United States Patent 11,098,302 (IDENTIFICATION OF POLYNUCLEOTIDES ASSOCIATED WITH A SAMPLE) - sequence listing, part 84

SEQ ID NO: 290415 - DNA, 138 bp, Homo sapiens
  misc_feature: GYAE6OF01BYK89.49.34.D01.1.454.CMB.1.raw
  modified_base (135)..(138): a, c, t, g, unknown or other
  misc_feature (135)..(138): n is a, c, g, or t
tcagagtcgagagacacgaccggtgctcgatttagatcgtctgtgttgggtttgggcagcctaaggctgccccagcgtcactctgttcccaccctcctctctctcgactctgagcgggctggcaaggcgcatagnnnn

SEQ ID NO: 290416 - DNA, 137 bp, Homo sapiens
  misc_feature: GYAE6OF01BSJNK.49.34.D01.1.454.CMB.1.raw
  modified_base (135)..(137): a, c, t, g, unknown or other
  misc_feature (135)..(137): n is a, c, g, or t
tcagagtcgagagacacgaccggtgctcgatttagatcgtctgtgttgtgttggcagcctaaggctgcccccagcgtcactctcgttcccaccctcctctctctcgactctgagcgggctggcaaggcgcatagnnn

SEQ ID NO: 290417 - DNA, 131 bp, Homo sapiens
  misc_feature: GYAE6OF02H8UM8.49.34.D01.1.454.CMB.1.raw
  modified_base (129)..(131): a, c, t, g, unknown or other
  misc_feature (129)..(131): n is a, c, g, or t
tcagagtcgagagacacgaccggtgctcgatttagatcgtctgtgttggttggcagcctaaggctgcccagcgtcactctgttcccacctcctctctctcgactctgagcggctggcaaggcgcatagnnn

SEQ ID NO: 290418 - DNA, 135 bp, Homo sapiens; identical to SEQ ID NO: 290392
  misc_feature: GYAE6OF02GLJ9G.49.34.D01.1.454.CMB.1.raw
  modified_base (135)..(135): a, c, t, g, unknown or other
  misc_feature (135)..(135): n is a, c, g, or t

SEQ ID NO: 290419 - DNA, 134 bp, Homo sapiens
  misc_feature: GYAE6OF02F0D4L.49.34.D01.1.454.CMB.1.raw
  modified_base (134)..(134): a, c, t, g, unknown or other
  misc_feature (134)..(134): n is a, c, g, or t
tcagagtcgagagacacgaccggtgctcgatttagatcgtctgtgttgggtttgggcagcctaaggctgccccagcgtcactctgttcccgccctcctctctctcgactctgagcggctggcaaggcgcatagn

SEQ ID NO: 290420 - DNA, 134 bp, Homo sapiens; identical to SEQ ID NO: 290396
  misc_feature: GYAE6OF02HX3BZ.49.34.D01.1.454.CMB.1.raw
  modified_base (134)..(134): a, c, t, g, unknown or other
  misc_feature (134)..(134): n is a, c, g, or t

SEQ ID NO: 290421 - DNA, 135 bp, Homo sapiens; identical to SEQ ID NO: 290402
  misc_feature: GYAE6OF02GPB5J.49.34.D01.1.454.CMB.1.raw
  modified_base (135)..(135): a, c, t, g, unknown or other
  misc_feature (135)..(135): n is a, c, g, or t

SEQ ID NO: 290422 - DNA, 130 bp, Homo sapiens
  misc_feature: GYAE6OF02GTI2D.49.34.D01.1.454.CMB.1.raw
  modified_base (130)..(130): a, c, t, g, unknown or other
  misc_feature (130)..(130): n is a, c, g, or t
tcagagtcgagagacacgaccggtgctcgatttagatcgtctgtgttggttggcagcctaaggctgcccagcgtcactctgttcccgccctcctctctctcgactctgagcggctggcaaggcgcatagn

SEQ ID NO: 290423 - DNA, 136 bp, Homo sapiens
  misc_feature: GYAE6OF02G4AQ7.49.34.D01.1.454.CMB.1.raw
  modified_base (134)..(136): a, c, t, g, unknown or other
  misc_feature (134)..(136): n is a, c, g, or t
tcagagtcgagagacacgaccggtgctcgatttagatcgtctgtgttgggtttgggcagcctaaggctgccccagcgtcactctgttcccgcctcctctctctcgactctgagcgggctggcaaggcgcatagnnn

SEQ ID NO: 290424 - DNA, 138 bp, Homo sapiens
  misc_feature: GYAE6OF02J0HXH.49.34.D01.1.454.CMB.1.raw
  modified_base (133)..(138): a, c, t, g, unknown or other
  misc_feature (133)..(138): n is a, c, g, or t
tcagagtcgagagacacgaccggtgctcgatttagatcgtctgtgttgggttgggcagcctaaggctgccccagcgtcactctgttcccaccctcctctctctcgactctgagcggctggcaaggcgcatagnnnnnn

SEQ ID NO: 290425 - DNA, 135 bp, Homo sapiens; identical to SEQ ID NO: 290402
  misc_feature: GYAE6OF02I2PXO.49.34.D01.1.454.CMB.1.raw
  modified_base (135)..(135): a, c, t, g, unknown or other
  misc_feature (135)..(135): n is a, c, g, or t

SEQ ID NO: 290426 - DNA, 136 bp, Homo sapiens; identical to SEQ ID NO: 290380
  misc_feature: GYAE6OF02GOINZ.49.34.D01.1.454.CMB.1.raw
  modified_base (135)..(136): a, c, t, g, unknown or other
  misc_feature (135)..(136): n is a, c, g, or t

SEQ ID NO: 290427 - DNA, 172 bp, Homo sapiens
  misc_feature: GYAE6OF02HHJ25.49.34.D01.1.454.CMB.1.raw
  modified_base (140)..(172): a, c, t, g, unknown or other
  misc_feature (140)..(172): n is a, c, g, or t
tcagagtcgagagacacgaccggtgctcgatttagatcgtctgtgttgggtttaggggcagcctaaggctgcccccagcgtcactctgttcccgccctcctctctctcgactctgagcgggctggcaaggcgcgattagnnnnnnnnnnnnnnnnnnnnnnnnnnnnnnnnn

SEQ ID NO: 290428 - DNA, 154 bp, Homo sapiens
  misc_feature: GYAE6OF02IFS0D.49.34.D01.1.454.CMB.1.raw
  modified_base (134)..(154): a, c, t, g, unknown or other
  misc_feature (134)..(154): n is a, c, g, or t
tcagagtcgagagacacgaccggtgctcgatttagatcgtctgtgttgggttgggcagcctaaggctgccccagcgtcactctgttcccgccctcctctctctcgactctgagcgggctggcaaggcgcatagnnnnnnnnnnnnnnnnnnnnn

SEQ ID NO: 290429 - DNA, 137 bp, Homo sapiens
  misc_feature: GYAE6OF02HA023.49.34.D01.1.454.CMB.1.raw
  modified_base (135)..(137): a, c, t, g, unknown or other
  misc_feature (135)..(137): n is a, c, g, or t
tcagagtcgagagacacgaccggtgctcgatttagatcgtctgtgttgggtttgggcagcctaaggctgccccagcgtcactctgttcccgccctcctctctctcgactctgagcgggctggcaaggcgcatagnnn

SEQ ID NO: 290430 - DNA, 169 bp, Homo sapiens
  misc_feature: GYAE6OF02GC4UF.49.34.D01.1.454.CMB.1.raw
  modified_base (139)..(169): a, c, t, g, unknown or other
  misc_feature (139)..(169): n is a, c, g, or t
tcagagtcgagagacacgaccggtgctcgatttagatcgtctgtgttgggtttggggcagcctaaggctgcccccagcgtcactctgttcccgccctcctctctcgtcgactctgagcgggctggcaaggcgcataggnnnnnnnnnnnnnnnnnnnnnnnnnnnnnnn

SEQ ID NO: 290431 - DNA, 137 bp, Homo sapiens; identical to SEQ ID NO: 290429
  misc_feature: GYAE6OF02I0B3J.49.34.D01.1.454.CMB.1.raw
  modified_base (135)..(137): a, c, t, g, unknown or other
  misc_feature (135)..(137): n is a, c, g, or t

SEQ ID NO: 290432 - DNA, 136 bp, Homo sapiens
  misc_feature: GYAE6OF02IQVPE.49.34.D01.1.454.CMB.1.raw
  modified_base (136)..(136): a, c, t, g, unknown or other
  misc_feature (136)..(136): n is a, c, g, or t
tcagagtcgagagacacgaccggtgctcgatttagatcgtctgtgttgggtttgggcagcctaaggctgcccccagcgtcactctgttcccaccctcctctctctcgactctgagcgggctggcaaggcgcatagn

SEQ ID NO: 290433 - DNA, 135 bp, Homo sapiens; identical to SEQ ID NO: 290402
  misc_feature: GYAE6OF02G1ZHX.49.34.D01.1.454.CMB.1.raw
  modified_base (135)..(135): a, c, t, g, unknown or other
  misc_feature (135)..(135): n is a, c, g, or t

SEQ ID NO: 290434 - DNA, 183 bp, Homo sapiens
  misc_feature: GYAE6OF02JFME1.49.34.D01.1.454.CMB.1.raw
  modified_base (139)..(141): a, c, t, g, unknown or other
  misc_feature (139)..(141): n is a, c, g, or t
  modified_base (143)..(143): a, c, t, g, unknown or other
  misc_feature (143)..(143): n is a, c, g, or t
  modified_base (145)..(183): a, c, t, g, unknown or other
  misc_feature (145)..(183): n is a, c, g, or t
tcagagtcgagagacacgaccggtgctcgatttagatcgtctgtgttggggtttggggcagcctaaggctgcccccagcggtcactctgttcccacctcctctctctcgactctcgagcgggctggcaaggcgcatagnnncntnnnnnnnnnnnnnnnnnnnnnnnnnnnnnnnnnnnnnnn

SEQ ID NO: 290435 - DNA, 136 bp, Homo sapiens; identical to SEQ ID NO: 290432
  misc_feature: GYAE6OF02I43UW.49.34.D01.1.454.CMB.1.raw
  modified_base (136)..(136): a, c, t, g, unknown or other
  misc_feature (136)..(136): n is a, c, g, or t

SEQ ID NO: 290436 - DNA, 139 bp, Homo sapiens
  misc_feature: GYAE6OF02H6W3Z.49.34.D01.1.454.CMB.1.raw
  modified_base (135)..(139): a, c, t, g, unknown or other
  misc_feature (135)..(139): n is a, c, g, or t
tcagagtcgagagacacgaccggtgctcgatttagatcgtctgtgttgggtttgggcagcctaaggctgccccagcgtcactctgttcccaccctcctctctctcgactctgagcgggctggcaaggcgcatagnnnnn

SEQ ID NO: 290437 - DNA, 136 bp, Homo sapiens
  misc_feature: GYAE6OF02HRK7Q.49.34.D01.1.454.CMB.1.raw
  modified_base (134)..(136): a, c, t, g, unknown or other
  misc_feature (134)..(136): n is a, c, g, or t
tcagagtcgagagacacgaccggtgctcgatttagatcgtctgtgttgggtttgggcagcctaaggctgccccagcgtcactctgttcccacctcctctctctcgactctgagcgggctggcaaggcgcatagnnn

SEQ ID NO: 290438 - DNA, 153 bp, Homo sapiens
  misc_feature: GYAE6OF02ITN4U.49.34.D01.1.454.CMB.1.raw
  modified_base (136)..(153): a, c, t, g, unknown or other
  misc_feature (136)..(153): n is a, c, g, or t
tcagagtcgagagacacgaccggtgctcgatttagatcgtctgtgttgggtttgggcagcctaaggctgcccccagcgtcactctgttcccgccctcctctctctcgactctgagcgggctggcaaggcgcatagnnnnnnnnnnnnnnnnnn

SEQ ID NO: 290439 - DNA, 136 bp, Homo sapiens; identical to SEQ ID NO: 290380
  misc_feature: GYAE6OF02HE63S.49.34.D01.1.454.CMB.1.raw
  modified_base (135)..(136): a, c, t, g, unknown or other
  misc_feature (135)..(136): n is a, c, g, or t

SEQ ID NO: 290440 - DNA, 152 bp, Homo sapiens
  misc_feature: GYAE6OF02GYHZJ.49.34.D01.1.454.CMB.1.raw
  modified_base (137)..(152): a, c, t, g, unknown or other
  misc_feature (137)..(152): n is a, c, g, or t
tcagagtcgagagacacgaccggtgctcgatttagatcgtctgtgttgggtttgggcagcctaaggctgcccccagcgtcactctgttcccgccctcctctctctcgactctgagcgggctggcaaggcgcgatagnnnnnnnnnnnnnnnn

SEQ ID NO: 290441 - DNA, 141 bp, Homo sapiens
  misc_feature: GYAE6OF02IARLE.49.34.D01.1.454.CMB.1.raw
  modified_base (136)..(141): a, c, t, g, unknown or other
  misc_feature (136)..(141): n is a, c, g, or t
tcagagtcgagagacacgaccggtgctcgatttagatcgtctgtgttgggtttgggcagcctaaggctgcccccagcgtcactctgttcccaccctcctctctctcgactctgagcgggctggcaaggcgcatagnnnnnn

SEQ ID NO: 290442 - DNA, 217 bp, Homo sapiens
  misc_feature: GYAE6OF02F38Y0.49.34.D01.1.454.CMB.1.raw
  modified_base (140)..(140): a, c, t, g, unknown or other
  misc_feature (140)..(140): n is a, c, g, or t
  modified_base (176)..(176): a, c, t, g, unknown or other
  misc_feature (176)..(176): n is a, c, g, or t
  modified_base (178)..(217): a, c, t, g, unknown or other
  misc_feature (178)..(217): n is a, c, g, or t
tcagagtcgagagacacgaccggtgctcgatttagatcgtctgtgttgggtttggggggaagaggaagactgaccggtccccccaggagttcaggtgctgggcacacgcggccctgggctgcctggtcaaggctacttcnctcgtcgactctgagcgggctggcaaggcgcatagncnnnnnnnnnnnnnnnnnnnnnnnnnnnnnnnnnnnnnnnn

SEQ ID NO: 290443 - DNA, 183 bp, Homo sapiens
  misc_feature: GYAE6OF02HGIIK.49.34.D01.1.454.CMB.1.raw
  modified_base (175)..(183): a, c, t, g, unknown or other
  misc_feature (175)..(183): n is a, c, g, or t
tcagagtcgagagacacgaccggtgctcgatttagatcgtctgtgttgggtttggggggaagaggaagactgacggtccccccaggagttcaggtgctgggcacagcggccctgggctgcctggtcaaggactacttcctctctcgactctgagcgggctggcaaggcgcatagnnnnnnnnn

SEQ ID NO: 290444 - DNA, 156 bp, Homo sapiens
  misc_feature: GYAE6OF02FV6ZB.49.34.D01.1.454.CMB.1.raw
  modified_base (128)..(128): a, c, t, g, unknown or other
  misc_feature (128)..(128): n is a, c, g, or t
  modified_base (134)..(156): a, c, t, g, unknown or other
  misc_feature (134)..(156): n is a, c, g, or t
tcagagtcgagagacacgaccggtgctcgatttagatcgtctgtgttgggtttgggcagcctaaggctgcccccagcgtcactctgttcccaccctctctctctcgactctgagcggtctggcaggcncatagnnnnnnnnnnnnnnnnnnnnnnn

SEQ ID NO: 290445 - DNA, 176 bp, Homo sapiens
  misc_feature: GYAE6OF01D1YF7.38.25.C03.1.454.CMB.1.raw
  modified_base (173)..(176): a, c, t, g, unknown or other
  misc_feature (173)..(176): n is a, c, g, or t
tcagtcgatcacgtcacgaccggtgctcgatttagtagtgtagatttgggtttgggggaagaggaagactgacggtcccccaggagttcaggtgctgggcacagcggccctgggctgcctggtcaaggactacttccacgtgatcgactgagcgggctggcaaggcgcatagnnnn

SEQ ID NO: 290446 - DNA, 173 bp, Homo sapiens
  misc_feature: GYAE6OF01CLO7A.38.25.C03.1.454.CMB.1.raw
  modified_base (171)..(173): a, c, t, g, unknown or other
  misc_feature (171)..(173): n is a, c, g, or t
tcagtcgatcacgtcacgaccggtgctcgatttagtagtgtagatttgggtttggggaagaggaagactgacggtccccaggagttcaggtgctgggcacagcggccctgggctgcctggtcaaggactacttccacgtgatcgactgagcgggctggcaaggcgcatagnnn

SEQ ID NO: 290447 - DNA, 512 bp, Homo sapiens
  misc_feature: GYAE6OF01DL6Y7.38.25.C03.1.454.CMB.1.raw
  modified_base (381)..(381): a, c, t, g, unknown or other
  misc_feature (381)..(381): n is a, c, g, or t
  modified_base (501)..(501): a, c, t, g, unknown or other
  misc_feature (501)..(501): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaatggaaacacaaagtatgcacataattccagggcagagtcatcatgaccnagacacatccacgagcactgcctacatggaactgagaacctgagatctgacgacacggccttatattatgtagagagaaacaaacttcctacttacataattacgacgtataggatcgtntttagtttacg

SEQ ID NO: 290448 - DNA, 506 bp, Homo sapiens
  misc_feature: GYAE6OF01B7I3L.38.25.C03.1.454.CMB.1.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaatggaaacacaaagtatgcacataatttccagggcagagtcatcatgaccacagacacatccacgagcactgcctacatggaactgaggaacctgagatctgacgacacggccttatacttatgtgcgagagacaaattcctacttacatattacgacgataggatgtctttacg

SEQ ID NO: 290449 - DNA, 512 bp, Homo sapiens
  misc_feature: GYAE6OF01C2RFO.38.25.C03.1.454.CMB.1.raw
  modified_base (380)..(380): a, c, t, g, unknown or other
  misc_feature (380)..(380): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatcctttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacagggcttgagtggatgggatggatcagcacttacaatggaaacacaaagtatgacacataattccaggcagagtcatcatgaccanagacacatccagagcactgcctacatggaactgaggaacctgagatcgtagaccgacgacggccttatacttatgtgacgagagaactaacttcctacttacattaagtacgacgataggaactgtctttac

SEQ ID NO: 290450 - DNA, 182 bp, Homo sapiens
  misc_feature: GYAE6OF01CPYAC.38.25.C03.1.454.CMB.1.raw
  modified_base (174)..(182): a, c, t, g, unknown or other
  misc_feature (174)..(182): n is a, c, g, or t
tcagtcgatcacgtcacgaccggtgctcgatttagtagtgtagatttgggtttgggggaagaggaagactagacggtcccccaggagttcaggtgctgggcacagcggccctgggctgcctggtcaaggactacttccacgtgatcgactgagcgggctggcaaggcgcatagnnnnnnnnn

SEQ ID NO: 290451 - DNA, 499 bp, Homo sapiens
  misc_feature: GYAE6OF01CCMQC.38.25.C03.1.454.CMB.1.raw
  modified_base (494)..(494): a, c, t, g, unknown or other
  misc_feature (494)..(494): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatcctttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaatggaaacacaaagtatgcacataatttccaggcagagtcatcatgacacagacacatccacgagcactgcctacatggaactgagaactgagatctgacgacacggccttatattatgtgcgagagactaattcctacttacatattacgagataggaatgtntttac

SEQ ID NO: 290452 - DNA, 556 bp, Homo sapiens
  misc_feature: GYAE6OF01C5J1K.38.25.C03.1.454.CMB.1.raw
  modified_base (274)..(274): a, c, t, g, unknown or other
  misc_feature (274)..(274): n is a, c, g, or t
  modified_base (361)..(361): a, c, t, g, unknown or other
  misc_feature (361)..(361): n is a, c, g, or t
  modified_base (393)..(393): a, c, t, g, unknown or other
  misc_feature (393)..(393): n is a, c, g, or t
  modified_base (399)..(399): a, c, t, g, unknown or other
  misc_feature (399)..(399): n is a, c, g, or t
  modified_base (409)..(409): a, c, t, g, unknown or other
  misc_feature (409)..(409): n is a, c, g, or t
  modified_base (422)..(422): a, c, t, g, unknown or other
  misc_feature (422)..(422): n is a, c, g, or t
  modified_base (448)..(448): a, c, t, g, unknown or other
  misc_feature (448)..(448): n is a, c, g, or t
  modified_base (549)..(549): a, c, t, g, unknown or other
  misc_feature (549)..(549): n is a, c, g, or t
tcagtcgatcacgtcacgaccggtgctcgatttagtagtgtagatttggggtttggggacccaaaaacccaccacccctcccttgggagaatcccctaggatcaccgagctcctcaccatggactggacctggagcattcctttctggtggcagcagcaacgaggtgcccactcccaggttcaattggtgcagtctggagcctgcggtgagacggcctcgggcctctgtgaacgtctcctgcgaggcttcgtggttactacttttagctagttntggtgtcagtctgggtgcgacgacggccctggacaagggcttggagtgagtgggatggatcagcattacaatggaaaacacaaagtntgacaactataattccgaggcagatacatcangaccanacgacacacnccaacgagcaacncgactacagtagaacctgacggtacngagtatcgagacgacgtacgacttaattagtagttagtcgacaagtacgaacgttaacctacttactactagttaacgttacgacgttagtacggtatgtnttttacg

SEQ ID NO: 290453 - DNA, 603 bp, Homo sapiens
  misc_feature: GYAE6OF01DY1K9.38.25.C03.1.454.CMB.1.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacacggccccgtggaccaagggcttggagtggagtggggatggatcgagctaacttaacaaagtggaaaacacaaaagtatagacaactaataagtttccgaagggacaggagtacagtacatacgaaccacaagaccaacactaccaacgagaccactcgacctaacagtacggaactcggaacggtaaccctagaacgtactcgtacgaccgaccgtacggtacctttaagtatttagttgtacgacgaagaagaacctaaacgtttccctaccttaacacttaacgttacgacgtagtaggtaacttgtcttttaacg

SEQ ID NO: 290454 - DNA, 651 bp, Homo sapiens
  misc_feature: GYAE6OF01C7BBL.38.25.C03.1.454.CMB.1.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacagggcttgaggtggagtgggatggatcagcacttacaatggaaacacaaagtatgacactaataactttccaagggtcagagtcatcatcgaccacagacacatccaacgacgacaactcgacctaacagtacggaactagaacggaacctaggacgattaccgtagaaccggaaccgtaaccgggtaccctttaagttaacgtttaacgtttaggtacggtaccggaaaggtaaacggtaaaccttaaaaaccgtttaccccttaacccgtttaaacctaaacgttttaaacgtttaaacccggtaaacggttaaacgttaagggtaaacggttcggttaaccttttttaaaccg

SEQ ID NO: 290455 - DNA, 532 bp, Homo sapiens
  misc_feature: GYAE6OF01CQD21.38.25.C03.1.454.CMB.1.raw
  modified_base (471)..(471): a, c, t, g, unknown or other
  misc_feature (471)..(471): n is a, c, g, or t
  modified_base (523)..(523): a, c, t, g, unknown or other
  misc_feature (523)..(523): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaagcctggggcctcagtgaaggtctcctgcaaggcttctggttacacctttaccaactatggtatcaactgggtgcgacaggcccctggacaagggcttgagtggatgggatggatcagcgcttacaataataacacacactatgcacagaagtccagggcagagtcaccgtgaccacggacacataccacgagcacacgcctacagtaggagttgaggagccgtgagatctgacgacacggccgtagtattactgtgcgagagtanagtaatagttgttatacggtactacgtgggacctacgggaaccctggtaccnccgtctccg

SEQ ID NO: 290456 - DNA, 516 bp, Homo sapiens
  misc_feature: GYAE6OF01CB75S.38.25.C03.1.454.CMB.1.raw
tcagtcgatcacgtcacgaccggtgctcgatttagtagtgtagatttgggtttgggggacccaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttggagtggatgggatggatcagcacttacaatggaaacacaaagtatgcacataatttcaggcagagtcatcatgacacagacacactaccacgagccactcgacctacatacggaactgacggaacctgaagatctagacgacacggtccttatattatgtgcgagagactaattcctacttacattaatacgtacgataggaatgtctttac

SEQ ID NO: 290457 - DNA, 614 bp, Homo sapiens
  misc_feature: GYAE6OF01E2WHS.38.25.C03.1.454.CMB.1.raw
  modified_base (359)..(359): a, c, t, g, unknown or other
  misc_feature (359)..(359): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgagaggcctggggcctcagtgaacgtctcctgcaaggcttctggttacacttttagcagttatggtgtcagctgggtgcgacacggccctggacgaagggtcttggagtgggatggggatggatcgagcacttacaataggaaacacaaagtatgacanattaattcgagggtacagagtcatcatcgaccacacgaacacactaccgacgacgccacgtcgacctacgagtacggaaactcggaacggaaccctaggacgtaactcgtacgaaccgacgaaccggttacctttaagttactttagttggtacgcggtaaagtaagaaccttaaacgtttacccttacctttaaactactttaaacgttaacccggtaacggtacgttaagggtaacgttgtacgtttttaacg

SEQ ID NO: 290458 - DNA, 618 bp, Homo sapiens
  misc_feature: GYAE6OF01C3YQ7.38.25.C03.1.454.CMB.1.raw
  modified_base (396)..(396): a, c, t, g, unknown or other
  misc_feature (396)..(396): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggctcgagtgaacgtctctgcaaggcttctggttactacttttagctagttatggtgtcagcgtggtgcgacaggccctggacagggcttgagtggagtgggatggatcagcacttaacaataggaaaacacgaaagtatagacaacaataactttcgaaggacagagtacatacatagaccanagacacagtccaacgacgacactcgacctacattacggaaccttggaacggtacctaggacgataccgtacggaaccgtaacaccggtacctttaagttactttacgttaggtacgtacgaagggtaactaaaccgtaaactttccccgtaacctttaactaaacgttaacgttaaaccggacggttaaacgtagggtaaacgtgttacgttttttaaaccg

SEQ ID NO: 290459 - DNA, 621 bp, Homo sapiens
  misc_feature: GYAE6OF01B8Y00.38.25.C03.1.454.CMB.1.raw
  modified_base (206)..(206): a, c, t, g, unknown or other
  misc_feature (206)..(206): n is a, c, g, or t
  modified_base (351)..(351): a, c, t, g, unknown or other
  misc_feature (351)..(351): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacaggtgcccactcccaggttcaattggtgcagtctggagctgcggtgaagnggcctggggcctcagtgaacgtctcctgcaaggcttcgtggttactacttttagctagttatggtgtcagcgtgggtgcgacacggccctggacagggtcttggagtggatgggatggatcgagctacgttacaagtacggaaanaactaaagtatagaccaagtattaacgtttcgaggacagacgtacagtctagacgaaccagacgaactacagtacccaagacgacacgtagacctacagtacggaacctaggaccgtaactagagtactcgagaccgaacgtccggtactttagtactttagtggtacgagtacgtaacggtaacctaactttcccgttaaccttaaacgttacgttaaacgttaacgtaacggaacgttagggtaaactttgttaccgttttttaaacg

SEQ ID NO: 290460 - DNA, 573 bp, Homo sapiens
  misc_feature: GYAE6OF01EWL8I.38.25.C03.1.454.CMB.1.raw
  modified_base (388)..(388): a, c, t, g, unknown or other
  misc_feature (388)..(388): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagcgtgggtgcgacaggccctggacaagggcttgagtggatgggatggatcagcacttacaatggaaacacaaagtatagacacataacttccgaggcagagtcatcatacgaccanagacacatccacgagcactcgacctacataggaactagaacggaactagagatcgtagaacgacgtaaccggtcctttaagttatttagttcggtagacgtaagaacgtaactaaacgtttacccttaccgttaacacttaaacgttaaccgacggtaagttagggtaacgttgtctttttaacg

SEQ ID NO: 290461 - DNA, 514 bp, Homo sapiens
  misc_feature: GYAE6OF01ATNCH.38.25.C03.1.454.CMB.1.raw
  modified_base (345)..(345): a, c, t, g, unknown or other
  misc_feature (345)..(345): n is a, c, g, or t
  modified_base (509)..(509): a, c, t, g, unknown or other
  misc_feature (509)..(509): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctgggggcctcagtgaacgtctcctgcaaggcttctggttacaccttttagctagttatggtgtcagctgggtgcgacaggccctggacaagggcttgagtggatgggatggatcagcacttacaagtaggaaacanaaagtatagacacataattcagggcagagtcatcatcgaccacagacacatccagacgcactcgacctacatggaactcggagaactgacgatcgagacgacgacgtaccttatacttatgtgcgagagactaactcctacttacatatacgactatagatgtntttag

SEQ ID NO: 290462 - DNA, 179 bp, Homo sapiens
  misc_feature: GYAE6OF01CS45H.38.25.C03.1.454.CMB.1.raw
  modified_base (173)..(179): a, c, t, g, unknown or other
  misc_feature (173)..(179): n is a, c, g, or t
tcagtcgatcacgtcacgaccggtgctcgatttagtagtgtagatttgggtttggggggaagaggaagactgacggtcccccaggagttcaggtgctgggcacagcggccctgggctgcctggtcaaggactacttccactgatcgactgagcgggctggcaaggcgcatagnnnnnnn

SEQ ID NO: 290463 - DNA, 590 bp, Homo sapiens
  misc_feature: GYAE6OF01DAHL9.38.25.C03.1.454.CMB.1.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggccctggacaagggcttgagtggatgggatggatcagcacttacaatggaaaacacaaagtatgacaactaataactttccgaagggcagagtcatcatcgaccacagacacatccacgagcactcgacctacagtacggaactggaacggaaccctgaacgtactaccgtaggaccgtactaccggtacctttaattactttacttaggtacgtacggaagaagtaacctaaaacgtttccctacctttaacaagtttaacgttaacgtaacgtaagttagggtaaacgttgtactttttaacg

SEQ ID NO: 290464 - DNA, 174 bp, Homo sapiens
  misc_feature: GYAE6OF01A2IDI.38.25.C03.1.454.CMB.1.raw
  modified_base (173)..(174): a, c, t, g, unknown or other
  misc_feature (173)..(174): n is a, c, g, or t
tcagtcgatcacgtcacgaccggtgctcgatttagtagtgtagatttgggtttgggggaagaggaagactgacggtcccccaggagttcaggtgctgggcacagcggccctgggctgcctggtcaaggactacttccacgtgatcgactgagcgggctggcaaggcgcatagnn

SEQ ID NO: 290465 - DNA, 563 bp, Homo sapiens
  misc_feature: GYAE6OF01DLCGC.38.25.C03.1.454.CMB.1.raw
  modified_base (348)..(348): a, c, t, g, unknown or other
  misc_feature (348)..(348): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggccctggacaagggcttgagtggatgggatggatcgagcacttacaataggaaacacaaagtntagacacataatttccaggcagagtcatcatcgacacagacacactcacgagacactcgcctacatacggaactaggaacggaacctggaagacgtctaggaccgacgtaccggtaccttaattagttattagtgtacgaagtacgtaacgtaaactttcctaccttaactacttaacttacgtaacgtagttagggtaacgttgtcttttaacg

SEQ ID NO: 290466 - DNA, 585 bp, Homo sapiens
  misc_feature: GYAE6OF01BUDIS.38.25.C03.1.454.CMB.1.raw
tcagtcgatcacgtcacgaccggtgctcgatttagtagtgtagatttgggttgggggacccaaaaccacacccctccttgggagtaatcccctagatcactaggtcggtacctcgaaccatgggacgtccggaccgtggagcatccttttcgttggtggcaggccaggcaacaggtggcccaactcccaggtttccaattggtgcagtctggaggctggcggtagagaggcctggggcctcagtgaacgtctcctgcaaggcttctggttacacttttagctagttatggtgtcagctgggtgcgacaggcccctggacaagggcttggagtggatgggatggatcagcacttacaatggaaacacaaagtatgcacataattccagggcagagtcatcatgacacagacacatccagacgcactgacctacatggaactggagtaacctgacgatcgtgaaccgcgaaccggtccttaagttaacttagttaggtgaccgtagaacgtaacttaaactttcccttacctttacgaacttaagttaaccgtacggaacgtttaggaaggttgtacgtttttaacg

SEQ ID NO: 290467 - DNA, 703 bp, Homo sapiens
  misc_feature: GYAE6OF01CVJBA.38.25.C03.1.454.CMB.1.raw
tcagtcgatcacgtcacgaccggtgctcgatttagtagtgtagatttgggtttggggacccaaaaaccacacccctccttgggagaatcccctagatcacagctcctcaccatggactggacctggagcatccttttctggtggcagcagcaacaggtgcccactcccaggttcaattggtgcagtctggagctgcggtgaagaggcctggggcctcgagtagaacgtctccgtgcgaaggtcttacgtggttaactacgttttagcgtagttagtggtgtcgagtcgtgggtgcgacgacggccccgtaggaccgaaggtcgttggaggtggagttaggagtggagtcgagactaacttaacgaagttaggaaaacaacgtaaaagtatacgactaacgtaagttaacgttaccgaagggtacgtaagtaggtaccaattacgaacgtacgaaccgaacgaacgaccaaacgtactacccgaacgacgaccgtacgacgtacctacgtaagtacggaaacgtaggaaccggtaacctaggaacgtagtaccgtacggaaccgtaccgtaaccggttaccttaagttaacgtttagtacgggtactacggaaagaacgttaacctaacgtttacccctaacttaacgttaaccttaaaccgttacggaacgttaagtaggtacgttacgtttgttttaaccgg

SEQ ID NO: 290468 - DNA, 536 bp, Homo sapiens
  misc_feature: GYAE6OF01BTBT9.38.25.C03.1.454.CMB.1.raw
  modified_base (285)..(285): a, c, t, g, unknown or other
  misc_feature (285)..(285): n is a, c, g, or t
  modified_base (407)..(407): a, c, t, g, unknown or other
  misc_feature (407)..(407): n is a, c, g, or t
  modified_base (502)..(502): a, c, t, g, unknown or other
  misc_feature (502)..(502): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacnggccctggacagggcttgagtggatgggatggatcagctacttacaatggaaacagaaaagtatgacaactataacttacgagggcaagagtcatcatcgaaccacagacacatccacgacncactgacctacagtaggactaggaacgaacctgagatcgtagacgactacggtacttagtattatcgtgcgagacgtaactaacttcctacttanattaacgtacgtacgagtaggacgtgtctttacg

SEQ ID NO: 290469 - DNA, 179 bp, Homo sapiens
  misc_feature: GYAE6OF01BUA9W.38.25.C03.1.454.CMB.1.raw
  modified_base (174)..(179): a, c, t, g, unknown or other
  misc_feature (174)..(179): n is a, c, g, or t
tcagtcgatcacgtcacgaccggtgctcgatttagtagtgtagatttgggtttgggggaagaggaagactgacggtccccccaggagttcaggtgctgggcacagcggccctgggctgcctggtcaaggactacttccacgtgatcgactgagcgggctggcaaggcgcatagnnnnnn

SEQ ID NO: 290470 - DNA, 593 bp, Homo sapiens
  misc_feature: GYAE6OF01EFVHC.38.25.C03.1.454.CMB.1.raw
tcagtcgatcacgtcacgaccggtgctcgatttagtagtgtagatttgggtttggggacccaaaaaccacacccctccttgggagaatcccctagatcacagctcctcaccatggactggaccttgagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggccctggacaagggcttgagtggatggggatggatcagcacttaacaataggaacaacaaagtatagacaacaattaattccgagggcagagtcatcatcgaccacagacacataccacgacgacactcgacctacagtacggaactaggaacggaacctagaagtactctacggacgtaccgtacgggtacctttaattaagtttattggtagacggtaagaacgtaactaaaacttcccttacccttaactaacttaacgttaaccggaacgtaacgttaagggtaaacgttggtaccttttaacg

SEQ ID NO: 290471 - DNA, 546 bp, Homo sapiens
  misc_feature: GYAE6OF01ADEQI.38.25.C03.1.454.CMB.1.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaatggaaacacaaagtatgacacataatttcagggcagagtcatcatgaccacagacacactccacgacgcactcgaccctacagtacggaactggaacggaacctggaacgatctaggacgacgtacggtccttaagttattattgtacgacgtagagaacctaacttccctaccttacaacttattaacgtacgtataggaagttgtctttacg

SEQ ID NO: 290472 - DNA, 754 bp, Homo sapiens
  misc_feature: GYAE6OF01BQRB4.38.25.C03.1.454.CMB.1.raw
  modified_base (281)..(281): a, c, t, g, unknown or other
  misc_feature (281)..(281): n is a, c, g, or t
tcagtcgatcacgtcacgaccggtgctcgatttagtagtgtagatttgggttggggacccaaaaccacacccctccttgggagtaatccctagatcacaggctcctcacccatggactggacctggagcatcctttcgttggtggcagcagcaacaggtgccactcccaggttcaattggtgcagtctggagctgcggtgaagaggcctggggcctcagtgaacgtctcctgcaaggcttcgtggttactacttttagctagttatggtgtcagctgggtncgacaggcccctggacgagggcttggagtggatgggatggatcgagcactttaacaagtacggaaaacaacgtaaaagttagtacgtacaacgtaattaacgtttccgaagggcaggacgttacatacgatacgacctaacaacgtaccaactaacgtcccgaacgaacgacctacgtaccgacccttaccgtaaacggtacgggtaaaccgtcgggtaaaccggtaacccgttaagggtaacgtaacgttaccgtaaggaacccggtaaccgtaacccgggttacccttttaattaacgtttacggtttacggtacgggtaaccgggtaaaacgtaaccggttaaaccttaaaccgttttacccccttaacccgttttaaacctaacgtttaaaccggtttaacccggtaaaccgggttaaaggtttaacggggttaaacggtttaccgttttaacggttttttaaacccgg

SEQ ID NO: 290473 - DNA, 626 bp, Homo sapiens
  misc_feature: GYAE6OF01A9S9H.38.25.C03.1.454.CMB.1.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacacggcccctggacgaagggcttggaggtggagtgggatggatcgagcacttacgaataggaaacaacgaaagtatgacactaattaatttccgagggtacaagagtacatcatacgaccaacaagacacactaccaacggacgacaactcgaccctaacgaagttacggaaccgttaggaacgggtaaccgtaggaacgtagtaccgtacgaaccggaaccgtaaccggtacctttaagttaagtttagttcggtagacgtaaggaacggtaactaaactttcccttaccgttaaactacgttaacttaacgtacgtaagtaggtaagttcgtcgttttaac

SEQ ID NO: 290474 - DNA, 639 bp, Homo sapiens
  misc_feature: GYAE6OF01C72BD.38.25.C03.1.454.CMB.1.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagcagttatggtgtcagctgggtgcgacaggccctggacaagggcttgagtggatgggatggatcagcacttacaatggaaaacacaaagtatgacactaataacttccgaggcagagtcatcatcgaccacgagaacacgactaccgaacgacgaccactacgaccttacgaagtacgggaaaccttgggaacggtaaaccttaggaacgtacttaccgtacggaaccgtaaccgtacgggttaccctttaagttaagtttagtttacggtagtacgaaacgtaacgtaaaccgttaaactttaccccttaaccgtttaacctaagtttaacgtttaccgaaacgtaagtttagggtaaacgttcgtttacgtttttaaccg

SEQ ID NO: 290475 - DNA, 553 bp, Homo sapiens
  misc_feature: GYAE6OF01DMJQ5.38.25.C03.1.454.CMB.1.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggccctggacaagggcttgagtggatgggatggatcagcacttacaagtggaaacacaaagtatgacacaataactttccagggcagagtcatcatcgaaccacagacacatccagagcactgccctacatacggaactggagaacctgagtatacgtgaacgacgacggtacctttagtaatttagttgtgacgaagaagtaactaaaacgtttccctacctttacaagttaacttacgacgtaagtagggtaaatgtacttttaacg

SEQ ID NO: 290476 - DNA, 641 bp, Homo sapiens
  misc_feature: GYAE6OF01BQPVT.38.25.C03.1.454.CMB.1.raw
  modified_base (208)..(208): a, c, t, g, unknown or other
  misc_feature (208)..(208): n is a, c, g, or t
  modified_base (447)..(447): a, c, t, g, unknown or other
  misc_feature (447)..(447): n is a, c, g, or t
tcagtcgatcacgtcacgaccggtgctcgatttagtagtgtagatttgggtttggggacccaaaaaaccacacccctccttgggagaatcccctagatcacagctcctcaccatggactggacctggagcattccttttcttggtggcagcagcaacaggtgcccactcccaggttcaattggtgcagtctggagctgcggtgaaggnggccgtgggcctcgagtgaacgtctcctgacaaggtcttcgtggttactacttttagctagttatggtgtcagtcgtgggtgcgacgacggcccgtaggacaagggtcttaggagtgggagtgggatggatcgagtactacttaacgaagttacggaaaacaagtaaagtatacggactaacgtaacttaacgtttccgaagggtacaggtaacgtcaagtcaagtacgaccaacgaanaccacaactccgaagacgacacgtacgacctacgagtacgaacgtaggacgaacgtagagtactcgacgaacgaccgtacgttacttaagttagttagtacggagacggaagtaacgtaacttaaaccgtttcccttaacctaagtaacgttaacttacggaacgttagtaggtaacgttgttacgttttaacg

SEQ ID NO: 290477 - DNA, 608 bp, Homo sapiens
  misc_feature: GYAE6OF01DR8VT.38.25.C03.1.454.CMB.1.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgagaggcctggggcctcagtgaacgtctcctgcaaggcttctggttacacttttagctagttatggtgtcagtcgtgggtgcgacgacggcccctaggacgaagggtcttgagtggagtgggatggatcgagcacttacaatggaaacacaaagtatgacataataacttcgaggcagagtcatcatcgacacagaacacactccgaagacgccactcgaccctaacagtacggaactaggaacggtaacctgagtacgtaccgtaggaaccgacgtaccggttacctttaagttaactttagttaggtacggacgtaacggtacgtaaaccgtaaactttcccgttaccttaacgtaacttaacgttacggtaacgtaacgtagggtaacgttgttcgtttttaacg

SEQ ID NO: 290478 - DNA, 479 bp, Homo sapiens
  misc_feature: GYAE6OF01CIAV7.38.25.C03.1.454.CMB.1.raw
  modified_base (434)..(434): a, c, t, g, unknown or other
  misc_feature (434)..(434): n is a, c, g, or t
  modified_base (461)..(479): a, c, t, g, unknown or other
  misc_feature (461)..(479): n is a, c, g, or t
tcagtcgatcacgtcacgaccggtgctcgatttagtagtgtagatttgggtttgggtgtgtctgtggtcatgatgactctgccctggaaattatgcacataatttccagggcagagtcatcatgaccacagacacatccacgagcactgcctacatggaactgaggaacctgagatctgacgacacggccttatattattgtgcgagagacaaattcctccttacatattacgacgatggaagtgctttatttctttgactccgtggggccagggacccctgatcaccgtctcctcggcctccaccacggccactcggtcctcccctgccaccctcctaccaagacgccaccctcgtcggggcacgacgccggccctgggctcgccgtggtccaaggaccttactccgacgtgatccgacgtggacggccgggntcgggacgaacgggtccgacactagcnnnnnnnnnnnnnnnnnnn

SEQ ID NO: 290479 - DNA, 551 bp, Homo sapiens
  misc_feature: GYAE6OF01D5J5T.38.25.C03.1.454.CMB.1.raw
  modified_base (416)..(416): a, c, t, g, unknown or other
  misc_feature (416)..(416): n is a, c, g, or t
  modified_base (516)..(516): a, c, t, g, unknown or other
  misc_feature (516)..(516): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatcctttttcttggtggcagcagcaacaggtgcccactcccaggttcaattggtgcagtctggagctgcggtgaagaggcctggggcctcagtgaacgtctcctgcaaggcttcgtggttactacttttagctagttatggtgtcagcgtgggtgcgacacggcccctggacaagggcttggaggtggagtggggatggatcgagcacgttacaagtaggaaaacactaaagtatgacatataattccgagggcagatcatcatcgacacagacacactaccacgancactgacctacagtacggaactaggaacgacctgacgatcgtagacgacgtacggtacttatattagtagtcggacgagagaacgtaacttcctacttanattagtaacgactagtaggtagttgtcttttaacg

SEQ ID NO: 290480 - DNA, 635 bp, Homo sapiens
  misc_feature: GYAE6OF01CTSJU.38.25.C03.1.454.CMB.1.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcgagtgaacgtctcctgcaaggcttctggttactactttttagctagtttatggtgtcagcgtgggtgcgacacggcccctaggacgaagggcttggaggtggagtggggatggatcgagctaacttaacaagtaggaaacaacgtaaagtatagacaactaattaacgtttaccgaagggtaccaaggtaacgtacaattacaagtacgaaccacgaacgaaccaacactaccgaacgacgaccaacgtcgaccctaacgagtacggaaacctaggaacgtaaccgtaggaacgtattacgacggaacgaaccgtacggtacctttaaagttacttagttcgtagacgagaacgtaacttaacttaccttacttactaacgttactacgacgttagtaggtagtcgttattttacg

SEQ ID NO: 290481 - DNA, 548 bp, Homo sapiens
  misc_feature: GYAE6OF01AYV5E.38.25.C03.1.454.CMB.1.raw
  modified_base (444)..(444): a, c, t, g, unknown or other
  misc_feature (444)..(444): n is a, c, g, or t
  modified_base (472)..(472): a, c, t, g, unknown or other
  misc_feature (472)..(472): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaaatggaaaacacaaaagtatagcaacataaatttccaagggcaggacgtacatcatgacaacagacacatccacgagcactcgacctacagtggaactgaggaacctgagatntagacgacacggacttatattatgtagngagaaggaacctaaagttcccttaccttaacaacgttaattaacggaactaagtaggaaacgttgtacgttttaac

SEQ ID NO: 290482 - DNA, 642 bp, Homo sapiens
  misc_feature: GYAE6OF01EH215.38.25.C03.1.454.CMB.1.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcgagtgaacgtctcctgacaaggtcttcgtggttactacttttagctagttatggtgtcagtcgtgggtgcgacgacggcccctaggacgagggtcttggagtggacgtggggaggactccgtccgattcgttggaccaaaccacactacgcacacacgtacagacagactcgacgacgttacccggacggtaacgaactcccgaacggtacgacaaccgtacgtacctaacgaagtaggaagtaacgtgaagtacgcgtagagtatcgtagaccgacgtaacggcgttagttacgttcgtaggtcgacggaggagggaccggggcgggtacggggtccgttacgggttagggttaacggttagggtcgttacgttttagacgttacggtcggtacggggaacgaagggtacgtaaggttccggg

SEQ ID NO: 290483 - DNA, 542 bp, Homo sapiens
  misc_feature: GYAE6OF01EDNQR.38.25.C03.1.454.CMB.1.raw
  modified_base (389)..(389): a, c, t, g, unknown or other
  misc_feature (389)..(389): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagctagttatggtgtcagctgggtgcgacaggcccctggacaagggcttgagtggatggggatgggatcagcacttacaataggaaaacacaaagtatgacaacataattccaggcagagtcatcatgaccanacgacacataccacgagcactcgacctacagtcggaactgaacgaacctgagatcgagacgacgacggtaccttatattatgtgacgagagaactaaactttcctaccttacaacttaattaaccgacgtattagggaagttgtcttttaacg

SEQ ID NO: 290484 - DNA, 600 bp, Homo sapiens
  misc_feature: GYAE6OF01EPLY1.38.25.C03.1.454.CMB.1.raw
  modified_base (352)..(352): a, c, t, g, unknown or other
  misc_feature (352)..(352): n is a, c, g, or t
tcagtcgatcacgtcacgaccggtgctcgatttagtagtgtagatttgggtttggggacccaaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagcgtgggtgcgacacggccctggacaagggcttgagtggagtgggatggatcagcattacaataggaaacacgaaagtntagacaactaattaactttaccgagggaccagtacgtacaatacatacgaaccacgagaacaacatacccaacgagacactcgaccctacagttacggaactggaacggaactagacgtatcgtagaccgacgtacggtacctttataagtttagttggtgacggaagtaacgaactaaacgtttccctaaccttaacaacttaagtaaccgtaacgtaacgttaaggtaagtttgtcgtttttaacg

SEQ ID NO: 290485 - DNA, 779 bp, Homo sapiens
  misc_feature: GYAE6OF01DWBGB.38.25.C03.1.454.CMB.1.raw
  modified_base (210)..(210): a, c, t, g, unknown or other
  misc_feature (210)..(210): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacaggtgcccactcccaggttcaagttggtgcagtctggagcgtgcggtagaaggnggccgtggggcctgagtgaacgtctccgtgcgaaggtcttcgtggttactacgttttagcgtagtttagtggtgtcgagtcgtggtcgcgtacgcggcccgtaggaacgaagggtcgttaggaggtggaggttgggagtggtagtacgaggtactaacgttaagaaacgttaacggaaaacgtaacgtaaagtacgtagaactaacgtaaattaacgtttaccggaagggtaccgtaaggtacgtacgtacgttaacgacgttacgaaaccgaacgtaaccgaactaacgtaacctaccggaacgaaccgtactaaccggtactaaccgtacgaacgtaaggtaacgtacggaacggtaaccgtaggtaacgaacgttaccgtaacggaacccgtaaccgtacggtaaccctttaagttaaccgttagggtacgtaaggtaccggaaacgttaaccgtaaaccgtttaaaccgtttacccgttaacgtttaaaccgtacgtttaaaccgaaccggttaacgggttaacgtaaaggtttaacgggttacgtttacgttttttaaaccggg

SEQ ID NO: 290486 - DNA, 804 bp, Homo sapiens
  misc_feature: GYAE6OF01C9Z0N.38.25.C03.1.454.CMB.1.raw
  modified_base (346)..(346): a, c, t, g, unknown or other
  misc_feature (346)..(346): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaggcttctggttacacttttagctagttatggtgtcagtcgtgggtgcgacgacggcccctggacgaagggcttgaggtggagtggggagtggatcgacgctaacctttanaaagtacggaaaaacaacgtaaaggtaataggacctaactaaattaacgttttccgaacgggtacaaggtaacgtccaagttacaattacgaaccctaacgaaacggtaacccaacctaaccgtaccccgaaaccgggaacgtacccgtaaccgttccggaaccccttaaccgtaacgtttaaccgggaaacccgttaacgggaaaccgggtaaaccgttacgggaaacgtacggttaaccggtaacggtaaacccgggtaacccgtaacccgggtttaaccttttaacttaacggtttttaaggttcgggttaacgggaaccgggtaaacggttaaaccgtaaaccgtttaaacccttttacccttacccgtttaaacgttaaccgtttaacgtttaaacccggtaacggttaacggttaaggggtttaaacggttcggtttacgttttttaaccgg

SEQ ID NO: 290487 - DNA, 614 bp, Homo sapiens
  misc_feature: GYAE6OF01AYS4M.38.25.C03.1.454.CMB.1.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagcgtgggtgcgacacggcccctggacgaagggcttgagtggagtgggatggatcagctacttacaagtaggaaaacacgaaagtatagacaactaattaacttccgaagggcaaggtacgtacatcaatcgaacctacgacgacaacactaccaacgacgaccaactcgaccctagagtaggaaccgtggaacggaacctgaacgtataccgtaggaaccgaacgtaccggtacctttaagtagtttacgttggtacggtacgaaaggaacgtaaacgtaaacctttccctaccttaacaacttacgttaacgtacgtattaggaacgttgttaccgtttaag

SEQ ID NO: 290488 - DNA, 661 bp, Homo sapiens
  misc_feature: GYAE6OF01AJKUQ.38.25.C03.1.454.CMB.1.raw
  modified_base (531)..(531): a, c, t, g, unknown or other
  misc_feature (531)..(531): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacgaggtcgcccacctcccaggttcaagttggtgcagtctggagctggcggtgaaggacggccgtggggcctcgagtcgaacgtctcctgcaaggtcttcgtggttaccttacttttagctagtttagtggtgtcagtcgtgggtgcgacgacggccccgtaggacgaagggtcttaggaggtggagtggggatggatcgacgacctaacgttaacgaagtacggaaaccaacgtaaagtatcgactaactaattaaacttccggaagggcaagacgtacataccaagtaccgaacccgaacgaacgaaccgaaccacgtaaccccgagaaccgacctaccgtacgacctaacgagtacggaactggaacgtaacgngaacgtatccgagaccgacgtacgttacttattagttagtggtatagagtaacgaacttaaccttcccttaaccttataaacgtttacttaaccggagtagttaaggtaacgttcgttaacgtttttacg

SEQ ID NO: 290489 - DNA, 622 bp, Homo sapiens
  misc_feature: GYAE6OF01D8FRS.38.25.C03.1.454.CMB.1.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcgagtgaacgtctcctgcaggtcttcgtggttactacttttagctagttagtggtgtcgagtcgtgggtcgcgacgacggccctaggacgtagggcttggagtggagtgggatggatcgagactaacttagaagtaggaaaacaacgtaaagtactagacaacgtaattaacgttaccggaagggtacgaagtacgtaccattacaagtacaaccacgacgtaaccacaactccgaagacacacgtacgacctacgagtacggaactaggaacgactaggactagtcgacgaccgacgtaccgttacttagtattacgtgacgacgagtaacgtaaccgttaacttccttacttaacgtacttaacgttacgtacggtaataggttacgttgttacgtttaacg

SEQ ID NO: 290490 - DNA, 640 bp, Homo sapiens
  misc_feature: GYAE6OF01C6KRA.38.25.C03.1.454.CMB.1.raw
tcagtcgatcacgtcacgaccggtgctcgatttagtagtgtagatttgggtttggggacccaaaaaaccacacccctccttgggagaatcccctagatcacagctcctcaccatggactggacctggagcatccttttcttggtggcagcagcaacaggtgcccactcccaggttcaattggtgcagtctggagctggcggtgaagaggccgtggggcctcagtgaacgtctcctgcaaggtcttcgtaggttactacttttagctagttatggtgtcagtcgtgggtgcggacacggcccgtggacgaagggcttggaggtggagtggggtatgggatcgagctacttaacgaagtacggaaaacacgaaagtatgactaactattaacgttacgagggacaggtacgtacattacacgtacgaaccaacgaagtaaccacgtaactaccgaacgacgactacgtacgacctacgaagtcggtaaacgtcgggaacgtaacgtggaagtacgtccgtaaggacccgtaaccggtacgtacctttaattactttaggttacggtcgtacggagtaacgtaacgtaacttccctttacttaactaagttaccgttagaacgtagtaggtaatgttatttac

SEQ ID NO: 290491 - DNA, 600 bp, Homo sapiens
  misc_feature: GYAE6OF01BEC5N.38.25.C03.1.454.CMB.1.raw
  modified_base (592)..(592): a, c, t, g, unknown or other
  misc_feature (592)..(592): n is a, c, g, or t
tcagtcgatcacgtcacgaccggtgctcgatttagtagtgtagatttgggtttggggacccaaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttacacttttagcagttatggtgtcagtcgtgggtgcgacacggcccctggacaaggcttggagtggatgggatggatcagcacttacaataggaaacacaaagtatagacaatataacgttccgaagggacagtagtacatacaatcgaaccacaacgacaaccaacgtacccaacgaacgccaactacgaccctaacaagtacggtaaacgtacggaacggtaacctagacgtaactccgtagaaccggacgtaccggtaccttaatatttacgttgtagcgaagaagtaactaactttcccttacttactaattaataacgtacgtagtaggtaagttcgtnttttaacg

SEQ ID NO: 290492 - DNA, 671 bp, Homo sapiens
  misc_feature: GYAE6OF01CZL11.38.25.C03.1.454.CMB.1.raw
  modified_base (358)..(358): a, c, t, g, unknown or other
  misc_feature (358)..(358): n is a, c, g, or t
  modified_base (365)..(365): a, c, t, g, unknown or other
  misc_feature (365)..(365): n is a, c, g, or t
  modified_base (414)..(414): a, c, t, g, unknown or other
  misc_feature (414)..(414): n is a, c, g, or t
  modified_base (450)..(450): a, c, t, g, unknown or other
  misc_feature (450)..(450): n is a, c, g, or t
tcagtcgatcacgtcacgaccggtgctcgatttagtagtgtagatttgggtttggggacccaaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagcgtgggtgcgacaggcccctggaacgaagggtcttggagtggatggggatggatcagcaacttacaatggaaaacacaaagtntgacaanaacttaagtttccgaagggtacaaggtacgtcaatcaatacgaacctanacgaacacaactccaacgaacgccaatcgcccttanaagtacggaaacgtggaacggtaaccctaggaacgcgtacgtacggaaccgtaccgtaacgggttacctttaagttagtttacgttggtaacggtaccggaaagtacgaaaccgttaaaactttaccccgttaaccctttaaaccgtaaagtttaacgttaaccgggtaaacgttaaacggtaagggggtttaaacgttacggttaccgtttttttaaacg

SEQ ID NO: 290493 - DNA, 173 bp, Homo sapiens
  misc_feature: GYAE6OF01ENROL.38.25.C03.1.454.CMB.1.raw
  modified_base (173)..(173): a, c, t, g, unknown or other
  misc_feature (173)..(173): n is a, c, g, or t
tcagtcgatcacgtcacgaccggtgctcgatttagtagtgtagatttgggtttgggggaagaggaagactgacggtcccccaggagttcaggtgctgggcacagcggccctgggctgcctggtcaaggactacttccacgtgatcgactgagcgggctggcaaggcgcatagn

SEQ ID NO: 290494 - DNA, 643 bp, Homo sapiens
  misc_feature: GYAE6OF01BBCMG.38.25.C03.1.454.CMB.1.raw
tcagtcgatcacgtcacgaccggtgctcgatttagtagtgtagatttgggtttggggacccaaaaaccacacccctccttgggagaatccctagatcacagctcctcaccatggactggacctggagcatccttttcttggtggcagcaggaacaggtgcccactcccaggttcaattggtgcagtctggagctgcggtgaaggaggcctggggcctcgagtgaacgtctctgcgaaggtcttctggttactacttttagctagttatggtgtcaggcgtgggtgccgacacggcccgtggaacgaagggtcttggaggtggagtggggactgggatcgagtcgaacttacgaaagtaggaaaacaacgtaaaagtatcgaacaactaaagttaacttaccggagggtacgaagtacgtacatactatacgaacctacgagaaccacactaccgacgacgacaacgtcgaacctatagtacggtaacgtgacgtaacctagaacgtctacgtacggaaccaccgacggttaccttattaagtttatacggtagacgtaagaccgtaaactaaccttccttacgtaacttaaacgttaccttaacggagtaccggttaggtaacttattcgttttagtttaccg

SEQ ID NO: 290495 - DNA, 652 bp, Homo sapiens
  misc_feature: GYAE6OF01D727A.38.25.C03.1.454.CMB.1.raw
  modified_base (206)..(206): a, c, t, g, unknown or other
  misc_feature (206)..(206): n is a, c, g, or t
  modified_base (449)..(449): a, c, t, g, unknown or other
  misc_feature (449)..(449): n is a, c, g, or t
tcagtcgatcacgtcacgaccggtgctcgatttagtagtgtagatttgggtttggggacccaaaaaaccacacccctccttgggagaatcccctagatcacagctcctcaccatggactggacctggagcatccttttcttggtggcagcagcaacaggtgcccactcccaggttcaattggtgcagtctggagctgcggtgaagnggccgtggggcctcgagtgaacgtctctgcaaggcttcgtggttactacgttttagctagttatggtgtcgagcgtgggtgcgacacggccctggacgaagggcttggaggtggagtggggatgggatcgacggctaacgttaacaagtaggaaaacaacgaaagtatacgaccaagtaattaacgttccgaggacaggtacgtacaagtcatcgaaccgacaagaaccacactccgacgacncaactgaccctagagtacggaactaggaacgtaacgtagaagtacctaggtaccgaaacgaccgtaccggttacctttaatttaacgttacgtttggtacgtacgaaaggtaacctaaacgttaaaccgttcccttaaccgttaactaagtttacgtaaaccggtacgtaacgttagggtaacgtttcgttacgtttttaacg

SEQ ID NO: 290496 - DNA, 761 bp, Homo sapiens
  misc_feature: GYAE6OF01C2GIM.38.25.C03.1.454.CMB.1.raw
  modified_base (747)..(747): a, c, t, g, unknown or other
  misc_feature (747)..(747): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacaggtgcccactcccaggttcaattggtgcagtctggagctggcggtgaagaggccgtggggctctaggtgaacgtctccgtgacaaggtcttccgttggttaactaccgtttttagccgtaggttagttggtgttacgaggtcgtggggtcgacgaccgacggtaccccgtggaacgaagggtcttaggtaggtggtagtagggatgggacttcgaacggtactaacgtttaacaaggtacggaaaacaacgtaaaagtcgtagacctaactaaacgttaacgtttaccggaagggtacaacggtagtaactaacttacgagtacgaaccaacgaagaaccaacgtaacgtacccgaacgaacgtacgaaccgtcgtaacctaacgtacgttaacggaaacgttacggaacgggaaacccgttagacgaacgttccgtaacggtaccggaaaccgtaaccgggttaacctttaagtttaagtttaacgttaggtacgtaggtaacggtaacttaaaacgttaacctttacccgtaacctttaaacgaacgttttaaacgttaccggaacggttaagttaggtaacgggttntacgttttttaacg

SEQ ID NO: 290497 - DNA, 739 bp, Homo sapiens
  misc_feature: GYAE6OF01AOZAN.38.25.C03.1.454.CMB.1.raw
  modified_base (208)..(208): a, c, t, g, unknown or other
  misc_feature (208)..(208): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacaggtcgcccactcccgaggttcaattggtgcagtctggagctgcggtgaagnggccgtgggcctcgagtgaacgtctcctgcaggtcttcgtggttactactttagctagttagtggtgtacgagtcgtgggtcgcgacgacggtccccgtaggacgaacggggtcttaggaggtcgggtaggtaggggtacgtaggtacgtacgacggtacctaaccgttaaacgtaaggtaaccggaaaaaccgtaaagtaaaacgttacgtacgtaccaaacgttaacgttaacgtttacccggaagggtactaaggtaacgtacgtaactactaagtaccgaaccaaccgaacgaaccaactaaccgtacccgaacgaacgtacctaccgtacgtaccctaacgtacgtacggtaacgtacggtaacgtaccgtagtacgtacgtaccgaacggtacgtaccggtacgtacctttagttacgtttagtcggaggtacgaaacggtaacgtaacgttaaccgttacccttaagttacgtaacttaagttaaccggacgttaaggtaacggtacgttagttacgttttacg

SEQ ID NO: 290498 - DNA, 624 bp, Homo sapiens
  misc_feature: GYAE6OF01CSQ0K.38.25.C03.1.454.CMB.1.raw
  modified_base (339)..(339): a, c, t, g, unknown or other
  misc_feature (339)..(339): n is a, c, g, or t
tcagtcgatcacgtcacgaccggtgctcgatttagtagtgtagatttgggtttggggacccaaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagctgggtgcgacacggcccctggacgaagggcttgaggtggagtgggatggatcgagctacttanaataggaaacacaaagtatgacataattaacttcgagggcagagtacatcatacgaccacagacacactaccgacgacgacacgtcgacctacagtacggaactaggaacggaaaccgtggaacgtacgtaccgtaggaacccgtaaccgtaccgggttacctttaagtttaacgtttagttacggtagtaccggtaaagacgtaaacctaaacctttcccgttaacctttaactaacttaacgttaaccgaacgttaagtacgggtaaattgttacttttaacg

SEQ ID NO: 290499 - DNA, 709 bp, Homo sapiens
  misc_feature: GYAE6OF01CP47S.38.25.C03.1.454.CMB.1.raw
tcagtcgatcacgtcacgaccggtgctcgatttagtagtgtagatttgggtttggggacccaaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcgagtgaacgtctcctgcaaggcttcgtggttactacttttagctagttatggtgtcagcgtgggtcgcgacgacggcccgtaggacgaagggtcttggaggtggagtgggagtggatcgagctaacttacgaagtaggaaacaacgaaagtatcgactaactaattaacgtttcgagggtacaggagtcaatacagtacgaccacacgaccaacacgtaccgaacgacgtaccacgtacgaccctaacgaacgtacgggtaaactacgggaacggtaaccgtaggtaacgtacgtaaccgtaacgggaaccgtaaccgtaacccggttaccttttaaagttaacgtttagttacggtacggtaaccggtaacgtaaacggtaaaccgttaaaaccctttccccgttaaaccctttaaacgtaaactttaacggttaaccgggtaacgttaacggttagggttaaacgtttcggtttactttttaaacgg

SEQ ID NO: 290500 - DNA, 567 bp, Homo sapiens
  misc_feature: GYAE6OF01A3HAN.38.25.C03.1.454.CMB.1.raw
  modified_base (354)..(354): a, c, t, g, unknown or other
  misc_feature (354)..(354): n is a, c, g, or t
  modified_base (462)..(462): a, c, t, g, unknown or other
  misc_feature (462)..(462): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagcgtggtgcgacacggcccctggacaaggcttgaggtggagtgggatggatcgagcacttacaataggaaacacgaaagtangacaacgtataacgtttcgagggcagacgtcatcagtacgaccaactacgacaaccatccgacgacgacactcgtaccgtaacagtggtaaccaggacgaactggaanacgtcgtacgacgacgtacggtcctttatattagtcgtgacgagacgaaccgtaacttccttacttacagttacttaacggactagtaggaagttgtcttttacg

SEQ ID NO: 290501 - DNA, 639 bp, Homo sapiens
  misc_feature: GYAE6OF01D9PZM.38.25.C03.1.454.CMB.1.raw
tcagtcgatcacgtcacgaccggtgctcgatttagtagtgtagatttgggtttggggacccaaaaaccacacccctccttgggagaatcccctagatcacagctcctcaccatggactggacctggagcattcctttttcttggtggcagcagcaacaggtgcccactcccaggttcaattggtgcagtctggagctgcggtgaagaggccgtgggcctcgagtgaacgtcctcctgcgaaggtcttcgttggttactacttttagctagttagtggtgtcgagcgttgggtgccgacgacggcccgtaggaacgaagggtcttggagtgggagtggggagtggatcgagctaacttaacaagtaggaaacaacaaagtatagactaactaattaacgttacgagggtacagacgtacatcagtacgaaccacacgaacacactaccgacgacacgacgtacgtacctacacgtacggaacgtacgacgtaacgtagagtactacgtacgaccgacgtacgtacgttacgttattagttagagtttttttttttttttttacgagtaacgtaacgtaaacttaccttaccttaactaacgttaacgtacgtacgtagtaggtaacgttgttcgtttacg

SEQ ID NO: 290502 - DNA, 593 bp, Homo sapiens
  misc_feature: GYAE6OF01BIXBA.38.25.C03.1.454.CMB.1.raw
  modified_base (531)..(531): a, c, t, g, unknown or other
  misc_feature (531)..(531): n is a, c, g, or t
tcagtcgatcacgtcacgaccggtgctcgatttagtagtgtagatttgggtttggggacccaaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcgagtgaacgtctcctgcaaggcttcgtggttactacttttagctagttatggtgtcgagtcgtgggtgcgacacggccctggacagggcttggagtggagtgggatggatcgagctactaacaagtaggaaaacacaaagtatacgacaataattaacttcgagggacaggtacgtacatcgatacgaccacaagaaccacactacccgacgacgctacgtcgacctacgtagtacggtaactagggaaccgtaacgtagacgtacgtacgtacggaaccgaacgtaccggtacttaagttattagttagngacgaggactaacgtaacttcctactactaattatacgtagtagtaggtagtgttctttacg

SEQ ID NO: 290503 - DNA, 617 bp, Homo sapiens
  misc_feature: GYAE6OF01BP03Q.38.25.C03.1.454.CMB.1.raw
  modified_base (361)..(361): a, c, t, g, unknown or other
  misc_feature (361)..(361): n is a, c, g, or t
  modified_base (368)..(368): a, c, t, g, unknown or other
  misc_feature (368)..(368): n is a, c, g, or t
  modified_base (373)..(373): a, c, t, g, unknown or other
  misc_feature (373)..(373): n is a, c, g, or t
tcagtcgatcacgtcacgaccggtgctcgatttagtagtgtagatttgggtttggggacccaaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcgagtgaacgtctcctgcaaggcttctggttactattttagctagttatggtgtcgagtcgtgggtgacgacgacggccccgtaggacgaagggcttaggaggtggagtgggatggatcgagctataacaagtaggaaaacanaaagtangacanaattaacttcgaggacaggatacatacatacgaaccacacgaacacgactaccgaacgacgtacactacgacctacagtacggaacgtaggaacgtaccgtagactagtcgtaacgaacgacgtaaccggtactttaattacgttagtcgtaggaccgtaagaacgtaaacttaaaccttcccttaacttaacaacgttaacgtaacggtaacgtagtaagggtaagttcgttacgttttaacg

SEQ ID NO: 290504 - DNA, 652 bp, Homo sapiens
  misc_feature: GYAE6OF01CNPYC.38.25.C03.1.454.CMB.1.raw
tcagtcgatcacgtcacgaccggtgctcgatttagtagtgtagatttgggtttggggacccaaaaaccacacccctccttgggagaatcccctagatcacagctcctcaccatggactggacctggagcattccttttctggtggcagcagcaacaggtgcccactcccaggttcaagttggtgcagtctggagctgcggtgaagaggcctggggcctcgagtgacgtctcctgctaaggcttcgtggttacctagtttttagactagtttagtggtcgtcgaggtcgtgggtgcgacgacggcccgtaggacgtagggtctggaggtggagtgggatggatcgagctacttacaagtacggaaacaacgtaaagtacacgtacaactaagtaacgtttacggaaggtacaagtacgttacaagttacagtacgaaccgacgaacgaaccacgtacctaccgacgtaacgcctaacgtacgtacctaacgtacgtacggaacgtagaaccggtacgtgaacgactccgtagaccggtaaccacggttacttaattagttagtgtacgaccgtaagtaaccgtaacttaaccgtccttaccttaacgtacgttaacgtaccgtacggtataacgggttatgttacgttttacg

SEQ ID NO: 290505 - DNA, 629 bp, Homo sapiens
  misc_feature: GYAE6OF01D7730.38.25.C03.1.454.CMB.1.raw
  modified_base (281)..(281): a, c, t, g, unknown or other
  misc_feature (281)..(281): n is a, c, g, or t
  modified_base (360)..(360): a, c, t, g, unknown or other
  misc_feature (360)..(360): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagctagttatggtgtcagctgggtncgacaggcccctggacaagggcttgagtggatgggatggatcagcaacttacaaatggaaaacacaaaagtatgacaanaattaaatttccgaagggtacagagtcagtccaatgaaccacaagaacacaatcccaacgagcaactcgaccctaacatcggaaccttggaacggaaaccttggaagtactaccgtaggaaccgaaccgtacgggtccctttaaatactttattaggtacgtacggaagtaacgaacgtaaaaacttttccccttaaccgtttaaaccaaagtttaacttaaaccgtaacggtaagttacgggaaaacggtttgttacttttttaaacg

SEQ ID NO: 290506 - DNA, 612 bp, Homo sapiens
  misc_feature: GYAE6OF01CAK42.38.25.C03.1.454.CMB.1.raw
tcagtcgatcacgtcacgaccggtgctcgatttagtagtgtagatttgggtttgggggacccaaaaaaccacacccctccttgggagaatcccctagatcacagctcctcaccatggactggacctggagcatccttttcttggtggcagcagcaacaggtgcccactcccaggttcaattggtgcagtctggagctggcggtgaagaggcctggggcctcgagtgaacgtctcctgcaaggcttctggttactacttttagcagttatggtgtcagcgtgggtgcgacacggccctggacaagggctggaggtggagtgggagtggatcgagctacgttaacaagtacggaaacaacaaagtagtagacactaataacgtttccgagggacagagtacacttagatacgaaccaacacgaccaacacgtaccacgacacacctcgaccctatacgtacggaacgtacggaacggtaaccgtagaacgtacttacgtaggacccgtacgtaccgtacctttaattacgttatcgttgacgagaagtaccgtaaacttactaccttaacgtacttaagttaccgagtagtaagtacgttgttaacttttaccg

SEQ ID NO: 290507 - DNA, 676 bp, Homo sapiens
  misc_feature: GYAE6OF01BMMXP.38.25.C03.1.454.CMB.1.raw
  modified_base (360)..(360): a, c, t, g, unknown or other
  misc_feature (360)..(360): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagcgtgggtgcgacacggcccctggacgagggtcttggagtggagtggggatgggatcagccaacttacaagtaggaaacactaaagtntagacaactaatacttaccgagggacagagtcatcacgtacgaccaacgacgacaaccactaccgaacgagactaaccgtacgtaccctacgtaagtacggaaacgttacggaacggtacccgtagaacggtacttacgtacgggaaccgtaccgtaaccggttacctttaattaacgttttagttacgggtacgacggaaacggtaaccttaaacgtaaaccgttttaccccttaaccgtttaaactaacgtttaaacggtaacccgtaaggtaacggttaaggggtaaacgtttcggttacttttttaaaccgg

SEQ ID NO: 290508 - DNA, 710 bp, Homo sapiens
  misc_feature: GYAE6OF01CI59T.38.25.C03.1.454.CMB.1.raw
  modified_base (290)..(290): a, c, t, g, unknown or other
  misc_feature (290)..(290): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtcgcccactcccaggttcaattggtgcagtctggagctgcggtgaaggaggccgtggggcctcgagtgaacgtctccgtgcgaaggtcttcgtggttactacttttagctagttagtggtgtcagcgtggtncgacgcgcccgtggacgaggtcgtgaggtggagtgggagtggactcgacgctaacttaacgaagtacggtaaaaccaacgtaaaagtactacgaactaactaagttaacgtttacccggaaggtaacgtaacgtaacggtactaacgtacctaaaggttaccgaacccgtaaacgaaccgaactaaccgtaaccgtaaccccgaacggaacgaccctaccgtacgtacccgtagtaacgtacgggtaacgacggtaacgtaaccgtaggtaatacgtaccgtaacggaaccgtaaccgtaccggttaacttaacgttagtttagtcgtaggtacgtaacgacgttaaaccgttacgtttaccctacttacgtaaacgttacttaacggtagacggttagtacgttacgtttagtttaccg

SEQ ID NO: 290509 - DNA, 707 bp, Homo sapiens
  misc_feature: GYAE6OF01AI0UF.38.25.C03.1.454.CMB.1.raw
  modified_base (492)..(492): a, c, t, g, unknown or other
  misc_feature (492)..(492): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagcggcctggggcctcagtgacgtctctgcaaggtcttctggttactacttttagctagttagtggtgtacagtcgtggtcgacgacacggcccgtaggacgtaacgggtcttggacggttgggtacgtggggtagtggacgtacgtaacgtactaacgttaacgaagtaacggaaactaacgtaaagtacgtacgacctaacgttaattaacgtttaccggaggtacaagtacgtacactacgtaactaccgaacctacgaacgtaaccacgaaccaccgtacgaaccnccgtaccgtctacccgtaacgtacgtacggaaccctagggtaaccgaaccgttagacgttacgtcggtaacgaaccgtaaccgtaaccgttacgtttagtacgtttagtccggtgtaacgtaaacgtacgtaaaccttaccgtttacctaccttaaagaccgtttaacggttaaccgtacgttaagttacggtaacgtttgtttaccgttttacg

SEQ ID NO: 290510 - DNA, 617 bp, Homo sapiens
  misc_feature: GYAE6OF01BIH35.38.25.C03.1.454.CMB.1.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcgagcgtgggtcgcgacgacggtcccgtggacgaagggcttaggaggtggagtgggatggatcagctacttacaagtaggaaacaacaaagtatagcaactataacttacgagggcagagtcatcatcgaccagagacacacgtaccacgtagacctacgtcgacctacgaacgtaggaacgtcggaacgtaacccgtagacgtatccgtaggaacccgtacgtaccggtacctttaattaacgtttacgtaggtacgacggtaagaacggttaacctaactttacccttacgtttaacgacttaacgttaacgtaccgtagttaaggtaacttggttacttttaacg

SEQ ID NO: 290511 - DNA, 928 bp, Homo sapiens
  misc_feature: GYAE6OF01CPSRJ.38.25.C03.1.454.CMB.1.raw
tcagtcgatcacgtcacgaccggtgctcgatttagtagtgtagatttgggtttggggacccaaaaaaccacacccctccttgggagaatcccctagatcacagctcctcaccatggactggacctggagcatccttttctggtggcagcagcaacaggtgcccactcccaggttcaattggtgcagtctggagctgcggtgaagaggcctcggggctcgagtcgaacgtctcctgcgtaaggtccttcgtaggttaccttacgttttacgacgtagtttagtcgggtagtaccgaggtccggttaggggttcggaccggtaccgacggggtacccccgttagggaaccgaagggttccgtttgggaaggtgggtaggtaggggaagttcggggaacttaccgaacggtaccttaaccgttaaacgtaaacgggttaacggaaaaccgtaaaccgtaaaaaggttacgttacggaacctaaaccgtaaacgtttaaaccgtttaccgggaaacggggtaccgtaaagggttaaccgtaccgtaaacgtaccgtaaacgttaccgaacccgtaacgtaacggtaaccctaacgttaaccaacccggaccgtaaacggtacccgtaaccggttaccgaaccccgtttaacggaaacgttttaggggaaaacccgtacggggttaaaccggtaaaccccggtttgggaaaacgtttcccgtaacggtaaaccggtaacccggtaacccggttacccggttaaccgttttaagtttaacgttttacggttacggtacgggttaaacgaacccggggttaaacttaaaacccggttaaacctttccccgttaaaccgtttaccttaaagtttaaacccgttaaaccggaggttaacggttacgggtaaacgtttgtttaaccgtttttaaccgg

SEQ ID NO: 290512 - DNA, 765 bp, Homo sapiens
  misc_feature: GYAE6OF01EBA7S.38.25.C03.1.454.CMB.1.raw
  modified_base (155)..(155): a, c, t, g, unknown or other
  misc_feature (155)..(155): n is a, c, g, or t
  modified_base (182)..(182): a, c, t, g, unknown or other
  misc_feature (182)..(182): n is a, c, g, or t
  modified_base (217)..(217): a, c, t, g, unknown or other
  misc_feature (217)..(217): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatccttttctggtggcagcagcaacnggtgcccactcccaggttcaattggtncagtctggagctgcggtgaagaggcctggggcctnagtgaacgtctcctgcaaggcttacgtcggttacacttttagctagttatggtagtcagtcgtgggtgtccgacaggccccttagggaccaaaggggctttaggacggtaggagttaggggataggtcgtacgtacggactaacgttaaccgtaagtaaaacggtaaaactaaacgtaaagttaacgtacgtaacgtaaactaacgttaacgtttaccggaacgggtaacgtaacgtaacgtacgtaactaacgtaacgtaacgtaaccaacgaacgaaccaacctaaccgtacccgtaacgtaacgtaccgtaccgtacgtaccgtaacgtaacgtaacggtaaccgtaacggtaacggtaaccgtaacgtacgtaacgtaacgtacggtaaccggtaacgtaaccgttaaccgttaacgttaacgttaacgttacgttacggtaaccgtaaacgtaaacgttaaccgttaaaccttaacccgttaccgttaacgttaacgttaacgtaacgttaacgttaacgttacggttaacgttacggttacg

SEQ ID NO: 290513 - DNA, 604 bp, Homo sapiens
  misc_feature: GYAE6OF01APZ2K.38.25.C03.1.454.CMB.1.raw
  modified_base (206)..(206): a, c, t, g, unknown or other
  misc_feature (206)..(206): n is a, c, g, or t
  modified_base (365)..(365): a, c, t, g, unknown or other
  misc_feature (365)..(365): n is a, c, g, or t
  modified_base (402)..(402): a, c, t, g, unknown or other
  misc_feature (402)..(402): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctggcggtgaagnggccgtggggcctgagtgaacgtctcctgcaggcttcgtggttactacttttagctagttatggtgtacagtcgtgggtgcgaccaggtccccaggacagggcttggaggtggagtgggatgggatcgacgctacttagaagtaggaaacacgaaagtntacgacaatacgttaacttacgacgggacagtacgtntacgtacagtacgacacgtaagaccactactaccgacgacgcctacgtacgtacctaccgagtacggaactacggaacgtacgtagaagactacgtaggacgacgtaccggttacttattattagtggtagcgaagtacgtaaccttacgttacctacttagtactaagttacgtacgtagtagtaacgttgtacttttacg

SEQ ID NO: 290514 - DNA, 810 bp, Homo sapiens
  misc_feature: GYAE6OF01DCBFB.38.25.C03.1.454.CMB.1.raw
  modified_base (401)..(401): a, c, t, g, unknown or other
  misc_feature (401)..(401): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcattccttttctgggtggcagcagcaacaggtcgcccactcccgaaggttcaattggtgcagttctggagcgtgcggtagaaggacggccgtggggccttcgaggtagaaccgttctccgtaggacgaaggtcctttacgtggtttaactacgtttttagctagtttagtggtgtcagtcgtgggtgcgacgtacggcccgtaggacgagggtcttggaggtggacgtgggactggatcgaggactactaacaagtaggaaaacacgaaagtntacggaactaacgtaattaacgtttaccgaagggtaccgtaagtaacggtacctaaactacggtacgttaaacggtaaccgaacgtaaccggtaacccaaacggtaacccttaaccccggaaacgggaccgtaaccgtaaccgttaaccggtacccgttaaacgtacgggtttaaccggaaacgttaacggggtaaaccggtaaacccggttagtaaccggaactttacggaacggtaacccggtaaaccgtacggttaacccgtttaagtttaacggttaagttcgggtaaccgagggtaaacgtaaccgtaaacgttaacccgtttaaccgtttaccttaaacgtaaacgtttacttaaaccggtaacggttaacgtaaggttaacgtttagtaccttttttaacgg

SEQ ID NO: 290515 - DNA, 771 bp, Homo sapiens
  misc_feature: GYAE6OF01A5MQI.38.25.C03.1.454.CMB.1.raw
  modified_base (271)..(271): a, c, t, g, unknown or other
  misc_feature (271)..(271): n is a, c, g, or t
tcagtcgatcacgtcacgaccggtgctcgatttagtagtgtagatttgggtttggggtacccgaaaaaccacacccctccttgggagaatccctagatcacagctcctcaccatggactggacctggagcatcctttctggtggcagcagcaacaggtgcccactcccaggttcaattggtgcagtctggagctgcggtgaagaggcctggggcctgagtgaacgtctcctgcaaggtcttctggtactacgttttagctagttagtggtntcgagtcgtgggtcgcgacgcggcccctaggacgtaagggctttggagttggagttgggaatcgggatacgacggactaacgttacaaggttagaaaccagaaaagttcgagtacaacgtaattaaaccgttcgagggtaacagaactacgtacttcgaacgttgaaccgaactaacggacaactactacccgaaacgacggaactaacgttcgacccgtttaaacgacggttaacggtaaaccgttacgggaaacgtacccgtaaggtaaccgtaaacgttccgttaacccggaaacgtaacccgggtaaccgggtttaaaccctttacgttaaacgtttacgttacgggtttaaccgaacgggtaacggttaaaccgtaaaccggtttaaacccttaaccccggttaccctttaaaacttacgggtttaaaaaccttttaccggaaaccggttaaaggttaaggtaaacggtttaccggtaactttttttaaaccggg

SEQ ID NO: 290516 - DNA, 685 bp, Homo sapiens
  misc_feature: GYAE6OF01BMV24.38.25.C03.1.454.CMB.1.raw
tcagtcgatcacgtcacgaccggtgctcgatttagtagtgtagatttgggtttggggacccaaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcgagtgaacgtctcctgcaaggtcttctggttactacttttagctagttatggtgtcagtcgtgggtgcgacgacggccccgtggaacgaagggcttgacggtggagtgggatggatcgagactacgttaacaagtaggaaaacaactaaagtacagaccataagttaacttcggaaggacagtagtacagtcagtacgaccaacgacgtaacaacacgtcccgaacgacacctacgtagaccctaactaagtaccggaacgtacggaaccggtaacctaggaagtaacgttaccgtaaccggtaaccggaaccgtaccgggttaccttttaagttactttacgttaggtacggaccgtaaaggacgttaaaaccgttaacctttaccccttaaccttaacgttaacgttaaacgttaacggtaacgttaaggtaagggttaacgtttcggttaacgtttttaccg

SEQ ID NO: 290517 - DNA, 796 bp, Homo sapiens
  misc_feature: GYAE6OF01AQEM7.38.25.C03.1.454.CMB.1.raw
tcagtcgatcacgtcacgaccggtgctcgatttagtagtgtagatttgggtttggggacccaaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagcgtgggtgcgacacggcccctggacaagggcttggagtggagtgggatggatcgacgactactttaacgaaagtacggaaaaaccaacgtaaaaaggttactacggacctaaacgtaaacgttaaacgttttacccggaaacgggggtcctaaagggtaacggttacctaacgttaccgtaaagttaccggaaacccgtaaccaaacggtaaaccctaaacccgaaccgttaaccccccggaaacggtaaaccggtacccgtaacccgttaaccggtacccccttaaaccgtaaacgtttaccggggaaaacccgtttacggggaaaccgggtaaacccgttagggaacgtaacgttccggtaacggaacccggtaaccgtaaccgggttaccctttaagttaactttacgtttaggtacggtacggaaggtaaacgtaaccgttaaactttacccttaaccttaacgtaacttaacgttaaccggaacgttagttaggtaaacgttgttacgttttaacg

SEQ ID NO: 290518 - DNA, 693 bp, Homo sapiens
  misc_feature: GYAE6OF01EUX2J.38.25.C03.1.454.CMB.1.raw
tcagtcgatcacgtcacgaccggtgctcgatttagtagtgtagatttgggtttggggacccaaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaggcttcgtggttactactttagctagttatggtgtcagtcgtgggtcgcgacgacggccccgtggacgagggtcttggaggtggagtgggatggatcgagactacgttacgaagtaggaaaacaacgaaagtatagacaactaattaacgtttacgagggactaggagtacgatacaagtacgaacctaacgaacgaccaacacgtacccgaaacgacgacctaacgtccgaaccctaacgtacgtaacggaaaccgtacggaaaccgggtaaccgtaggaacgtacgttaccgtaacggaaccggaaccgtaccggttacctttaaagtttacgtttacgtttagtacggacggtaaacgtaacggtaacttaaacccgttacctttaccttaagtaaaccgttacgttaaccgtaacggtagttaaggtaacggtttcgttaacgtttttaacg

SEQ ID NO: 290519 - DNA, 759 bp, Homo sapiens
  misc_feature: GYAE6OF01AN2BC.38.25.C03.1.454.CMB.1.raw
  modified_base (219)..(219): a, c, t, g, unknown or other
  misc_feature (219)..(219): n is a, c, g, or t
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctnagtgaacgtctcctgcaaggcttcgtggttactactttttagctagttatggtgtacagtccgtagggtcgacgacgacggccctggaccaacgggtcttgaggtggagtgggtatggatcgagcctacgttacgaagttaggaaacaacgaaaacgttataggacctaactaacttaaagttttaccggaagggtcctaacggtacgtaccaacgttacctaaggtacgaccgtaaccgaacgaacccacgaaccgtacccgaaccgtacggactaccgttacgacccgttaacgtaacggttacggtaaaccgtaggtaaccgggtaacccctaggaacgttaacggttccgttaacggaacccggtaacggtaacccggtacccgttttaattaacgtttacgttacggtacggtaacggtaaacggtacgtaaaccttaaacccgtttacccgttaacccgttaaaccttaaacgttaccgtttaaccggtaacggttaaggtaacgggtaacgtttcggttaactttttacccgg

SEQ ID NO: 290520 - DNA, 857 bp, Homo sapiens
  misc_feature: GYAE6OF01ET4P5.38.25.C03.1.454.CMB.1.raw
  modified_base (212)..(212): a, c, t, g, unknown or other
  misc_feature (212)..(212): n is a, c, g, or t
  modified_base (279)..(279): a, c, t, g, unknown or other
  misc_feature (279)..(279): n is a, c, g, or t
tcagtcgatcacgtcacgaccggtgctcgatttagtagtgtagatttgggtttggggacccaaaaaaccacacccctccttgggagaatcccctagatcacagctcctcaccatggactggacctggagcattccttttcttggtggcagcagcaacaggtcgcccactcccgaggttcaagttggtgctagtctggagctggcggtgaagnggccgtggggcctcgagtgaacgtctctgcaggtcttcgtggttactactttagctagttagtggtntcgagtcgtgggtgcgacgacggcccgtaggacgaggtcttaggaggtgggtagtggggataggactcgagtactaacgttaacgaagttaacggaaacctaacgtaaagttacgtacgaacctaaacgttaacgttaaaacgtttcccgggaagggtaccgtaaggtaacgtaccgtaggttactaacgtaaccgtaaccctaacgaaccgtaacccgtaacccgtaaccgttaaccccggaaacgggtaacgtaccgtaaccgtaccgggtaaccccttaaacggtaacgggttaaacgtaaccgggttaacgggtaaacccggtaacccgtacgggtaaccgttacggttaacccggtaaacggaacccggtaaccggtacccgtttaaccgtttaagttagtttaacggttggtaaccggtacggtaaaggtaaaccgtttaaacccgttaaaccgttttcccgttaaaccgtttaaaccttaacgggtttaaacggttaacccgggtaaacggtttaaaccgggttaacgggtttaaacgggttttaacctttaacggtttttttaaacccgg

SEQ ID NO: 290521 - DNA, 678 bp, Homo sapiens
  misc_feature: GYAE6OF01BTJSK.38.25.C03.1.454.CMB.1.raw
  modified_base (208)..(208): a, c, t, g, unknown or other
  misc_feature (208)..(208): n is a, c, g, or t
  modified_base (372)..(372): a, c, t, g, unknown or other
  misc_feature (372)..(372): n is a, c, g, or t
tcagtcgatcacgtcacgaccggtgctcgatttagtagtgtagatttggggtttggggacccaaaaaaccacacccctccttgggagaatcccctagatcacagctcctcaccatggactggacctggagcattccttttcttggtggcagcagcaacaggtgcccactcccaggttcaattggtgcagtctggagctgcggtgaagnggccgtgggcctcgagtgacgtctcctgcaaggtcttcgtggttactacttttagctagttatggtgtcagtcgtggtgcgacgacggcccgtaggacgaagggtcttaggagtggagtgggatggatcagcacttaagaagtaggaaaacaacgaaagttagngaactaacgtaattaaacgttccggagggactaacggagtcgaatcgtaagtaccgaacctaacaacgaaccaacctaactacccgaacgaacctcgtactacgacctaacgagtaacggaactacggaacgtaacgtagactagtcgtaacgaaccgacgttaacccgttaactttattaagtttacgttaggtacgtaacggtacgaaaggtaaacccttaacctttacccgttaacttaacgttaacgttaaagttacccgtaaaggtacgtttaagggaacgtttcgttactttttaaccgg

SEQ ID NO: 290522 - DNA, 892 bp, Homo sapiens
  misc_feature: GYAE6OF01AXV2Y.38.25.C03.1.454.CMB.1.raw
tcagtcgatcacgtcacgaccggtgctcgatttagtagtgtagatttgggtttgggggacccgaaaaaccacacccctccttgggagaagtcccctagatcacagctcctcaccactggactggacctggagcatcctttctggtgcagcagcaacaggtgcccactcccaggttcaattggtgccagtctggagctggcggtgaacgacggcctggggcctcgaggtcgaaccgtctcctgcaaggcttcgtggttacctacgttttagctagttagtggtgtcagtcgtgggtgcgacacggccctaggacgacggtctgagtcggagtgggatgggtactcgacgtacctaacgtttaaccgaagttacgggaaaacctaacggtaaaacggttaggtaccgaacgtaaccgtaaacgtttaacgtttacccggaacggggtacgtaacggtaacgttaccgtaacgttaccgtaacgttacgggaaacccctaacgtaaccggtaacccctaaccgtaacccggttaaccccgtaaccgggtaaccggtaacccgttaacccgtttaccggtaaacccgtttaaccgttaaacggttaaccgggtaaaacccgtttacgggtaaacccgggtaaccgttaacggtaacggttaacgttaccggtaacccgggttaaacccggtaaccccgtaacccggggtttaacccgttttaaacggtttaaccggtttaagggttaccgggttaacggtaaccgggttaaacgggtaaacccgttaaacccgtttaaaacccggttttccccttaaaccgtttaacgtaacttaacggttaacccggtaacggttaagttaaccgggtacgtttccggttttactttttaaccgg

SEQ ID NO: 290523 - DNA, 668 bp, Homo sapiens
  misc_feature: GYAE6OF01A7910.38.25.C03.1.454.CMB.1.raw
  modified_base (206)..(206): a, c, t, g, unknown or other
  misc_feature (206)..(206): n is a, c, g, or t
  modified_base (654)..(654): a, c, t, g, unknown or other
  misc_feature (654)..(654): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgacagtctggagctgcggtgaagnggccgtggggcctcgagtgaacgtctccgtgacaaggtcttctggttactacttttagctagttagtggtagtcaggcgtgggtcgcgaacgacggccccgtaggaacgaggggtcttggaggttcgggagtggggacgtggtaactcaggtcctaacgtttaacaagttaacggaaacctaagaaaagttctaggactaaacgtaattaaacgttcgaagggactaaggacgttacagtcgaagtcgaaaccgacaacgacaacctaacgtacccaacggacaccgaacgttcgacccttagaacgtacgaacgtcggaaccgtactaggacgtacgtacaaggaccgacgtacggttactttaagtacttagttcggagtaagacgaataacctaacgtttaccacgttaatacgttaacgtaacgtataacggtagtaccggttnttacgtttttaacg

SEQ ID NO: 290524 - DNA, 616 bp, Homo sapiens
  misc_feature: GYAE6OF01A26ZJ.38.25.C03.1.454.CMB.1.raw
  modified_base (285)..(285): a, c, t, g, unknown or other
  misc_feature (285)..(285): n is a, c, g, or t
  modified_base (356)..(356): a, c, t, g, unknown or other
  misc_feature (356)..(356): n is a, c, g, or t
  modified_base (566)..(566): a, c, t, g, unknown or other
  misc_feature (566)..(566): n is a, c, g, or t
tcagtcgatcacgtcacgaccggtgctcgatttagtagtgtagatttgggtttggggacccaaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttcgtggttacacttttagctagttatggtgtcagcgtgggtncgacacggcccctggacaagggcttgagtggatgggatggatcagcactacaagtaggaaacacaaagtanagacaatataacttcgaagggcaagtagtacatacagtcgaaccagacgacacactaccgacgacacctactagaccctaacgaagtacggaaaccgtaggaacgtaaaccgtgaaacgtactaccgtacggtaaccgaacgtaccggtactttaatacgtttagtcggtacggaacgagtaacgtaacctaactttccctaaccttaanaacgttacgttaaccgtaacgtagtaggtaaacgttgttacgttttaacg

SEQ ID NO: 290525 - DNA, 838 bp, Homo sapiens
  misc_feature: GYAE6OF01D608Z.38.25.C03.1.454.CMB.1.raw
  modified_base (159)..(159): a, c, t, g, unknown or other
  misc_feature (159)..(159): n is a, c, g, or t
  modified_base (190)..(190): a, c, t, g, unknown or other
  misc_feature (190)..(190): n is a, c, g, or t
tcagtcgatcacgtcacgaccggtgctcgatttagtagtgtagatttgggtttggggacccaaaaaccacacccctccttgggagaactcccctagatcacagctcctcaccatggactggaccgtggagcattccttttcttggtgcagcagcaacgnggtcgcccacctccgtaggttcaagttggtnctagtcgtggagctggcggtagaaggcggccggtcggggccctagtaggtacgaacgttcctccgtggaaccgtacggtcctttcggtacggtttaaccttacgtttttacggacttaaggtttacgtgggttacgtcggaggtcggttagggcctaccggaacgtaccggtcccggtaggaacggtacggttcgttagggtacggggttggtagggtacgggtagtaggtacgtaccggtaacgtaccttaaacgttagaacggtaaacgtaaaacgtaacgtaacgtagtacgtaactaaacgttacgttaaaccgttccggggaagtaccggtaaggtactaccgtaacgcgtaacgtacccgaaccgtaacaacggtaaccctaccggtaaccctcccgtaaacggtcccgtaacccgtaccgtaaccgtacccgtaacggtaacgtaacggtaaccgtacggttaaccgtcgtaaggaaccgttacgacggttaaccgaccgtaccgttaacgtttactttaacgttaacggtcggttaacgacggtaactaaaccgggtaccttaaaccggttaccttaacccgtatttaactaacgttagtaacccgtaggtaaccgttagttaccttgttactttacggg

SEQ ID NO: 290526 - DNA, 847 bp, Homo sapiens
  misc_feature: GYAE6OF01AZPN3.38.25.C03.1.454.CMB.1.raw
  modified_base (205)..(205): a, c, t, g, unknown or other
  misc_feature (205)..(205): n is a, c, g, or t
  modified_base (270)..(270): a, c, t, g, unknown or other
  misc_feature (270)..(270): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagnggcctgggcctcagtgaacgtctctgcaaggcttcgtggttactacgttttagctagttatggtntcgagcgtgggtgcgacgacggtccccgtaggacgtaagggtccttggacggtgggagtggggatgggatcgaagtcctaactttacgaaagtacggaaaactaacgtaaagtacgtagacctaacgtaacgttaaacgtttaccggaacggggtacctaaggtaacgttaccaacttaccgaaacgttacccggaaacccgaaccgtaaccggaacctaaaccgtaacgttaacccccggaaacggtaaccgtacccgtaaccgtaccggtaacccctaaacgtaacggttaaccgggtaaaccgttaacgggtaaccgggtaaaccccgttagggtaaacgtaccgtttaccgtaaccggtaaaccccgggtaaacccgtaaccgggtttaaacccttttaaggtttaacgtttaacgtttacggggtacccggtaacgtaaagggtaaacccgttaaaccgttaaaacccgttttacccccttaacccggtttaaacttaaaccgttaacggtttaaacccggtaacgttaacggttaagggttaaacggtttcgtttaaccgtttttaaaccg

SEQ ID NO: 290527 - DNA, 842 bp, Homo sapiens
  misc_feature: GYAE6OF01E3SWZ.38.25.C03.1.454.CMB.1.raw
tcagtcgatcacgtcacgaccggtgctcgatttagtagtgtagatttgggtttggggacccaaaaaaccacacccctccttgggagaatcccctagatcacagctcctcaccatggactggacctggagcattccttttcttggtggcagcagcaacaggtgcccactcccaggtcaattggtgcagtctggagctggcggtgaaggaggccgtggggcctcgagtgaaccgtctcctgcgaaggtcttcgtcggttactacgttttagctagttagtggtcgtcaggtcgttgggtcgaccgtacgacggtccccgtaggaacgaagggtcttaggaggtgggagttggggagtcggatcgagtactaaccgttaagaagttaacggaaaacctaacgtaaaaggttacgacgactaacgtaacgtttaacgttcccggaaggtacgaacggttaacgtaccgtaagtaaccgtacgtaaaccgaccccgtaaacgaaccgtaaccctaaccgtaaccgtaccccgaacggtaacgaccctaaaccgttccgtaaccccgttaaacgtaccggttaaacgggaaaccgttaacggggtaaaccgggtaaccccgttaagggaaccgtacgttaccgggtaaacgggaccccgttaaaccgggtacccggtttactttaacgttttaacggtttacggtttacgggaggttaacccgggtaaaggtaaccgtaaaaccccgttttaccgtttaccccgttaaacttaaacgtttaaacggttaaacgttaacgggaaaccgttaggttaagggtaacgttttccgtttacgttttttaaccg

SEQ ID NO: 290528 - DNA, 735 bp, Homo sapiens
  misc_feature: GYAE6OF01CT6FI.38.25.C03.1.454.CMB.1.raw
  modified_base (329)..(329): a, c, t, g, unknown or other
  misc_feature (329)..(329): n is a, c, g, or t
  modified_base (407)..(407): a, c, t, g, unknown or other
  misc_feature (407)..(407): n is a, c, g, or t
  modified_base (679)..(679): a, c, t, g, unknown or other
  misc_feature (679)..(679): n is a, c, g, or t
  modified_base (724)..(724): a, c, t, g, unknown or other
  misc_feature (724)..(724): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtcgcccactcccaggttcaattggtgcagtctggagcgtgcggtgaagaggccgtgggcctcgagtgaacgtctcctgcgaggtcttcgtggttactacgttttagctgttagtggtgtcaggtccgtggggtcgccgtacgcggccccgtggacgtaagggtctggaggnggtacgttgggagttggactcgaacggtcctaaacgttaacggaaacgtaacggaaaacctaacgtaaaaacggttanaccgaccgtaaacttaaacgttaaccgtttaccggaagggtaccgaaggttacgactaacgtactagtaccgtaaccacgaacgtacaacctacgtaccgaacggacaccgtaaccgtccacctacgtacggtaacggaacgtacgggaaccgtaaccggtgaaccggttcgtaaccgaggtaacccgtacggttacccgttaacgtttaattaagttcggtaacgtgaacgaacgtaacgttaaacccgttactttaccctaacgtttaanacgttaaagttaccggtaacgttaggttacggtaactttcggttntttttaaccgg

SEQ ID NO: 290529 - DNA, 719 bp, Homo sapiens
  misc_feature: GYAE6OF01CUACY.38.25.C03.1.454.CMB.1.raw
tcagtcgatcacgtcacgaccggtgctcgatttagtagtgtagatttgggtttggggacccaaaaaaccacacccctccttgggagaatcccctagatcacagctcctcaccatggactggacctggagcattccttttcttggtggcagcagcaacaggtgcccactcccaggttcaattggtgcagtctggagctgcggtgaagaggcctggggcctcgagtgaacgtctcctgcaaggcttcgtggttactacttttagctagttatggtgtcagtcgtgggtgcgtacacggcccctggacgaagggcttggagtggagtgggatggatcgagcaacttaacgaagtagaaaacaacgaaagtactagactaactaataacgtttccgaagggccaagtacgtactaactcgtaagtacgaaccctacgaacggaacctaaccgaaccttaccgaacggaccgacctaaccgtacgaccccttaacgaacgtacggtaaaccgtacgggtaaaccggtaacccgtaggaacgtaacgtcgtaacggaaccggtaaccgtaacggttacctttaagttacgtttacgttacgtggaccgtaaagtaaacgttaacgttaaacccgtttacccgttaaccctttaactaaaccgtttaaacgttaccggtaaacggttaacgttagggttaaacgttcgtttacgttttttaacccg

SEQ ID NO: 290530 - DNA, 765 bp, Homo sapiens
  misc_feature: GYAE6OF01D4L0U.38.25.C03.1.454.CMB.1.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagctgggtgcgacacggccctggacaagggcttggagtggagtgggatggatcgagcacttaacaagtaggaaaacactaaaagtatagacaactaattaacgtttaccgaagggaccaaggtaacgttacaattccaattacggaaaccccaacgaaggaacccaaccgtaaccgttaccccgaaacggaaacgacccgtaacccgttacgggtacccccttaaacgtaacggttaccggggtaaaacccgttacgggaaacgggtaaaccccgttagggaaacgtaacttaccggtacggaaacccggtaaccggtaacccgggtttacccttttaaagtttaacgtttacgtttacggtacggtacggaaacgtaacggtaaacccttaaaaccgttttccccttaacccttttaaacgtaacgtttaacgttaaacccggtaacgttaacggttaagggttaaacggtttcggttaaccgtttttaacg

SEQ ID NO: 290531 - DNA, 683 bp, Homo sapiens
  misc_feature: GYAE6OF01BAFDC.38.25.C03.1.454.CMB.1.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcgagtagaacgtctcgtgacgaggcttcgtaggttactacgttttagctagttagtggtcgtcaggtcgtgggtcgacggacgacggccccgtggacgaagggtcttggaggtggagtgggagtaggatcgacgactagttaacgaagtagaaaactaactaagtatagacgtaataacttaacgttccgaggtactagtatacagtactagtacgaacctaacacgaacctaacgtaaccgtaccgaacgaacctaccgaaccgtacacccctaagaacggtacggtaacgtacggaacgtacctagtaacgtactacggaacgaccggtaaccgtacggtttaacttagttagttacgtgtacggacgtacgtaacgttaaccgttaacttaccccttaagttaccttaaagttacgttaaaccgagttaaggtaaggttaacgtttgtttaccgttttaacg

SEQ ID NO: 290532 - DNA, 677 bp, Homo sapiens
  misc_feature: GYAE6OF01CSFGO.38.25.C03.1.454.CMB.1.raw
tcagtcgatcacgtcacgaccggtgctcgatttagtagtgtagatttgggtttggggacccaaaaaaccacacccctccttgggagaatcccctagatcacagctcctcaccatggactggacctggagcatccttttcttggtggcagcagcaacaggtcgcccactcccaggttcaattggtgcagtctggagctgcggtgaagaggccgtggggcctcgagtgaacgtctcctgcaaggtcttctggttactacttttagctagttatggtgtcagcgtgggtgcgacgacggccccgtaggacgagggtcttaggaggtggagtgggagtaggatcgagctaacgttaacgaagtaaggaaaacaacgtaaaagtatacgactaactaagttaacttccggaggtacaaggtagtacaagtacagtacgaaccacaacgaacaacactaccgaacgacgtaccacgtaccgacctaacgagtacgggtaactacggaacgtaaccaggtaatacgtacgtacggaaccaccggtaccgttacctttaattagtttacgttaggtacgaacggtagtaacgtaaaccgttaaccgtttccccttaacgtttaaaccagtttaaacggttacccgtaaacggtagttagggtaaagtttgttaaacgtttttacg

SEQ ID NO: 290533 - DNA, 753 bp, Homo sapiens
  misc_feature: GYAE6OF01DRI7Q.38.25.C03.1.454.CMB.1.raw
  modified_base (194)..(194): a, c, t, g, unknown or other
  misc_feature (194)..(194): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacaggtgcccactcccaggttcaattggtgcagtctgganctggcggtgaagcggccgtggggcctgaggtcgaacgtcctcctgcgtaaggtccttgtaggttacctacttttagctagttatggtgtacgagtcgtgggtacgcgaccgtacggcccgtacggacgaaggtcgtaggaggtaggtaggtgggagtaggatacgacgtactaacgttaacgaacgtacggaaaaacacgtaaaaggtagtgaacctaagtaactttaacgttacggaaggacgaaggtaacgtacctactacgactaaccgaacctaacgaacggtacctactaacctaccgaaacgactacgtaacgtaccctaactaacgtacgtaagggtaaccgaagggtaaccgtacggtaacggtagtaacgtaacgtacggtaacccggaacgtaccggttaacctttaattaacgtttacgttagtaccggtacggtaaacgtaacttaaaccgttaaccgtttaacccctttacttaaacccgttaaattaaccggttaacgtaaggttaaacggtaggttaaacgttcgtttaaaccgtttttaaccg

SEQ ID NO: 290534 - DNA, 806 bp, Homo sapiens
  misc_feature: GYAE6OF01AY61M.38.25.C03.1.454.CMB.1.raw
tcagtcgatcacgtcacgaccggtgctcgatttagtagtgtagatttgggtttggggacccaaaaaaccacacccctccttgggagaatcccctagatcacagctcctcaccatggactggacctggagcatccttttcttggtggcagcagcaacaggtgccccactcccaggttcaattggtgcagtctggagctggcggtgaagaggccgtggggcctcgagtgaacgtctcctgcaggtcttcgtggttactacttttagctagttagtggtgtcgaggtcgtggggtgccggaccgacgggtcccccgtagggaaccgtaagggggtcctttagggacgggttagggtacggttgggggtaacgttcggggtaagttaccggaacggtaccgttaaccgtttaaacgaaagttaacgggaaaaaccaaacggtaaaagtagtacggacctaaacgtaattaacgtttacccggaagggtacaaggtaacgtaccaacttacgaactacggaaccctaacgaacgaacctaacctacgtacccgaacggactacccacgtacgtaccctaacgtaacgtacggtaactaacgggtaaccgaaccgtaggaacgtagttaccgtacgaaccggaaccgttaccggttacctttaagttaacgttagttacggtacggaacggtaagtaaaccgtaaaccgttaaccgtttaccccgtttaaccgttaaccttaaacgttaaaccgtttaacgggaaaccgttaagggtaaagggttaacctttaggtttaccgtttttaaacg

SEQ ID NO: 290535 - DNA, 740 bp, Homo sapiens
  misc_feature: GYAE6OF01B53Y7.38.25.C03.1.454.CMB.1.raw
  modified_base (194)..(194): a, c, t, g, unknown or other
  misc_feature (194)..(194): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacaggtgcccactcccaggttcaattggtgcagtctgganctgcggtagaagaggccgtggggcctcagtgaacgtctcctgcaaggtcttcgtggttactactttttagctagttagtggtgtcgagtcgtgggtgcgacgacggtccccgtaggacgacgggtctggtacgtggtagtgggagtggactgacgtactaacgttacgaagtaacggaaacaacgtaaagttatacgaacctaaacttaacgttaaacgttttacggaacgggacgtaaacggtaacgtactaaacgtttaccaacgtcggtaacccaaccgaagtaccaaaccgtacctaccccggaacgtacgacctaaccgtccgtacctaaccgtacgttaacggaaacttacggaaccggttaaccgaggtaaccgaacgtccgtaacggaaccgtaccgtaacggtaccttaagtttaccgttagttcggtagaaccggtagtaaaacgtactttaaaccgtttacccaaccgttttaacaaagtttaaccgtaaccggtaagttacgttaagggtactttacggttactttttaaccgg

SEQ ID NO: 290536 - DNA, 743 bp, Homo sapiens
  misc_feature: GYAE6OF01CX51O.38.25.C03.1.454.CMB.1.raw
tcagtcgatcacgtcacgaccggtgctcgatttagtagtgtagatttgggtttgggacccaaaaaccacacccctccttgggagaatcccctagatcacagctcctcaccatggactggacctggagcattccttttcttggtggcagcagcaacgaggtcgcccactccctaggttcaattggtgcagtctggagtctggcggtagaaggacggtccgtggggcctcgagttacggaacgtcctcgtgacaggtccttacgtgttaactacgtttagctagttcgtaggttgtcagcgttggtgcgacgcgacccgtggacgaggtcttagaggtggacttggatggacgacgagacttactaagaacgtaacgaaacgtaacgaaagtacgagtaacctataaacgtacgttccgaacggaacgtagtacgtacgaagtccgtaaagtacgaacccaacgaacgtaaccaacgtaacctaccggtaaccgtacgtaccgtaacccgtactaaccgttaaccggaacgttaccggtaaacgtaacggtaacggtaacccgtaggtaaccgtaacgttaaccgaaccggtaacccgtaacggtaaccgtttaccgtaatttaacgttagtaccgtacggagttaacgtaaacgttaacccgtaacctttaacccgtactttaagtaaaccgttaactaacgtacccgtaaggaaccgtttgttacgtttaccggtttttaacg

SEQ ID NO: 290537 - DNA, 768 bp, Homo sapiens
  misc_feature: GYAE6OF01B9H85.38.25.C03.1.454.CMB.1.raw
  modified_base (381)..(381): a, c, t, g, unknown or other
  misc_feature (381)..(381): n is a, c, g, or t
  modified_base (689)..(689): a, c, t, g, unknown or other
  misc_feature (689)..(689): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacaggtcgcccactcccaggttcaagttggtgctaggtctgggagctggcgggtagaaggcgggccgtggggcctcgagtagtaaccgtcctccgtgacgtaacggtctttccgtggtttacctaacttttagacgttaggtttacgtgggttcgtacgacggttccggttgggggtcgaccggaacggtccggggtccccgtaggaaccggaaggggtcgttaggnggtggtaagggtgggtagtagggacgtccaaggtactaacttaaacgaaggtaacggaaactaaaccgaaagtacgtacggaacctaaacggttaacttaaacggtttccggaaagggtaccgtaaggtaacttaccgtaacttaaccgaacgttaaccgaaacccaccgtaacgaacccaaactacctaacccgacggtacaaccgtaaccgtccgtactaacgtacgtaagtaccgtacgaaccggtaacgagacgtactcgtaagccgttaccgtacgttaccgtttataacgtttgtacggtanaacggtagacctaacgttaacctccgttactaacgttagtacctaaagtcggtaataggttacggttcttaacgtttcg

SEQ ID NO: 290538 - DNA, 890 bp, Homo sapiens
  misc_feature: GYAE6OF01CE8XK.38.25.C03.1.454.CMB.1.raw
  modified_base (131)..(131): a, c, t, g, unknown or other
  misc_feature (131)..(131): n is a, c, g, or t
tcagtcgatcacgtcacgaccggtgctcgatttagtagtgtagatttgggtttggggacccgggaaaaaccacacccctccttgggagaatcccctagatcacagctcctcaccatggactggacctggancatccttttcttggtggcagcagcaacaggtgcccactcccaggttcaattggtgcagtctggagctgcggtgaagaggcctggggcctcagtgaacgtctaccgtgcaaggtctttccgtggttaacctacgtttttaggcctagtttaagtcggttgtaccgtagtccgtgggtagccgtacgacggccccgtaggacgaagggtcttggaacggtggtacgtgggagttaggactacgacgtacgtaaacgtttaaacgaagttaacggaaaaccgaaaccgtaaaaagtacgtacggaacctaaacgtaaacgttaaacgttttacccggaaaggtaccgaagtaagttaaccgtaacttacgtaaagtaccgtaacccgaacgaacgaaccaaccgtaacctaccgaaaccggacgtaccgtaacgtaccgtaccgttaacgtaaacggttacgggtaaacgtaacgggtaacggtaaacccgtaggtaaacgtaccgtacgtaacggtaaccgtaaccggtaacccggttaactttaaacgtttaacgttacggttttaacggtcggtttaaacgggtaaagtaaaaccggttaaaacccgttttaaacccgttttaacccccggttttaaacccgttttaaaccgttaaaaccgtttaaacggttttaaaaccccgggtaaacggggtttaaacgtttaaccggggtaaaacggttttaacccggttttaacccggtttttttaaaacccgg

SEQ ID NO: 290539 - DNA, 860 bp, Homo sapiens
  misc_feature: GYAE6OF01EMX9V.38.25.C03.1.454.CMB.1.raw
tcagtcgatcacgtcacgaccggtgctcgatttagtagtgtagatttgggtttggggacccaaaaaaccacacccctccttgggagaatcccctagatcacagctcctcaccatggactggacctggagcatccttttcttggtggcagcagcaacaggtgcccactcccaggttcaattggtgcagtctggagctggcggtgaagaggccgtggggcctcgagtcgaacgtctcctgcaaggtcttcgtaggttactacttttacgctagttagtggtctcgacgtcgttgggtcgaccgacgccggtccccgtagggaaccgtaacgggtctttacgggaggttagggacggttggggaattgggtaactccgacgtacctaacgttaacgtaagtaacggaaaaaccaacgtaaaagttacgtacggaacctaacgttaaacgttaaccgtttaccggaaacggggtacctaagggtaacgttaccgaaacgttaccgtaagtaaccggaaacccaaccgtaacggaaaccctaacccgtaacctaacccgtaaccggtaaccgacccgtaaccgttaccggaaccccttaacgacggttaacggtaaaccgtacggaaccgggtaacccgtaggaacgtacgttaacccggttaaccggaaacccgtaccgggttaaaccggtttacctttaaacgtttaacgttttaacggttacgtacgggaaaccggttaaacggtaaaccgttaaaccgtttaaccctttaccccgttaaccgtttaaccttaaacggttaacgttaacccggtaaaggtcggttaaagggtttacgtttacgttttaacgtttttaaccgg

SEQ ID NO: 290540 - DNA, 751 bp, Homo sapiens
  misc_feature: GYAE6OF01BO27B.38.25.C03.1.454.CMB.1.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaaggaggccgtggggcctcgagtggaacgtctcctgcaaggtcttcgtggttactacttttagctagttatggtgtcagtcgtgggtgcgacaggccccgtaggacgaaggggtcttaggaggtaggagtgggagtggatcgagactacttaacaagtaggaaaacaacgaaagtagtagaccaactaagttaaactttccgaaggggtacctaaggtaacgtactaagttaccgaacttacggaacccaacaacggaacctaaccaccgtaacccgtaacggacgaaccctaacttaccggaccctttaacaacggttacgggtaaactacgggaacgtaaaccgtaggaacgtacgtactacggaacccgtacgtaacccgggttacctttaaagttacgttttaagtttcggacggtaacggtaaaggtaacggtaaaaccctttaacttaacccccgttttaccgttaaacccttaagttaaaaccgtttaacccggtaaacgtaaggttaaccgggttaaaggttccgttaaacttttttaacgg

SEQ ID NO: 290541 - DNA, 729 bp, Homo sapiens
  misc_feature: GYAE6OF01BE0ST.38.25.C03.1.454.CMB.1.raw
  modified_base (277)..(277): a, c, t, g, unknown or other
  misc_feature (277)..(277): n is a, c, g, or t
  modified_base (294)..(294): a, c, t, g, unknown or other
  misc_feature (294)..(294): n is a, c, g, or t
  modified_base (393)..(393): a, c, t, g, unknown or other
  misc_feature (393)..(393): n is a, c, g, or t
tcagtcgatcacgtcacgaccggtgctcgatttagtagtgtagatttgggtttggggacccaaaaaccacacccctccttgggagaatccctagatcacagctcctcaccatggactggacctggagcatccttttctggtggcagcagcaacaggtgcccactcccaggttcaagttggtgctagtctggagtctgcggtgaagcggcgtgggcctcgagtgacgtctcgtgcgaggtcttcgtaggttactacgttttagacgtagttagtggtntacgagtcggtgggtanacgacgtcggcccgtaggacgtacgggtcttaggaggtggtagtgggatggatcgaaggtacctaacgttaagaagttacggaaaacgtagaaacggtntacgacgtaacctaataacggttcggacggtactacggtagtactaagtacgtaagtcgaaaccgacgtaacgtaccaacgtacgtaccgaacgggtacctaacgtaccgtcgaaccttacgacggtaacgttaacccgagggtaaaccgtaacgttaggacttaaacggtgtaaaccgggtaccgaaaccgttaccgggttaaactttaagggttaaccgtttaacggcggtaaacggacgttaaacgtacggtaaaccgttacctttacccgattaaacgtacgttaacgtaacgtaggaacgttaaggtagttttaacccgtgtttttaaccg

SEQ ID NO: 290542 - DNA, 655 bp, Homo sapiens
  misc_feature: GYAE6OF01A378O.38.25.C03.1.454.CMB.1.raw
  modified_base (181)..(181): a, c, t, g, unknown or other
  misc_feature (181)..(181): n is a, c, g, or t
  modified_base (203)..(203): a, c, t, g, unknown or other
  misc_feature (203)..(203): n is a, c, g, or t
  modified_base (629)..(629): a, c, t, g, unknown or other
  misc_feature (629)..(629): n is a, c, g, or t
tcagtcgatcacgtcacgaccggtgctcgatttagtagtgtagatttgggtttggggacccgaaaaccaacacccctccttgggagaatcccctagatcacagctcctcaccatggactggacctggagcatctttctggtgcagcagcaacaggtgcccactcccaggttcaacttggtncagtctggagctgcggtgaagnggctggggcctgagtgacgtctctgcaaggtcttcgtaggttactacttttagcgtaagttagtggtgtacgagtcgtggtacgtcgacgtacggtccccgtaggtaccggtaagggtcttaggaggtacgggtagtagggtactagggtacgtcgtacggacttaagtaacctaggtaacgaaactacgtaaacgtagtacggtactaaccgtattaaacgttccggaaggacctagtaacggtcacgtacacgtacgaacctacgaacgtacacgacgtaccagggtaccagtacaccgatacgatacggaactagcgtacaggtcaagcgtaacacgtcgtgtacctatagttacgtacacgttcggaatacgaaacggttaccctacgggtacttaacggtactaacttacgaaccggtttntaaacgggcttaagtcggtttaaacg

SEQ ID NO: 290543 - DNA, 887 bp, Homo sapiens
  misc_feature: GYAE6OF01BQPO5.38.25.C03.1.454.CMB.1.raw
  modified_base (214)..(214): a, c, t, g, unknown or other
  misc_feature (214)..(214): n is a, c, g, or t
  modified_base (486)..(486): a, c, t, g, unknown or other
  misc_feature (486)..(486): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcattccttttctggtggcagcagcaacaggtcgcccactcccaggttcaagttggtagcagtcgtggacgcgtggcggtagaaggnggccgtggggcctcgaggtcgaacgtcctccgtggacgaacggtcttcgtacggttaacctacgttttagctaggtttagtgggttcgtcgaaggtccggttggggtacgccggtaacgtaccgggtccccgtagggaaccgaaggggttcttacgggaggtcggggagtaggggtagtcggaatcgaggtacctaacggttactaacggtacggaaaacctaacgtaaaggtacgtacgaaccgtaagtaaaccgtttaacgttacccggnggtaactacggtaaccgtctaacggtactaaccggtacccgtaaccgaagtaacccgaaccgttaactaccggtaacccgaaggtacccgtaaaccgttcccgttaaaccggtaccttaaacgggtaccgggtaaaccggtaaccgggttaaacgggaaccccgttaaaggtttaccggaaacgttacccggttaacggaaccggttaaccgggtaacccgttaaccgggttttaacttaaacgggtttaccttagggttaaccggtaggtaaaccggtaacgtaaaccgggttaaccttaaccccgtttaccgttaaccttaaacgttacgtttaaacccggaacggttaccggttaggttaaacccggttacggtttacccttttaggtttaacccggg

SEQ ID NO: 290544 - DNA, 672 bp, Homo sapiens
  misc_feature: GYAE6OF01DTUM0.38.25.C03.1.454.CMB.1.raw
  modified_base (248)..(248): a, c, t, g, unknown or other
  misc_feature (248)..(248): n is a, c, g, or t
  modified_base (295)..(295): a, c, t, g, unknown or other
  misc_feature (295)..(295): n is a, c, g, or t
  modified_base (311)..(311): a, c, t, g, unknown or other
  misc_feature (311)..(311): n is a, c, g, or t
  modified_base (441)..(441): a, c, t, g, unknown or other
  misc_feature (441)..(441): n is a, c, g, or t
  modified_base (471)..(471): a, c, t, g, unknown or other
  misc_feature (471)..(471): n is a, c, g, or t
  modified_base (526)..(526): a, c, t, g, unknown or other
  misc_feature (526)..(526): n is a, c, g, or t
tcagtcgatcacgtcacgaccggtgctcgatttagtagtgtagatttgggttggggacccaaaaaaccacacccctccttgggagaatcccctagatcacagctcctcaccatggactggacctggagcattccttttctggtggcagcagcaacaggtgcccactcccgaggttcaagtttggcgacagtctggagctgaggtgaacggaggtcccgtgggggcctacgaggtcgaaccgtctccgngactaaggtcttcgtaggttacctagtttaacgcgtagttagtggtntacgagcgtggtgacncgtacggcccgtaggacgtagggcgttggtaggaggacggtaggtcggtaggactcgagtactaagttaacaaagtacgtaaaccaaagtaaagttgacgtacaacgttaataacgttcccgaaggttanacgtacgactagtacagtacgacaacgacncgaactactcgacgacgactacacgtacacgtagaacggtatacggaagtacggnaagtacttccgaagacccgtaacgtactaacgtttaacttacgttagccgttagacgaagtaagaacccgttaccgttacgtaccttaccgtaaagttaacccgtacgtacggtaaccttaggttaacgttacggttcgttttaac

SEQ ID NO: 290545 - DNA, 1059 bp, Homo sapiens
  misc_feature: GYAE6OF01A46ZC.38.25.C03.1.454.CMB.1.raw
  modified_base (412)..(412): a, c, t, g, unknown or other
  misc_feature (412)..(412): n is a, c, g, or t
tcagtcgatcacgtcacgaccggtgctcgatttagtagtgtagatttggggtttggggacccaaaaaccacacccctccttgggagaatcccctagatcacagctcctcaccatggactggacctggagcattccttttcttggtggcagcagcaacgaggtcgaccccactccctaggtttaccaagttggtgcctagtccgtggacgtctggcggtagaagacggtccgtggggcctcgaggtacgtaaccggttctaccgtggacgtaacggtctttcgttacggtttacttaccttttagcgttagtttacgtggttcgtacgaggtcgtgggtacgccgaacgccggtacccgtaggaacggtagggtcttaggagggttcggaaggtcgggtagtggactacgganaccgttacgtaacgtaagtacgaaataacgtaagtagtacaacgtaactaaacgttaacgttaccggaggtaacgttaagacgttacgtaaccgttaacgtaacgaaccgttaaaccgaaccgggtaaaccgaacccgttaaccaaaccccgggaccgtaaaccggtaaccgtaccggtaaaaccccggtccgtttaacccgtaaacgggttaaacggtaaaccggggttaaacccgttaacgggtaaaacccgggttaacgggttaacccggaaacggtttaacccggttacccgggttaaaacccgggttaaacccggaaaaccccgtttaacccgggggtttaaacccttttaaaagggtttttaccgggttttaaacgggttttacccggggaaccggtttaaaacccgggggaaaacgtttaaaaacccccggggtttaaaccggttttttaaaaaccccccttaccccggtttttaaaacccccgtttttaaaacccggggtttaaacccggttttaaaacccccggggttttaaaaccggggtaaaacccggttttttaaacggggggttaaaacccggggtttttaaacggtttttaccccggggttttaaaaccgtttttttttttaaacccccgggg

SEQ ID NO: 290546 - DNA, 783 bp, Homo sapiens
  misc_feature: GYAE6OF01AE2GP.38.25.C03.1.454.CMB.1.raw
  modified_base (770)..(770): a, c, t, g, unknown or other
  misc_feature (770)..(770): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcattcctttttcttggtggcagcagcaacaggtcgccccactcccaggttcaagtttcggtgcagtcgtggagcgtggcggtagaaggacggccgtggggcctgagtagaccgtctccgtgacgtacggtccttcgttaggttaccttacgttttagcgttagttagtggtcgtcacgtcggttgggtgcgaccgaccggtccccgtagggaccgaggggtcttagggacgggtggaggtgggagtagggacttacgacggtctaacgttaagaaaggtaaccggaaaacaacgtaaaggtacgtacgacaagttaacttaaacgtttccggaacggtacgtaaggtaactacgtaactacgtaaccgacgtaaccaacgacaaccgtaacctaccgtaaccgaacgacgtaccgtacgtacgacccgtaagtaacggtacggaaacggtacgggtaacgtaaccggtagtaacgtacgtacgtaaccggacccgtaacggtaccccgtttaattaacgttttagttacgtacgggtacgtacggtaaaccgacgttaacctttaacccgttacccttacctttaaacgttagttaacccgttaaacggaggtttaacgggtaggtttaacgttccggtttntttttaaacccgg

SEQ ID NO: 290547 - DNA, 741 bp, Homo sapiens
  misc_feature: GYAE6OF01BF6ZG.38.25.C03.1.454.CMB.1.raw
  modified_base (731)..(731): a, c, t, g, unknown or other
  misc_feature (731)..(731): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcattccttttctggtggcagcagcaacgaggtcgcccactcccaggttacaagttggtgcagtcgtggagcgtggcggtgaaggtcggccgtcggggacctcgtaggtacgtaacgtcctccgtgacgtaacggttccgtttaccgttacggtttaaccttacgtttttacggacgttacggttttagtcgggttagtccgtaggtccggttggtcgccgaacgtaccggtcccggtaggaacgtagggtctggtaaggtcggagtggggagttaggactacgacggactaagtaacgaaggtaacgaaaacagtaaacgtgacacgtaataacgttaacgtcggacggttagaacgtagtaacctagtacaaacgtacgaaccgaacgtaacacgtaacccacgtacccggaacgacctacgtaacctacgacctagacgtaccgtacgaagtaaccgcggttaagaactacgacggtaaccgaaccggaccgtttaacggttccttaagttagttacggacggtacaaccggtagtaaaccttaccgtaccttacgttaacctaagacgttaaccttaaggactaggtaatcgttacggtnttttaaccgg

SEQ ID NO: 290548 - DNA, 788 bp, Homo sapiens
  misc_feature: GYAE6OF01CREYD.38.25.C03.1.454.CMB.1.raw
tcagtcgatcacgtcacgaccggtgctcgatttagtagtgtagatttgggtttgggacccaaaaaccacacccctccttgggagaatcccctagatcacagctcctcaccatggactggacctggagcattccttttctggtggcagcagcaacgaggtcgcccactcccaggttcaagttggtgcagtcgtggagctggcggtgaagcggccgtgggcctcgagtcgacgtctcctgacgagtcttcgtggttactacgtttagacgtagtttgtgtgtcaggtcgtgggtcgaccgtacgaccggtcccgtaggaaccgtagggtcttaggaggtggtaggtaggtagttcggaatcgaacgtacctaacgttaacgaagttaacgaaaacgtaacgtaaagtacgtacgaacgtaacttaaagttaaccgttacggaacggtacgaacgtacgtactaagtacgtaagtccgaaccacgtaaccgaacccaaccgaacccggaagcccgtaacctaccgtaccgtaaccgtaacgacgttaacggaacgtaccggaacgtaccgtaagacgtaacgtaccgaacggaaccgttaccgaaccgttacgttaaactttggttaaccgttcgggaaccggtaaagtaaccggttaaaccgttaaccttaaacccgttttacccgtaaacccgtttaacttaaacccggttaaaccgttaaccggtaacggttaaacggttaacgggtaacgttttaacgtttaccgtttttacgtttttaaacccggg

SEQ ID NO: 290549 - DNA, 869 bp, Homo sapiens
  misc_feature: GYAE6OF01CBG45.38.25.C03.1.454.CMB.1.raw
  modified_base (211)..(211): a, c, t, g, unknown or other
  misc_feature (211)..(211): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacaggtcgcccactcccaggttcaagttggtgcagtcgtggagctggcggtgaaggnggtccgtggggcctcgtaggtgaaccgtctccgtaggccgtaaggtcctttacgtcggtttaacttaacgttttacgacgtaagttagttgggttcgtacgtaggtccggtgggtcggacggtaccgaccgggtcccgttaggaacggtacgggtcgttgggtaaggtgggaggttgggtacgtggtactacggtacgtaccgtaacgttaaagaacgtaaacggtaaaccaaagttaaaggtctaacgtaactaaacgttaagttaaccgttacggaacgggtactagtacgtactaacgtaccgtaagtaccgaaccgtaacgaaccgtaactaacccgaaccgtaacccgtaaccggtacccgaaccgtaacgtaccggtaacctaacggtaacgggtaaccgtaacggtaaacggaaccggtttagtaacggtacgtaaccgtaaccggtaccggtaacccggtaaccgtttaaaccgtttctttaaacgttacggtttaacggtacggttaacgtaaaccgttaaacggttaaaacctttaacccgttaacccgttttaaccttaacgtttaaacgtttaaacggttttaaacgtaccgtaaaccgggtttaagttaacggttttacttcccggtttttattttaaacccggg

SEQ ID NO: 290550 - DNA, 803 bp, Homo sapiens
  misc_feature: GYAE6OF01BJZXY.38.25.C03.1.454.CMB.1.raw
  modified_base (652)..(652): a, c, t, g, unknown or other
  misc_feature (652)..(652): n is a, c, g, or t
tcagtcgatcacgtcacgaccggtgctcgatttagtagtgtagatttgggtttggggacccaaaaaccacacccctccttgggagaatccctagatcacagcctcctcaccatggactggacctggagcatcctttcttggtggcagctagcaacgaggtcgcccactcccagggttcaagttggtcgcagtcgtggacgcgtaggcgggttagaacggacggtccgtcgggggcccttcgagtacggtaaccgttcctacccgtggaccgaacggttccgtttccgtacgggtttaaccgttaactttttacggaccgttaaaggtttcgttagggttcgttaccgaacggtcccggttggggtacggtcccgaaaccggtccgggtacccccgtagggaacgtaacggggtcctttaggggaggttcgggtaggttacggggtacgttaggggtaacttaccggagtaccgtaaccgttaacggtaagttaacgggaaactaacgtaaagtcgtacgactaacgtacgttaacgttcgaggtacgaagtacgtaccagtacgtaacgtacggaacccaaggaacctacgtaactcgtacgacgtacgactacgtactaccgtatagtacggtaagtacggacgtaacgtnaacgtcgtcgaacggtaaccgcgtaacgggttccttaaggtttaccgtggttaaggaccgtacggaactaaccggttaaacctacccttttaccggtaacttactacgtaagtacccgtaggtacggtagtaccgtttatcgttttaacgg

SEQ ID NO: 290551 - DNA, 732 bp, Homo sapiens
  misc_feature: GYAE6OF01C4SZE.38.25.C03.1.454.CMB.1.raw
tcagtcgatcacgtcacgaccggtgctcgatttagtagtgtagattttgggtttggggacccaaaaaccacacccctccttgggagaatcccctagatcacagctcctcaccatggactggacctggagctattccttttcgttggtggcagcacgcaacgaggtcgcccacctcccgtaggtttctaagttggtgcagtctggagctgcggtgaaggcggccgtgggtcctacgtacgtacgtaaccgttccgtcctcgacgtaaggtcctttccgttaggttaccttacgtttttacggcgttaaggttagtgggttacgtacgtacgtcggtggtcgaccgaaccgtaccggtcccgtaggacgtaagggtctgggacgtggaggtggacgtggatcgagtactacgttaacaaagtacggaaaccgaataagtatacgtactaacgtaacgttaacgttcggaagtacgtaagtaacgtacgacgtacacgttaagacctacgaaccgtaacaccttaaaccgaccgacggtaactcaactacgtacctacgaagtaacggtatacgggaactacgagtacgtcgacgaacgtaccgtaacgtaccgttattacttaagttcgtacggtaggaacgtagaaacgttaccgttaaacttcccgttaaacttaacgttacgttaaacgtaacggttacgtaagttacggttaactcgttttagtttaccg

SEQ ID NO: 290552 - DNA, 903 bp, Homo sapiens
  misc_feature: GYAE6OF01DX7GN.38.25.C03.1.454.CMB.1.raw
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacaggtgcccactcccaggttcaagttggtgcagtctggagctgcggtgaagaggccgtggggcctcagtgaacgtctcctgacagtcttcgtggttactacttttagctagttatggttagtcagtcgttagggtgtcgacgaccggtccccgtggacgaacgggtcttggaggtaggagtacggggtatggatcgaggcttaactttaacgaaagtacggtaaaacaaccgtaaaagtacgtacggaactaacttaaacttaaccgtttacccggaagggaacctaacggtaaggtacccgtaattaccgtaaacgtttaccgaaacccgtacgaaccgtaaacccgtaccctaaaccgttacccccgaaaccgggtacccgtaacccttaaacccggttaccggttaacccccgttaacgtaaacgggtttaaccgggtaaaaccgttaaccggggtaaaacccgggtaaaccgttaacgggtaaagggttaaccttaaccggttaccggggaaacccggttaaccggttaacccgggtttaaacccttttaagtttaaacggttttacggtttagggtttaacccgggaacgggttaaacggtaaaccggttaaaacccgttaaaccccgtttttacccttaacccggttttaaaactaaacggttttaacccgttaaaccgggttaaccgttaaaggggttacgggtttaaaccggttccgttttaaccgtttttttaaccggg

SEQ ID NO: 290553 - DNA, 652 bp, Homo sapiens
  misc_feature: GYAE6OF01ELWHX.38.25.C03.1.454.CMB.1.raw
tcagtcgatcacgtcacgaccggtgctcgatttagtagtgtagatttgggtttggggacccaaaaaaccacacccctccttgggagaatcccctagatcacagctcctcaccatggactgggcctggagcatccttttcttggtggcagcagcaacaggtgcccactcccaggttcaattggtgcagtctggagctgcggtgaaggaggccgtggggcctcgagtgacgtctcctgcaggtcttctggttactacgttttgctagttatggtcgtcgaggtcgttggggtcgtaccggaccgacgggccccgtagggacgaacggggtcgttggaggtgggaggtggggagtgggactcgagactaacgttaacgaagtacggaaaacaacgtaaagtagagacaactaacttaacgttccgacggactaggtacgtacatacgagtaccgaaccaacgacgaacctaccaacgtacccgacgacgactacctacgaccctagtagtacgaaccgtaggaacgtaacgtggactagtacgacgacggtaccgtacgttacttatagttagtgtacgagaacgtaacgtaactacgtttcccttacttactattacgttaacgtacgtaagtaggtaagtttctacgttttag

SEQ ID NO: 290554 - DNA, 177 bp, Homo sapiens
  misc_feature: GYAE6OF01DTW7C.38.25.C03.1.454.CMB.1.raw
  modified_base (175)..(177): a, c, t, g, unknown or other
  misc_feature (175)..(177): n is a, c, g, or t
tcagtcgatcacgtcacgaccggtgctcgatttagtagtgtagatttgggtttggggggaagaggaagactgacggtccccccaggagttcaggtgctgggcacagcggccctgggctgcctggtcaaggactacttccacgtgatcgactgagcgggctggcaaggcgcatagnnn

SEQ ID NO: 290555 - DNA, 827 bp, Homo sapiens
  misc_feature: GYAE6OF01CZLOR.38.25.C03.1.454.CMB.1.raw
  modified_base (129)..(129): a, c, t, g, unknown or other
  misc_feature (129)..(129): n is a, c, g, or t
  modified_base (159)..(159): a, c, t, g, unknown or other
  misc_feature (159)..(159): n is a, c, g, or t
  modified_base (163)..(163): a, c, t, g, unknown or other
  misc_feature (163)..(163): n is a, c, g, or t
  modified_base (672)..(672): a, c, t, g, unknown or other
  misc_feature (672)..(672): n is a, c, g, or t
  modified_base (678)..(678): a, c, t, g, unknown or other
  misc_feature (678)..(678): n is a, c, g, or t
tcagtcgatcacgtcacgaccggtgctcgatttagtagtgtagatttgggtttggggacccaaaaaaccacacccctccttgggagaatcccctagatcacagctcctcaccatggactggacctggancattccttttcttggtggcagcagctaacnggtncccacgtcccaggttacaagttggtgcagtcgtggagctgcggtagaaggaggccgtggggcctcgaggtcgaacgtctccgtgacgtaaggtcctttacgtacggttaccgttaagtttttacgacggttagtttacgtgggtttacgtcgtaacggttccggtagggttacggacccgaccggtaaccggtcccccgttaggggaaaccgtaacggggttcgttaggtagggttaggtaaggtacgggtagtaggtactacgtagtacccgttaaacgtttaacgaaacggtaacggtaaaacaaacgtaaagttaacgtacggaacctaaacgtaaactttaacgttttaacccggaagggtaaccgtacggtaaacgttacgttaaaacgtcgtaaaccgttaacgaacccgtaagaaaccgtaaccacgtaaccgtaccggaacgtaccaccgtaaccgtacgaaccttaacgtaagtaacggtaagacggtaacggtaaccgngtaaancgttaactcggtaaaccgtaccgtacgttaccgtttaattgttagtcggtacgagtaaagacggttaaacttaaccgttaccttacttaaacgtactttaaaccggtaacgttacggtaacgttaggaaacggttgtttactttaacgg

SEQ ID NO: 290556 - DNA, 836 bp, Homo sapiens
  misc_feature: GYAE6OF01C4Y1J.38.25.C03.1.454.CMB.1.raw
  modified_base (130)..(130): a, c, t, g, unknown or other
  misc_feature (130)..(130): n is a, c, g, or t
  modified_base (339)..(339): a, c, t, g, unknown or other
  misc_feature (339)..(339): n is a, c, g, or t
tcagtcgatcacgtcacgaccggtgctcgatttagtagtgtagatttgggtttggggacccaaaaaccacaccccccctcttgggagaatcccctagatcacagctcctcaccatggactggacctggancatcctttctggtggcagcagcaacaggtcgacccactcccagggttcaagttggtgcagttcgtgggagtctggacgggtagaacggacggtccgtcgggggtcctacggaggtacggaaccgttcctacccgttgaccgaagggtccttcgtacggtttacctagtttttacggacttaaggtttagtgggttggtacgtagtcggngggttacggaccgtaacggtaccggtccccggttaggaacggtaacggggtcgttacggtaaggggtagggtaaggtcggggtaacggtaggtaaccgttcgaacgtccggttaaactttaaacgaaaccgggttaaacggaaaaaccgtaaccgtaaaaggttaccgttacggaaccttaaacgttaaacgttaaccggttttaaccggacgggttaacgaaacggttacggaaccttaacgtaacgtaaccgttaaccgaaccgttaacgaacgtaacctacgaacgtacccgacgacgtaccaacgtcccgtaccaacgtcggtaacggtaacgtacggaaccggtaacgttaggacgttacgtaaccgtaacggtaaccggtacccttacggtactttaaactagttttacgcgttaacggtagacggtaactacgtacttacccgtttactagtaacttacgtacgaatacggttagtacgtgttctttacg

SEQ ID NO: 290557 - DNA, 961 bp, Homo sapiens
  misc_feature: GYAE6OF01B1ZVG.38.25.C03.1.454.CMB.1.raw
  modified_base (160)..(160): a, c, t, g, unknown or other
  misc_feature (160)..(160): n is a, c, g, or t
tcagtcgatcacgtcacgaccggtgctcgatttagtagtgtagatttgggtttgggggacccgaaaaaccacaccccgtccttgggagaagtcccctagatcacagctcctcaccatggactggacctggagcatcctttctggtggcgagcagcgaacnggtacgcccactcccgagggttccaagttggtcgactacggttcgtggagccgtggtcgggtagacggacggtccgtcgggggccctacgagttcggaaccgtcgtccgtgcaacggtccttacgtcggttactacttttagacgtagtttacgtggttagtcgacgtcggttagggtacggcgtaccgacggccccgttaggaccgtaagggtcttacgggagggtcggtacgttcggggactcggggtacttacggacggtccttaacgttaacgttaacggaacggtaaaaccttaaccgggtaaagtacgttacggaaccttaacgtaacgtttaaccggtttccggaaacggggtacctaacggaaccttaccgtaacgttaccgttaagtaccggtaaccgtaaccgggtaacgtaacccaaccggtaaccctccccggttaaaaccgcccggtttaaccgtaaccccggttacgaccccggtttaaacgtaacgggtacccgggtttaaacggacccgggttaaacggtaaccccggtaagtaaccgggtaaccgtttcggggttaaaccccggaacggtaaccccgggttacccgggttttaaccctttaaaacggggggtttacccttttaaagggtttccggttaaccgggggtaccgtaaaccggttaaccggtaaaaccccgttttaacgtttaccccggttaacccgttaaagtttacgggttaactttaaccccggggacggtttaaagtaaccggggttactaacccggtttgttttttaacccgg

SEQ ID NO: 290558 - DNA, 692 bp, Homo sapiens
  misc_feature: GYAE6OF01BZTM7.38.25.C03.1.454.CMB.1.raw
  modified_base (196)..(196): a, c, t, g, unknown or other
  misc_feature (196)..(196): n is a, c, g, or t
  modified_base (221)..(221): a, c, t, g, unknown or other
  misc_feature (221)..(221): n is a, c, g, or t
  modified_base (292)..(292): a, c, t, g, unknown or other
  misc_feature (292)..(292): n is a, c, g, or t
  modified_base (522)..(522): a, c, t, g, unknown or other
  misc_feature (522)..(522): n is a, c, g, or t
  modified_base (534)..(534): a, c, t, g, unknown or other
  misc_feature (534)..(534): n is a, c, g, or t
  modified_base (546)..(546): a, c, t, g, unknown or other
  misc_feature (546)..(546): n is a, c, g, or t
  modified_base (610)..(610): a, c, t, g, unknown or other
  misc_feature (610)..(610): n is a, c, g, or t
  modified_base (645)..(645): a, c, t, g, unknown or other
  misc_feature (645)..(645): n is a, c, g, or t
tcagtcgatcacgtcacgaccggtgctcgatttagtagtgtagatttgggtttggggacccaaaaaaccacacccctccttgggagaatcccctagatcacagctcctcaccatggactggacctggagcattccttttcttggtggcagcagcaacaggtgcccactcccaggttcaattggtgcgagtctggancgtgcggtgagaggccgtgggcctnagtgacgtctctgacgagtcttcgttggttactacgtttagctagttgtggtcgtcgagtcgttagggtcnccggaagaccgggtccccgtaggaacgaggggttccttggaggtggtacgtggggaagttggcgtacgacgacgtaacttaacgaaacgtacggaaaacctaacggtaaaggttctacggaacttaacgtaactttaacggttacggaacgggtactaacggtactacgtacgttaacgacgttaccgaccaaacgtacgaacccaagttaccgaccaacggtaccaccncgttacacctanacggtacgtaanacgggtaactacggtgtaacgtgaccgtacggaacctacggtacgtttctaattacttgtacgngcgaaacgagtaaccttaacgttccctaacgttanaaccgttaaggttaacgagttagtaagttagttgtttaaccttttgg

SEQ ID NO: 290559 - DNA, 673 bp, Homo sapiens
  misc_feature: GYAE6OF01EDNCW.38.25.C03.1.454.CMB.1.raw
tcagtcgatcacgtcacgaccggtgctcgatttagtagtgtagatttgggtttggggacccaaaaaaccacacccctccttgggagaatcccctagatcacagctcctcaccatggactggacctggagcatccttttcttggtggcagcagcaacaggtcgcccactcccaggttcaattggtgcagtctggagctggcggtgaaggaggccgtggggcctcgagtgaacgtctctgcgagcttcgtggttactacttttagctagttagtggtgtcgagtcgtgggtgccgacgacggtccccgtaggacgaagggtcttggaggtggagtggggagtggatcgagactaacgtaacaagaggaaacaagaaaagtatagacaataattaattaccgaggacaagagtacatcaatacgaacctaacgagaaccaccgtactaccgaaacgacgtaccaaccgtagaccctaactacgtaacgggtaaacctaacggaaccggtaaccgtaggaacgtacgtacgtaacgtaacccggacgtaaccggttacctttaagttaacgtttagttacgtaggacgtaaggaataaccgtttaaaccttacccttacttaactaagttaacgttaacgtaacggtagtaggttaacggttcttacgtttttaacg

SEQ ID NO: 290560 - DNA, 884 bp, Homo sapiens
  misc_feature: GYAE6OF01E493L.38.25.C03.1.454.CMB.1.raw
  modified_base (281)..(281): a, c, t, g, unknown or other
  misc_feature (281)..(281): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtgcagcagcaacaggtcgccccacctcccgaggttacaagttgggtgcagtcgtggagtcgtggcggtaggaagcgggccggtcgggcctcgaggtcgacgtctccgtgacgaggtcttcgtcgttactactttacgngttagttagtggtctcgaggtcggttgggcgacgaccgaccggtccccgtagggaccgaggggtcttggacggtgggtaacggtaggggtagtacgggtactacggacgtaccttaacgttaacgtaaacggtaacggaaaacaacgtaaaggttataccgaactaacgttaagtttaacccggtacggaacgggacctaaggtacgaaccgtagttaacctaggtaccccgaacgaaccgtacgaacccgtaaacctacgttaaccccggaacggtacccgaaacctaccggttaccgtaacctaacccggaaggttaacccgggaaacgtaccgggggtaaaccggttacgtaggtaaaccgttcgttaacccgaaccggggttaccgacccggttttaaaacccggttctttaagttttaaacgttccgggttaagtacgggtaccggttaaaaaggtaccgtttaaaaacccgttttacccgtttacccccgtttaaacgtaaaaccgtttaacgttttaaaacccgggttaccggtaaaacgggtttaggttaaacccgggtttagttttccccgggtttgttttttttaaaccccgg

SEQ ID NO: 290561 - DNA, 808 bp, Homo sapiens
  misc_feature: GYAE6OF01EOYZL.38.25.C03.1.454.CMB.1.raw
  modified_base (157)..(157): a, c, t, g, unknown or other
  misc_feature (157)..(157): n is a, c, g, or t
  modified_base (215)..(215): a, c, t, g, unknown or other
  misc_feature (215)..(215): n is a, c, g, or t
  modified_base (363)..(363): a, c, t, g, unknown or other
  misc_feature (363)..(363): n is a, c, g, or t
tcagtcgatcacgtcacgaccggtgctcgatttagtagtgtagatttgggtttggggacccaaaaaaccacacccctccttgggagaatcccctagatcacagctcctcaccatggactggacctggagcatccttttcttggtggcagcagcaacnggtgcccactcccaggttcaattgggtcgcgtagtctgggacgcgtggcggtgaaggnggccgtggggccctcgagtgaacgtctccgtgacaaggtccttacgttacggttaacctacttttacggacgttacggtttagtgggttcgtacaggtccggtgggtacgccggtaacgaccggtccccgtagggacgtaacggggtntttaggacggtgggtaagtggggaacgttgggaatcgaacgttacgtaaaccgttaacgaaaggtaacggaaaaccaagtaaaacggttaactcgtaactaaactacgtttaaacgttaccgggaggttacgaacggtaatcggtaaactctaaaggtaccaaccgaagaccgaaccttaacgtaccgtaacccggaacgtacggtaacctacgtacccgaacgtaacgtaacgtaaccggtaaagtacgggaacgtaaccggtaggtaactacggtaacgttacggaaacccgtccggttaacggtttaacttaaacggttttacgttaacggtcgtaaaccggtaaacgtaacgtaaacgttaaactttaaccggttcccttaacgtaaagtactttaacggtaacgtacgtaacggtaagtttacgtgtttaccgttttaag

SEQ ID NO: 290562 - DNA, 798 bp, Homo sapiens
  misc_feature: GYAE6OF01A83X7.38.25.C03.1.454.CMB.1.raw
  modified_base (372)..(372): a, c, t, g, unknown or other
  misc_feature (372)..(372): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtcgtggagctggcggtagaaggacggccggtcggggccttacgaagtacggaacgttcctccgtagacgaacggttctttcgttacggtttaccttacgttttacgacgttaagttagttgggttcgtacgacggtcggttcggggtcgacggaccgaccggcccgtaggaacggacggtctaggnggtgggacggtgggagtggagtacgacggtactaacgttaacgaagtaaggaaactaacggtaagtcgtacgacaactaaacgttaaccgttacggacgggtacaacggtacgttacaacgtactacgtaccgaaccgaacaaccggaacaccttacgaccccggaagtaccgtaccgtactaccgaccctacgttaagtaacggtaaccgtagggaaccgttaaacgaggaacgttacttaccgggaacgaccggtaacccggtacctttaacttaatttaccggttacgttgtaaccggaagtaccgtaaacgttaaacccgtttaaccttaccccggtttacgttaaaccgttaagttaaacccggttaacggtaacgggttaacgtttaagggtccgtttacgttttttaaacgtttcccgg

SEQ ID NO: 290563 - DNA, 651 bp, Homo sapiens
  misc_feature: GYAE6OF01DZLOH.38.25.C03.1.454.CMB.1.raw
  modified_base (207)..(207): a, c, t, g, unknown or other
  misc_feature (207)..(207): n is a, c, g, or t
tcagtcgatcacgtcacgaccggtgctcgatttagtagtgtagatttgggtttggggacccaaaaaaccacacccctccttgggagaatcccctagatcacagctcctcaccatggactggacctggagcatccttttcttggtggcagcagcaacaggtgcccactcccaggttcaattggtgcagtctggagctggcggtgaagnggcctggggcctcagtgaacgtctcctgcaaggcttctggttactacttttagcgtagttagtggtgtcagtcgtgggtgacgacgtacggcccgtagacgtaagggtctaggaggtggtaggtgggagtggaactcgagtacctaaagttaacaacgtaggaaaaccaacgtaaagtatacggacaacgtaattaacgtttaccgaaggcgaaggtacgtactacgtaacgacgtaggaaccctacgaagtaacccaactacgtaccaacgacgaccgactcgaaccctagtaggtacggaactcggaacgtactaggtacacgtcgacgacgaccgtacgtaccttagttaacgttagtgtacgcggaaactaacgaacgttaccttacttaccttactaagttacgaagttaaccgagtacgtagttaccttgttttaacg

SEQ ID NO: 290564 - DNA, 1197 bp, Homo sapiens
  misc_feature: GYAE6OF01BGOA8.38.25.C03.1.454.CMB.1.raw
tcagtcgatcacgtcacgaccggtgctcgatttagtagtgtagatttgggtttggggacccaaaaaccacacccctccttgggagaatcccctagatcacagcctcctcaccatggactggacctggagctacttcctttttcgttggtggcagcagcaacgtggtcgccccactcccgtaggttcgtaacgtttggtcgacgtacggttaccttagggaacgtcgttacggtccgggttaaggaaacgggaccgggtccccggttcgggggaccccttacggtaaggttaccggtaaacccggttccttacccgttacggaaccgttaacggttcccttttaccggtttaccgggttttaaccttaacttttttacggtacgtttaaacgggtttttacggttacgggtttcgttaaccggtaacggttccgggttaggggttaccggtaaccgggttaacccggtacccggggttacccccggttaaggggtaaccgggttaaccccggggttcggtttaacgggtacgggtttacgggtaggtttaaccggggtagttacggggtaacgtaccggtaaggtaacccttaaaccgtttaaaccggaaaacgggtttaaaccggaaaaacccgtttaaaacggttaaaaccgggttacgttaacccggtaaaccgttaaaaacccgtttaaacgtttttaaacccgggtaaccccggggtaaaggggttacctaaacggggttaaacggttaacctaacggtttaacggtaaacccgttaccccgtaaaacccgtaaccctaaacccgtaaaccccggtaacccttaaccgaaaccccgggtacgttaaccccggtacccgttaacgggttaccccttaaacccgttaaccgggtacggtaaaccccggttaaccgggtaaacggtaaccccggttaacgttaccggttaaacgtacccgtttaaaccggtaccggaaccccggtaaccgggtttttacccgttaaacgttttttaacgttaggtttacccgggtttaaggacggttaaacgggttaaacccgttaaaacccggtttaaacccgtttaaaccccgttttttccccgtaaacgggttttaaaaaccccgtacgttttttaaacccccgggaaaacggggttaacggttaaacccggggtttttaaaccggtaaccgg

SEQ ID NO: 290565 - DNA, 744 bp, Homo sapiens
  misc_feature: GYAE6OF01B3FR1.38.25.C03.1.454.CMB.1.raw
  modified_base (455)..(455): a, c, t, g, unknown or other
  misc_feature (455)..(455): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcattccttttctgggtggcagcagacaacaggtcgcccactcccgaggttactaagttggtgcagtcgtggagctggcggtgaaggacggccggtcgggcctacgtaggtcgaacgtcctcgtcgactaaggtctttcgttacggttaccttaacgttttacgcgttaggtttacgtgggtagtacgtacggtcgggttgggtcggaccgtacccggaccggtccccgtagggaacggtacggggtcgttagggaaggtgggtaggtagggatggtactacgacgtaacgtaacttaacgaagtaacggaaaactaacgtaaaagtntaacgaacgtaactaaacgtttacgtacgggaacggtacaacgaacgtacaacgttgtaaccgtaacgaacccgaacgtaaccgaactaaccgtaacgtaccgaacgtaccgaactccgtacgacttaacgagtacggtaacgagaacggtacagaacgtacgtcgaacgtaccgaacgtaccgttacttaagttatacggttcgtaaggacgtaagaacgttaaactccttaccgttaataacttattaggaaccttaggacggttaagtacgttcttacgttttacg

SEQ ID NO: 290566 - DNA, 900 bp, Homo sapiens
  misc_feature: GYAE6OF01AYBPF.38.25.C03.1.454.CMB.1.raw
  modified_base (205)..(205): a, c, t, g, unknown or other
  misc_feature (205)..(205): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacgaggtcgcccacctcccgaggttaccaagtttcggtgcgagtccgtggngcgtggcgggtgaaggcggccgtcggggcctcgagtcgtacgtcctccgtgacgacggtcttcgttaggttaccttacttttagcgtagttagttaggtgtacgacggtcggtaggggtcgacgaccggaccggcccggttacgggacggtaacgggttccgttagggtagggtcgggtaaggtgggtacgtacgggataccgtaacgtaccgtaaacgttaacgtaaaacggtacgtaaaacgtaacgtaaaacgtgtaacccggtaactaaaccttaagtttaacccgttaaccggggaaacgtacgtaacggttacctacgtaccgtaacggtaacccgtaaaccgaacccgaaaccgtaaccgtaaccctaaccggaacccctaacccgggtaacgaacccggttaacccctacggttaacccgtaaccccggttaactaacgggttaacggtaaacccgtacgggtaaacccgtaaggtacgtaaccgtagtacccgggttaaccgacccggtaacggttaaccgttttcttaaactttcggttaagttcggaaacggtaccgtaaacgtaaaccgttacccgttaaacgttacccctttaacgttaaaccgttaaacgtaacccgggttaaacgtaaccgggttaacgttaaccgggtttaacggttccgtttttaacgttttacccgg

SEQ ID NO: 290567 - DNA, 881 bp, Homo sapiens
  misc_feature: GYAE6OF01ANFTW.38.25.C03.1.454.CMB.1.raw
  modified_base (214)..(214): a, c, t, g, unknown or other
  misc_feature (214)..(214): n is a, c, g, or t
  modified_base (231)..(231): a, c, t, g, unknown or other
  misc_feature (231)..(231): n is a, c, g, or t
  modified_base (340)..(340): a, c, t, g, unknown or other
  misc_feature (340)..(340): n is a, c, g, or t
  modified_base (626)..(626): a, c, t, g, unknown or other
  misc_feature (626)..(626): n is a, c, g, or t
  modified_base (783)..(783): a, c, t, g, unknown or other
  misc_feature (783)..(783): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagctattccctttttcttgggtcggcagcagacaacgtaggtcgcccacctccctagggttctaagttggtcgactagtcgtgggacncgtggcggtaggaaggnggtacgtcgggtcctcgagtgtaccgtcgtcctgacgtacggtctttacgttcgttaccttacgtttagacgttagttacgtggtcgtacgacggtcggtttcgggganacccggtacgacccggttcccgtaagggaaccggtagggttcttagggaggttcggggaactgggtaacggttcggagttaccggtaacggtaccgtttaacgttaacgggaacgttaaaaccggaaacctaaaaccgggttaaagtttaggaacccgttaacgaaactttaaacggtaacccggttaccggaagggtaccgaagttaaccgttaccaaagtttaccgtacgtaaccccgggtaactaaccggtaacgaacccgttacccaaaccggttaaccccnccggttaaaccgttcccgggaaccttaccccgttaagtaacccgacggtttaaccgggtaaaccctaaggtacccgggtaattgggaaacgtccgtaaccgtaccgggaccggtaaaccgtttcggttaaacttaggtttacccttgggttaaccgnggtacggtaaagtaaaccctaccggtttaaccttcgttaactacggttaacgttaaccgtacgtaagggttactagtacgtttcgttactttaacggg

SEQ ID NO: 290568 - DNA, 171 bp, Homo sapiens
  misc_feature: GYAE6OF02H3ZEH.38.25.C03.1.454.CMB.1.raw
  modified_base (171)..(171): a, c, t, g, unknown or other
  misc_feature (171)..(171): n is a, c, g, or t
tcagtcgatcacgtcacgaccggtgctcgatttagtagtgtagatttgggtttggggaagaggaagactgacggtccccaggagttcaggtgctgggcacagcggccctgggctgcctggtcaaggactacttccacgtgatcgactgagcgggctggcaaggcgcatagn

SEQ ID NO: 290569 - DNA, 186 bp, Homo sapiens
  misc_feature: GYAE6OF02GAI3B.38.25.C03.1.454.CMB.1.raw
  modified_base (172)..(186): a, c, t, g, unknown or other
  misc_feature (172)..(186): n is a, c, g, or t
tcagtcgatcacgtcacgaccggtgctcgatttagtagtgtagatttgggtttgggggaagaggaagactgacggtcccccaggagttcaggtgctgggcacagcggccctgggctgcctggtcaaggctgcttccacgtgatcgactgagcgggctggcaaggcgcatagnnnnnnnnnnnnnnn

SEQ ID NO: 290570 - DNA, 501 bp, Homo sapiens
  misc_feature: GYAE6OF02GHOMW.38.25.C03.1.454.CMB.1.raw
  modified_base (383)..(383): a, c, t, g, unknown or other
  misc_feature (383)..(383): n is a, c, g, or t
  modified_base (423)..(423): a, c, t, g, unknown or other
  misc_feature (423)..(423): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaatggaaacacaaagtatgcacataatttccagggcagagtcatcatgaccanagacacatccagagcactgcctacatgaactgagactganatctgacgacacgcttatattatgtgcgagagacaaattcctaccttacattatacgacgataggaagtgtactttac

SEQ ID NO: 290571 - DNA, 181 bp, Homo sapiens
  misc_feature: GYAE6OF02HYHXA.38.25.C03.1.454.CMB.1.raw
  modified_base (173)..(181): a, c, t, g, unknown or other
  misc_feature (173)..(181): n is a, c, g, or t
tcagtcgatcacgtcacgaccggtgctcgatttagtagtgtagatttgggtttgggggaagaggaagactgacggtcccccaggagttcaggtgctgggcacagcggccctgggctgcctggtcaaggactacttccacgtgatcgactgagcgggctggcaaggcgcatagnnnnnnnnn

SEQ ID NO: 290572 - DNA, 504 bp, Homo sapiens
  misc_feature: GYAE6OF02I37BT.38.25.C03.1.454.CMB.1.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaatggaaacacaaagtatagcacataatttccagggcagagtcatcatgaccacagacacatccagagcactgcctacatggaactgagaacctgagatctagacgacacggccttatattattgtgcgagagacaattcctactacatattacgacgaatggaagtgatttac

SEQ ID NO: 290573 - DNA, 175 bp, Homo sapiens
  misc_feature: GYAE6OF02HQYG0.38.25.C03.1.454.CMB.1.raw
  modified_base (173)..(175): a, c, t, g, unknown or other
  misc_feature (173)..(175): n is a, c, g, or t
tcagtcgatcacgtcacgaccggtgctcgatttagtagtgtagatttgggtttgggggaagaggaagactgacggtcccccaggagttcaggtgctgggcacagcggccctgggctgcctggtcaaggactacttccacgtgatcgactgagcgggctggcaaggcgcatagnnn

SEQ ID NO: 290574 - DNA, 179 bp, Homo sapiens
  misc_feature: GYAE6OF02GW79Y.38.25.C03.1.454.CMB.1.raw
  modified_base (173)..(179): a, c, t, g, unknown or other
  misc_feature (173)..(179): n is a, c, g, or t
tcagtcgatcacgtcacgaccggtgctcgatttagtagtgtagatttgggtttgggggaagaggaagactgacggtcccccaggagttcaggtgctgggcacagcggccctgggctgcctggtcaaggactacttccacgtgatcgactgagcgggctggcaaggcgcatagnnnnnnn

SEQ ID NO: 290575 - DNA, 243 bp, Homo sapiens
  misc_feature: GYAE6OF02GZEF6.38.25.C03.1.454.CMB.1.raw
  modified_base (148)..(148): a, c, t, g, unknown or other
  misc_feature (148)..(148): n is a, c, g, or t
  modified_base (180)..(180): a, c, t, g, unknown or other
  misc_feature (180)..(180): n is a, c, g, or t
  modified_base (182)..(185): a, c, t, g, unknown or other
  misc_feature (182)..(185): n is a, c, g, or t
  modified_base (187)..(187): a, c, t, g, unknown or other
  misc_feature (187)..(187): n is a, c, g, or t
  modified_base (189)..(190): a, c, t, g, unknown or other
  misc_feature (189)..(190): n is a, c, g, or t
  modified_base (192)..(243): a, c, t, g, unknown or other
  misc_feature (192)..(243): n is a, c, g, or t
tcagtcgatcacgtcacgaccggtgctcgatttagtagtgtagatttgggtttgggggaaggaggaagactgacggtccccccaggacgttcagggtgctggggcaccagcggccctgggctgcctggtcaaggactacttccacgtnatcgactgagcgggctggcaaggtcgcatagntnnnngntnngnnnnnnnnnnnnnnnnnnnnnnnnnnnnnnnnnnnnnnnnnnnnnnnnnnnn

SEQ ID NO: 290576 - DNA, 526 bp, Homo sapiens
  misc_feature: GYAE6OF02IYI7T.38.25.C03.1.454.CMB.1.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaatggaaacacaaagtatgacacataatttccaggcagagtcatcatgaccacagacacatccacgagcactgaccctacatggaactgagaaccctgagatctagacgacacggcttatattattgagcgagagaactaaacttccctacttaacattacttaacggacgtaagtggaaagttcgtactttaacg

SEQ ID NO: 290577 - DNA, 665 bp, Homo sapiens
  misc_feature: GYAE6OF02ID7QV.38.25.C03.1.454.CMB.1.raw
  modified_base (321)..(321): a, c, t, g, unknown or other
  misc_feature (321)..(321): n is a, c, g, or t
tcagtcgatcacgtcacgaccggtgctcgatttagtagtgtagatttgggtttgggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttactacttttagctagttatggtgtcgagcgtgggtggcgacgacggccccgtcggacgaagggcgttggaggtntagggggggggggggggggggggggggggggggtgaggtggagtcgagactacttaacaagtaggaaacaacaaagtaatagacaactaataactttaccgtacggacgagagtactactactatacgaccaacaacgacaacactaccaacgacgaccacgtacgacctaactaacgtacggtaacgtacggaacggaaaccgtaggaagtacgtacgtacgacgaaccgaccggtaccgttacttaagttattagttacgtacgagaacgtaacgtaaacttaccttaccttaacttaacttaacgttaacgtaacgtaagtaggtaagtacgttactttac

SEQ ID NO: 290578 - DNA, 532 bp, Homo sapiens
  misc_feature: GYAE6OF02ITZDT.38.25.C03.1.454.CMB.1.raw
  modified_base (482)..(482): a, c, t, g, unknown or other
  misc_feature (482)..(482): n is a, c, g, or t
  modified_base (490)..(490): a, c, t, g, unknown or other
  misc_feature (490)..(490): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggagtgggatggatcagcacttacaataggaaacacaaagtatagacaacaataactttccgagggcaagagtacatacatcgaccacacgacacactaccaacgagacactgacctacagtaggaactaggacgaacctgagatacgtagacgacacggtcttaatattattgngacgaganacaacttcctactacatattacgacgtataggagtgtattac

SEQ ID NO: 290579 - DNA, 174 bp, Homo sapiens; identical to SEQ ID NO: 290464
  misc_feature: GYAE6OF02FRXB3.38.25.C03.1.454.CMB.1.raw
  modified_base (173)..(174): a, c, t, g, unknown or other
  misc_feature (173)..(174): n is a, c, g, or t

SEQ ID NO: 290580 - DNA, 510 bp, Homo sapiens
  misc_feature: GYAE6OF02HSSRK.38.25.C03.1.454.CMB.1.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaatggaaacacaaagtatgcacataattccaggcagagtcatcatgaccacagacacatccaacgagcactgcctacatgaactgagaactgagatctagacgacacggtcttatattatgtgacgagagactaaattcctacttaacattacttacgacgtatggaagtgtactttacg

SEQ ID NO: 290581 - DNA, 532 bp, Homo sapiens
  misc_feature: GYAE6OF02IR875.38.25.C03.1.454.CMB.1.raw
  modified_base (380)..(380): a, c, t, g, unknown or other
  misc_feature (380)..(380): n is a, c, g, or t
  modified_base (407)..(407): a, c, t, g, unknown or other
  misc_feature (407)..(407): n is a, c, g, or t
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaatggaacacaaagtatgcacatattccaggcagagtcatcatgaccanagacacatccacgagcacgtgacctanataggaactggagaacctgacgatctacgacgacaccggacttaatattattggtagaccgagacgactaaacttcctacttaacacttaagttaccgacgtatagggaacgttcggattttacg

SEQ ID NO: 290582 - DNA, 522 bp, Homo sapiens
  misc_feature: GYAE6OF02H64PT.38.25.C03.1.454.CMB.1.raw
  modified_base (382)..(382): a, c, t, g, unknown or other
  misc_feature (382)..(382): n is a, c, g, or t
  modified_base (398)..(398): a, c, t, g, unknown or other
  misc_feature (398)..(398): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaatggaaacacaaagtatgacacataattcagggcagagtcatcatgaccanagacacactaccagancactcgacctacatggaactggaacgaacctgagatctagacgacacggtaccttaatattattgtgacgagagaactaacttcctacttaactatattacgacgtataggaatgtactttacg

SEQ ID NO: 290583 - DNA, 592 bp, Homo sapiens
  misc_feature: GYAE6OF02HZQQ5.38.25.C03.1.454.CMB.1.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagctagttatggtgtcagcgtgggtgcgacgacggcccctggacaagggcttgagtggagtggggatggatcgagcacttaacgaataggaaacacgaaaagtatagacaactaataactttccgaagggtacaaggagtacaattcatacgaaccaacagaacaacaactacccgaacgaacacaactcgaccctaacatacggaactaggaacgaaccgtagaagactcgtagacgacgtaccggtaccttaattacttatggtagacggagagtaaccgtaaacttccctacttaactattattacgacgtatagggtaacttgtactttacg

SEQ ID NO: 290584 - DNA, 525 bp, Homo sapiens
  misc_feature: GYAE6OF02F0XO4.38.25.C03.1.454.CMB.1.raw
  modified_base (426)..(426): a, c, t, g, unknown or other
  misc_feature (426)..(426): n is a, c, g, or t
  modified_base (430)..(430): a, c, t, g, unknown or other
  misc_feature (430)..(430): n is a, c, g, or t
  modified_base (519)..(519): a, c, t, g, unknown or other
  misc_feature (519)..(519): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacctttaccaactatggtatcaactgggtgcgacaggcccctggacaagggcttgagtggatgggatggatcagcgcttacaataataacacacactatgcacagaagttccagggcagagtcacgtgaccacggacacatccacgagcacagacctaacatggagttgaggagccngagntctgacgacacggccgtgtactactgtgcgagagtacagaatattgtatggactacgtgggacctacgggaacccgtggtcctaccgtntacccg

SEQ ID NO: 290585 - DNA, 529 bp, Homo sapiens
  misc_feature: GYAE6OF02IMEQW.38.25.C03.1.454.CMB.1.raw
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcgagcacttacaataggaaacacaaagtatgacacataattccagggcagagtcatcatcgacacagacacataccacgagcactgacctacatgaactggaacgaactgagatcgtagacgacacggtcttaatattattgtagcgagacgaactaacttccctacttaacattaacgttacgacgtagtagggaatgtactttacg

SEQ ID NO: 290586 - DNA, 635 bp, Homo sapiens
  misc_feature: GYAE6OF02HC915.38.25.C03.1.454.CMB.1.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaatggaaacacaaagtatgacacataattcaggcagagtcatcatgaccacagacacactccaacgacgacactcgaccctaacagttacggaaacttggaacggaacccttaggaacgtacttaccgtacggaaccgaaccgtaaccgggtcccttttaaagttaacgtttaagtttacgggttacgacggtaagtaacggtaacctaaaacgttttccccttaacccgtttaaacctaacgtttaacgtttaaccggaacggttaacgttaacgggtaaggtttacggtaccttttttaaacg

SEQ ID NO: 290587 - DNA, 514 bp, Homo sapiens
  misc_feature: GYAE6OF02GLEEB.38.25.C03.1.454.CMB.1.raw
  modified_base (507)..(507): a, c, t, g, unknown or other
  misc_feature (507)..(507): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaatggaaacacaaagtatgcacataattccaggcagagtcatcatgaccacagacacatccgcgagcactgcctacatggaactgaggaacctgagatctagacgacacggtccttatattattgtagcgagagactaaattcctaccttaacattattacgacgtatggaagtgtntttaacg

SEQ ID NO: 290588 - DNA, 776 bp, Homo sapiens
  misc_feature: GYAE6OF02F0CHY.38.25.C03.1.454.CMB.1.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcgagtgaacgtctcctgcaaggcttctggttacacttttagctagttatggtgtcagcgtgggtgcgacgacggcccctggacgaagggcttgagtggagtggggatggatcgagcacttacaagtggaaaacacgaaaagtatagaccaacgtaattaaacgttttacccgaaggggtacctaaggtaacggttactaagttacccgtaaagttaccggaaacccgtaacgaacggtaaacccaacctaaaccgttaccccgaaacggaacggtaccctaaccgttaccgggaacccccttaaaccgaaacgttaccgggggaaaacctttacgggaaaccgggtaaacccgttaagggaacggtaacgttaccggtaacggaacccgtaaccgtaacccgggttaaccctttaagtttaaactttacgtttagggtacgtacggtacgtaacggtaaacccgttaaacgtttaccccgttaaccctttaaacgttaacgtttaaacgtttaaccggtacggtaacgttagggtaaacggtttacgtactttttaacg

SEQ ID NO: 290589 - DNA, 648 bp, Homo sapiens
  misc_feature: GYAE6OF02JARSI.38.25.C03.1.454.CMB.1.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttcgtggttacacctttaccaactatggtatcaactgggtgcgacaggccctggacaaggcttgagtggatgggatggatcgaggcgtcttaacaataactaacacacaactatgacacagtagttccagggcagagtacacgtgaccacggacacataccgaacgagacacgacgacctaacgatacgggaacgttaggacggacgtacccgttaggaacgtactacgtacggaacgaccgaaccgggtaccggtagttaacgtttaacgtacggtacggtacgtaacgtacggtaacgtacgtaagtttaacggtttaggttacgttacgggtaaccgttaacggtacgggggtacccgtaacggggtaaccccgttcgggttaccgtacccggttccttaccccgg

SEQ ID NO: 290590 - DNA, 581 bp, Homo sapiens
  misc_feature: GYAE6OF02H4OCH.38.25.C03.1.454.CMB.1.raw
  modified_base (365)..(365): a, c, t, g, unknown or other
  misc_feature (365)..(365): n is a, c, g, or t
  modified_base (444)..(444): a, c, t, g, unknown or other
  misc_feature (444)..(444): n is a, c, g, or t
  modified_base (513)..(513): a, c, t, g, unknown or other
  misc_feature (513)..(513): n is a, c, g, or t
tcagtcgatcacgtcacgaccggtgctcgatttagtagtgtagatttgggtttgggggacccgaaaaaccacacccctccttgggagaatcccctagatcacagctcctcaccatggactggacctggagcatccttttcttggtggcagcagcaacagggtgcccactcccgaggttcaattggtgcagtctggagctgcggtgagaggctggggctcgagtgacgtctctgcagctcgtgttacatttagcagttatggtgtcagtcgtgggtgcgacacggcccctgggacgaagggtcttagaggttggagtggggatgggatcgagcgaactttacgaagtcggaaacacgtaaaaggtntacgacaatattaacgttcgaagggactaagagtacatacagtcgaccacgagacacactccagagcacacgtacctanagtcggaactgaacggtacctaggaacgtactcgtacgaaccgacgaccggtactttagtattagttgngacgagtacgaacttaacttcctacttaacaatacgttacgacgtagtagggtagtcgttactttacg

SEQ ID NO: 290591 - DNA, 642 bp, Homo sapiens
  misc_feature: GYAE6OF02F1K52.38.25.C03.1.454.CMB.1.raw
  modified_base (268)..(268): a, c, t, g, unknown or other
  misc_feature (268)..(268): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgagaggcctggggcctcagtgaacgtctcctgcaaggcttctggttacacttttagctagttatggtntcagctgggtgcgacaggcccctggacaagggcttgagtggatggggatggatcgagcacttacaagtggaaacacaaagtatcgacactattaatttccgagggacagagtacatacagtcgaaccacacgaacaacacgtaccaacggactaccaacgtcgaccctaacgaacgttacgggaaacgttaggaacggaaacccgtaggaacgatacgtaggaaccgtaaccgtaccggtacctttaattaactttacggtttacgtacggacgtaggtaacaaccgttaaactttcccgttaccttaacgtaactttaacgttaaccggaacggttaacgttaagggtaacgtttcgttaaccgttttttacg

SEQ ID NO: 290592 - DNA, 506 bp, Homo sapiens
  misc_feature: GYAE6OF02FR6JK.38.25.C03.1.454.CMB.1.raw
  modified_base (408)..(408): a, c, t, g, unknown or other
  misc_feature (408)..(408): n is a, c, g, or t
  modified_base (455)..(455): a, c, t, g, unknown or other
  misc_feature (455)..(455): n is a, c, g, or t
  modified_base (462)..(462): a, c, t, g, unknown or other
  misc_feature (462)..(462): n is a, c, g, or t
  modified_base (501)..(501): a, c, t, g, unknown or other
  misc_feature (501)..(501): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcgagcacttacaatggaaacacaaagtatgacacataattacgaggcagatcatcatgacacagacacatccacgagcactcgcctanatgaactgacgaactgagatcagacgacacggtccttatattatgtnacgaganacgtaattcctacttacattatacgagtataggagtgtntttac

SEQ ID NO: 290593 - DNA, 557 bp, Homo sapiens
  misc_feature: GYAE6OF02HQ1VZ.38.25.C03.1.454.CMB.1.raw
  modified_base (355)..(355): a, c, t, g, unknown or other
  misc_feature (355)..(355): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagcgtgggtgcgacaggcccctggacaagggcttgagtggagtgggatggatcgagcacttacaagtaggaaacaacaaagtanagacacaataatttccgaggtcagagtcatcatcgacacagaccactactaccgacgacgacacgtcgacctacagttacggaactagaacgaacctagacgatcgtacgacgacgacggtcttaatagtttatgtagcgagagaacgtaacttccctacttaactattaacgtacgacgagttaggaagttgtattttacg

SEQ ID NO: 290594 - DNA, 636 bp, Homo sapiens
  misc_feature: GYAE6OF02GH91F.38.25.C03.1.454.CMB.1.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaatggaaacacaaagtatgacacataactttccgagggcagagtcatcatgaccacagacacactccacgagcactcgacctacagtacggaactcggaacggtaacctggaacgtacgttcgtacggaccgtaaccgaaccgggtacccttttaattaacgtttagtttacggtacgtaccggtaggtaacggtaaccgtaaaacgttttaccccttacccgtttaaaccttaacgtttaaacgtttaaccggtaaccggtaaggtttaacggggtaacgtttacggttaaccgttttttaaccg

SEQ ID NO: 290595 - DNA, 623 bp, Homo sapiens
  misc_feature: GYAE6OF02JHAHM.38.25.C03.1.454.CMB.1.raw
tcagtcgatcacgtcacgaccggtgctcgatttagtagtgtagatttgggtttggggacccgaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcgagtcgtgggtgcgacacggcccctggacgagggtcttggagtggatgggatggatcagcacttacaataggaaacacgaaagtatgacactaataactttacgagggcaagacgtcatacatcgaccacgaacgacacactccaacgacgcacgtcgacctagacgtaggtaactaggaacgaactaggagtactcgtacgaacgaaccgtaccggtacctttaagtacgtttaagttcggtaacgacggtaggtaaacgaaccgttaaacttttacccctaacgtttaacgaacgtttaacgttaacgggaccgttaaggtacgggtaagtttacggttactttttaacg

SEQ ID NO: 290596 - DNA, 565 bp, Homo sapiens
  misc_feature: GYAE6OF02G8G95.38.25.C03.1.454.CMB.1.raw
  modified_base (384)..(384): a, c, t, g, unknown or other
  misc_feature (384)..(384): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaagtggaaacacaaagtatgcaacataattccgaggcagagtcatcatgaccanagacacatccacgagcactgaccctacatacggaactggaacggaacctggagactacgtagaccgacgaccggtacctttaagttatttattggttgaccgtaggaacgtaacgtaaactttaccctaccttaactattaacgttacggacggtaatagggtaacgttggtacttttacg

SEQ ID NO: 290597 - DNA, 515 bp, Homo sapiens
  misc_feature: GYAE6OF02GU0LE.38.25.C03.1.454.CMB.1.raw
  modified_base (385)..(385): a, c, t, g, unknown or other
  misc_feature (385)..(385): n is a, c, g, or t
  modified_base (400)..(400): a, c, t, g, unknown or other
  misc_feature (400)..(400): n is a, c, g, or t
  modified_base (404)..(404): a, c, t, g, unknown or other
  misc_feature (404)..(404): n is a, c, g, or t
  modified_base (410)..(410): a, c, t, g, unknown or other
  misc_feature (410)..(410): n is a, c, g, or t
  modified_base (423)..(423): a, c, t, g, unknown or other
  misc_feature (423)..(423): n is a, c, g, or t
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcgagcattacaatggaaacacaaagtatgacaacataatttccaggcagagtcatcatgaccanagacacatccacgancacngcctanatgactgacgacngagatcgagacgacacggtcttatattatgtgacgagacgactaacttccttactaactattaactacgtacgataggacgtgtactttacg

SEQ ID NO: 290598 - DNA, 505 bp, Homo sapiens
  misc_feature: GYAE6OF02ITXWU.38.25.C03.1.454.CMB.1.raw
  modified_base (383)..(383): a, c, t, g, unknown or other
  misc_feature (383)..(383): n is a, c, g, or t
  modified_base (410)..(410): a, c, t, g, unknown or other
  misc_feature (410)..(410): n is a, c, g, or t
  modified_base (499)..(499): a, c, t, g, unknown or other
  misc_feature (499)..(499): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaatggaaacacaaagtatgacacataatttccagggcagagtcatcatgacanagacacataccacgagcactcgcctanatggaactgacgaactgagatcagacgacacgcttatattatgtgcgagagtactaattcctactacatattacgacgtataggagtgntttacg

SEQ ID NO: 290599 - DNA, 173 bp, Homo sapiens
  misc_feature: GYAE6OF02GSD34.38.25.C03.1.454.CMB.1.raw
tcagtcgatcacgtcacgaccggtgctcgatttagtagtgtagatttgggtttgggggaagaggaagactgacggtccccccaggagttcaggtgctgggcacagcggccctgggctgcctggtcaaggactacttccacgtgatcgactgagcgggctggcaaggcgcatag

SEQ ID NO: 290600 - DNA, 615 bp, Homo sapiens
  misc_feature: GYAE6OF02G6KQ7.38.25.C03.1.454.CMB.1.raw
  modified_base (346)..(346): a, c, t, g, unknown or other
  misc_feature (346)..(346): n is a, c, g, or t
  modified_base (395)..(395): a, c, t, g, unknown or other
  misc_feature (395)..(395): n is a, c, g, or t
  modified_base (431)..(431): a, c, t, g, unknown or other
  misc_feature (431)..(431): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacgaggcccctggacaagggcttggaggtggatgggatggatcagcacttacaataggaaacanaaagtatagacacattaacttccgaagggcagagtcatcatcgaaccanacgacacactaccaacgacgacacgtcgaccctaanagtacggaaactgggaacgaaccgtgaacgactcgtacgacgtaccgacggtacctttaagtacgtttagttacgtagacgtaacgtaacgtaaccgttaaaactttcccgttaacccttaacgtaacgtttaagtttaacccggaacgtaacggttagggtaaacgttcgtacgtttttaacg

SEQ ID NO: 290601 - DNA, 559 bp, Homo sapiens
  misc_feature: GYAE6OF02HBMYG.38.25.C03.1.454.CMB.1.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttggagtggagtgggatggatcgagctaacttacaataggaaacacaaagtatagacacattaacttacgagggcagatcatcagtagaccacagacacatccacgacgcactcgacctacatcgaacgtcgaacggaacctgaacgtactcgtaggacgaccacggtactttaattaactttagtgtagacgtagagtaactaaacttccttaccgttacaatacgttaacgacgtagtaggtaagttcgtatttac

SEQ ID NO: 290602 - DNA, 576 bp, Homo sapiens
  misc_feature: GYAE6OF02INL0R.38.25.C03.1.454.CMB.1.raw
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaaggggcttgaggtggagtgggatggatcagcacttacaataggaaacacaaagtatgacaacaattaactttccgaagggacaagtagtacatcatcgaaccacagacacaactacccaacgagaccactcgacctaacgaagttagggaaactaggaacggaacctaggaacgtactcgtaggaccgacgaaccggtacctttaattaagttattgtagacgagtaagactaaattccctacttacattacttacgacgtataggaatgtactttacg

SEQ ID NO: 290603 - DNA, 563 bp, Homo sapiens
  misc_feature: GYAE6OF02I5I6S.38.25.C03.1.454.CMB.1.raw
  modified_base (404)..(404): a, c, t, g, unknown or other
  misc_feature (404)..(404): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaatggaaacacaaagtatgacaacataactttccagggcaagagtcatcatcgaccacagacacatccacgacncactcgacctacatacggaactaggaacggtaaccctgacgagtctagaccgacgacggtacctttaattacttagttgtgacgagacgaactaaacttcccttaccttaactaattaacttacggacgtaagttagggtaacttcggtacttttaacg

SEQ ID NO: 290604 - DNA, 717 bp, Homo sapiens
  misc_feature: GYAE6OF02HL8BG.38.25.C03.1.454.CMB.1.raw
  modified_base (605)..(605): a, c, t, g, unknown or other
  misc_feature (605)..(605): n is a, c, g, or t
tcagtcgatcacgtcacgaccggtgctcgatttagtagtgtagatttggggtttggggacccaaaaaccacacccctccttgggagaatcccctagatcacaactcctcaccatggactggacctggagcatccttttctggtggctagcagcaacaggttgcccactccccaggtttacaattcggtgcagtctggagctggcgggtgaaggacggccgtggggcctcgagtacgaaccgtctccgtggccaaggtcttctggttactacgttttagctagttagtcggtgtcgacgtcgtgggtcgacgaccgacggcccccgtaggacgacgggtcttacggaggtggagtcggggagtgggacgtcgaggctacgttaactaagttacggtaaaacgtaacgtaaaggttactacggtacaacttaacgttaaacgtttaccgaaggggtacccgtaaggtacggttaacgtaataccgtaacgtaccgaacccgtaaccgaacgaacctaaaccgtaccgttaacccgaaccggtaacgaccctacgtaccggttacctaaccgtagtacgggaactacggacgtaacctgacgatacgngaaccgtacgacgtacttattattacgtgacgacgtagacgtactaacgtccctacttaactacgttacgtacgtacggtagtacggtaaggtacgttacgttagtttaccg

SEQ ID NO: 290605 - DNA, 783 bp, Homo sapiens
  misc_feature: GYAE6OF02JIWBT.38.25.C03.1.454.CMB.1.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttcgtggttacacttttagctagttatggtgtcagcgtgggtgcgacacggcccctggacagggcttgagtggatgggatggatcgagctactaacgaagtaggaaacacgaaagtataggacaactaattaacgtttaccgaggggtactaaggtaacgttacaactaccgtaacgttacgaaacccgaacgtaacggtaaaccaaccgtaaacgttaccccgaaaccgggtaacggtacctaaacccggttacggaacccccgttttaaagaaaccggttacgggtaaaaccgttacggtaaaccggggtaaaacccgttggaaaccggtaacgttaccgtaccgggtaaccggtaaaccgtaacccgggtttaccgtttaaactttaacgttttaaggttaaccgggttagggtaaccggaagggttaaacgtaacccttaaaaccgttttaccccgttaaaccgtttaaccgaacgttttaaacgtaacccggtaacgttaacggttaacgggtaacgtttacggttaacctttttacgg

SEQ ID NO: 290606 - DNA, 613 bp, Homo sapiens
  misc_feature: GYAE6OF02G815T.38.25.C03.1.454.CMB.1.raw
tcagtcgatcacgtcacgaccggtgctcgatttagtagtgtagatttgggtttggggacccaaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacgacggcccctggacagggcttggagtggagtgggatggatcgagctacttacaagtacggaaacacgaaagtatgacaactaattaacgtttacccgaagggaccaaggtacgtcgaacttcaagtaccggaaccaacgacgaaccacgaactacccgaacggacgaccaactcgaccctaacgagttacggaaactggaacggaacctgaacgatcgacgacgaacgacggtacctttaagtactttagtagtcgacgtagaacgtaactaaacttccctacttaacaacgttacgtacgacgtagtaggtacttcgtacttttacg

SEQ ID NO: 290607 - DNA, 724 bp, Homo sapiens
  misc_feature: GYAE6OF02JFLJ3.38.25.C03.1.454.CMB.1.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttcgtggttacacttttaggctagttatggtgtcagctgggtgcgacgacggcccctggacgaagggtcttggagtggatgggatggactcgagccgtaactttacgaagtaggtaaaaccaagtaaaacggtatacggactaaacctaaagttaacgtttaccggaagggtaaccgaaggttaacggtaccttaacgttaccgaaagttacgggaaaccctaccgaaacggtaaacctaaccgtaacgtacccccgaaacgggtaacgaccgtaaccgttaccggaaccccttaaacgacggttaacgggtaacccgttaaggaacccgggtaaaccctagggtaacgtacgtaaccgtacggaacccggtaacgtaaccggttaacttaacgtttagtttaaacttcggtagtacgacgtaacggtacttaaaccttctaccgttaactagttactacgacgtataggaacttgtactttacg

SEQ ID NO: 290608 - DNA, 632 bp, Homo sapiens
  misc_feature: GYAE6OF02I0YTA.38.25.C03.1.454.CMB.1.raw
  modified_base (401)..(401): a, c, t, g, unknown or other
  misc_feature (401)..(401): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggacaagggcttgagtggatgggatgggatcgagtcacttacaagtaggaaacacaaagtatgacaacataaatttccaagggacaagagtacaatcgatcgaacccanaacgacaacaactacccgaacgaacgtcaaaccgtcgacccttaaacgacgttaacggtaaaccgttaggaaaccgggtaacctggaaacggtatacgtacgaaccgaacgaccggtacctttaagttaattaagttcggtgacgtacgaacgtaacctaaacgtttcccttaccttaaatacgttaacgttaacgaacgtaagttaagggtaagttacgtatttttaacg

SEQ ID NO: 290609 - DNA, 624 bp, Homo sapiens
  misc_feature: GYAE6OF02FV9PI.38.25.C03.1.454.CMB.1.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagtcgtgggtgccgacgacggccccgtggacgaagggtcttgagtggagtgggatggatcgagctacgttacaagtggaaacagaaagtatgacactataacttcgaggacagagtcagtacagtacgaacacgagacacataccgagacgcactacgcctaacagtacggaacttcggaacgtaaccgtaggaacgacgttacacggaccgacgtaccggtacctttaagttagtttacgttcggtacgtacggtagtaacgaaccttaaacgttccccttaaccgttaaccgtacgttaacgtttaaccgaacggttaacggttagggtaagttacttacgtttttaacg

SEQ ID NO: 290610 - DNA, 718 bp, Homo sapiens
  misc_feature: GYAE6OF02HQBTV.38.25.C03.1.454.CMB.1.raw
  modified_base (349)..(349): a, c, t, g, unknown or other
  misc_feature (349)..(349): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgagaggcctggggcctcagtgaacgtctcctgcaaggcttctggttacacttttagctagttatggtgtcagtcgtgggtgcgacacggcccctggacgaagggcttggagtggagtgggagtggatcgagcacttacaagtgaaacanaaacgtatagacactataacgtttccgaaggtcaaggagtacaagttcaagtcgaaccacgtaacgacaaccgatacccgaacggactcctaaccgtcgtacccgtaactagtaacggtaaccgtggtaaaccgggaaacctagggactaacgttaccgtaacgggtaaccgtaaccgaaccggggtttaccctttaaagtttaacgttttaacgttacgggttaacggaccgggtaaggtaaccgtaaaccgttaaaccgttttaccccttaacccgtttaaacccgtaaacgttttaaacgttaacccggtaaacggttaaccggtttaacgggttaacggtttaccggttaacgttttttaaccgg

SEQ ID NO: 290611 - DNA, 701 bp, Homo sapiens
  misc_feature: GYAE6OF02J021V.38.25.C03.1.454.CMB.1.raw
  modified_base (285)..(285): a, c, t, g, unknown or other
  misc_feature (285)..(285): n is a, c, g, or t
  modified_base (342)..(342): a, c, t, g, unknown or other
  misc_feature (342)..(342): n is a, c, g, or t
  modified_base (361)..(361): a, c, t, g, unknown or other
  misc_feature (361)..(361): n is a, c, g, or t
  modified_base (396)..(396): a, c, t, g, unknown or other
  misc_feature (396)..(396): n is a, c, g, or t
tcagtcgatcacgtcacgaccggtgctcgatttagtagtgtagatttgggtttggggtacccgaaaaaccacaccccgtccttgggagaatccctagatcacagctcctcaccatggactggacctggagcatccttttcttggtggcagcagcaacaggtgacccactcccaggttcaattggtgcagtctggagctgcggtgaagaggcctggggcctcagtgaacgtctcctgcaggcttctggttacacgttttagctagttatggtgtcagtcgtgggtncgacacggcccctggaccgtaaggcttgacgtggatgggatggatcgagctacttanaagtggaaacacaaagttngacaagattaacgttccgaagggtcaggtacgtanacgtcaagtcgacccagacgtacaactacgtaccgaaggacaccgtacgtcgaccttaacgtagttaaccggtaacttaagggaaccgtaaacccttggaaacgtacttaccggtaaccgtaccggtaaccgtaacccggggtacctttttaaagtaccgttttaaaggttcgggtaacgtaccggtacgtaacggttaaaccctaacccgttttacccgttaaccgttaaaccgttaaagttaacccgtttaaccggaaccggttagtaacgggttaacgttacggttacccttttttaaacgg

SEQ ID NO: 290612 - DNA, 660 bp, Homo sapiens
  misc_feature: GYAE6OF02GE0NO.38.25.C03.1.454.CMB.1.raw
  modified_base (387)..(387): a, c, t, g, unknown or other
  misc_feature (387)..(387): n is a, c, g, or t
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggtccctggacagggcttgagtggatgggatggatcagcattacaatggaaacacaaagtatgacactataacttccgaggcagagtcatcgatcgaccanacgacacagtacccaacgacgacacgtcgtaccctaagactacgggaaccttaggaacggtaaacctggaacgacttaccgtagggtaacccgaacgtaccgggttaccctttaaagttaacgttttaacgttaggtacgtaccggtaaggaacgtaaaccgttaaacgttttccccgttaaccctttaaacgtaaccgtttaaagtttaaaccccggggaacgttaacgggtttaaggggtaaacggttttcggtaaccctttttttaacgg

SEQ ID NO: 290613 - DNA, 614 bp, Homo sapiens
  misc_feature: GYAE6OF02JYHPE.38.25.C03.1.454.CMB.1.raw
  modified_base (282)..(282): a, c, t, g, unknown or other
  misc_feature (282)..(282): n is a, c, g, or t
  modified_base (414)..(414): a, c, t, g, unknown or other
  misc_feature (414)..(414): n is a, c, g, or t
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagtctgggtnacgacacggccccgtggacaagggcttgaggtggatggatggatcgaggctacgttacaagtggaaacacaaagtatcgacacgtaataacgtttaccgagggactagtacgtacaattcaatcgaacctanaacgaactacgaactcccaacggagactaactacgtaccaacgagtacggaacgtacggaacgtaacctaggaagtacgtctacggaccgtaacggacggtacctttaatacttacgtagttacgaaccgagaacgtaacctaacgtttcctaacttactattaacgtacgacgtatacggtaagttactccttttaacg

SEQ ID NO: 290614 - DNA, 691 bp, Homo sapiens
  misc_feature: GYAE6OF02GZZZ6.38.25.C03.1.454.CMB.1.raw
tcagtcgatcacgtcacgaccggtgctcgatttagtagtgtagatttgggtttggggacccaaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcgagtgaacgtctcctgcaaggcttcgtggttacacttttagcagttatggtgtcagtctgggtgcgacgaggccccgtggacaagggcttgaggtggagtgggatgggatcgagtctaacttacaaagtacggaaaacaacgtaaaagtatacgacctaacgtaaattaaacgtttacccgaagggtaccaaggtacgtacaattacgaagttcgaaaccctaacgaacgaaccacctaaacgtacccgaaccgtaagtaccctaacgttccgaacccctaacgtaacggttaacggtaaccgtaggaaccggtaaacgtagtaagacttaccgtacggaaccgaaccgaccggtacctttaattaacgttagttaggtacgacgtagaacgtaactaaactttacccgtaaccttaactacgttaaacgttaccgaacggttagtacggtaaacgttcgtacttttttacg

SEQ ID NO: 290615 - DNA, 590 bp, Homo sapiens
  misc_feature: GYAE6OF02I22GG.38.25.C03.1.454.CMB.1.raw
  modified_base (346)..(346): a, c, t, g, unknown or other
  misc_feature (346)..(346): n is a, c, g, or t
  modified_base (462)..(462): a, c, t, g, unknown or other
  misc_feature (462)..(462): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcgagtgaacgtctcctgcaaggcttcgtggttactacttttagctagttatggtgtcagtctgggtgcgacgacggccccctggacgaaggggtcttggaggtggagtggggatggatcgagcacttanaagtaggaaacacaaagtatgaccaactaattaactttaccgaagggtacaaggtagtacatacatacgaccaacgagacaacataccgaacagacactcacctacagtaggaacngaacgaactgacatcgtacgacgacgacgtacttattattatagtcgacgagaacgtaactaactttccctaccttaacgtacttaacgttacgacgtaacggtaggtaacgttagttacttttaacg

SEQ ID NO: 290616 - DNA, 531 bp, Homo sapiens
  misc_feature: GYAE6OF02GODHI.38.25.C03.1.454.CMB.1.raw
  modified_base (404)..(404): a, c, t, g, unknown or other
  misc_feature (404)..(404): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacacggcccctggacaagggcttgagtggatgggatggatcgagcacttacaataggaaacacaaagtatgacactataactttcgaggcagagtcatcatcgacacagacacataccacgancactcgacctacagtagaactgacgaacctgagatcgtagacgacacggtcttatattattgtcgagagacgactaaacttcctacttaacattagttacgacgtagtaggtaagttgtactttacg

SEQ ID NO: 290617 - DNA, 575 bp, Homo sapiens
  misc_feature: GYAE6OF02IM2Z0.38.25.C03.1.454.CMB.1.raw
  modified_base (354)..(354): a, c, t, g, unknown or other
  misc_feature (354)..(354): n is a, c, g, or t
  modified_base (434)..(434): a, c, t, g, unknown or other
  misc_feature (434)..(434): n is a, c, g, or t
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagcgtgggtgcgacgacggcccctggacaagggtcttgagtggagtggggatggatcgagcacttaacaagtacggaaacanaaagtatgacataataattcgaggcaagagtcaatcatacgaccaacagacactactaccaacgacgacactcgacctanagtacggaacagaacgacctagacgtatcagacgacgaccggtacttaattaacttagttgtagacgtagaactaacgtaaacttacctaccttaactaacttaacgttacggaacgtagtaggtaattcgttattttacg

SEQ ID NO: 290618 - DNA, 686 bp, Homo sapiens
  misc_feature: GYAE6OF02IWAJG.38.25.C03.1.454.CMB.1.raw
  modified_base (271)..(271): a, c, t, g, unknown or other
  misc_feature (271)..(271): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgagaggcctgggcctcgagtgaacgtctcctgacaaggcttcgtggttactacttttagctagttatggtntcgagcgtgggtgcgtacgacggtcccctggacgtaagggcttaggaggtggagtgggatggatcgagctacgttacaagtaggaaacaacgtaaagtacgtagaccaaactaagttaacgtttaccggagggacgaaggtacgtacagtacgagtacgtaaccagaacgaacctacaactacccgaaggtacgactaccgtagaccctagaacgttaggtaactacggacggtaactaggtacgtatacggtacgaaccgtaccgtacggttacctttaacgttagtttacgtttaggacgtaacggtaacggaacggttaaaccttaacgttacccgttaacgttaaaccctaagttaaccgttaaccggtacgggtaaccttaaggggtactttacggtacctttttaacgg

SEQ ID NO: 290619 - DNA, 533 bp, Homo sapiens
  misc_feature: GYAE6OF02GOFOD.38.25.C03.1.454.CMB.1.raw
  modified_base (403)..(403): a, c, t, g, unknown or other
  misc_feature (403)..(403): n is a, c, g, or t
  modified_base (408)..(408): a, c, t, g, unknown or other
  misc_feature (408)..(408): n is a, c, g, or t
  modified_base (476)..(476): a, c, t, g, unknown or other
  misc_feature (476)..(476): n is a, c, g, or t
  modified_base (500)..(500): a, c, t, g, unknown or other
  misc_feature (500)..(500): n is a, c, g, or t
  modified_base (527)..(527): a, c, t, g, unknown or other
  misc_feature (527)..(527): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttcgtggttacacttttaggcagttatggtgtcagctgggtgcgacaggcccctggacaagggcttgagtggatgggatggatcagcacttacaagtaggaaacacaaagtatcgacactataacttccgaggcagatacatcatcacacacgacacatcacgnctacncgacctacagtaggaactcggagaaccgtagagtactcggacgacgacacggtacttagtattattgngacgagacactaacttcctactanattagtacgagtagtaggtagttagtntttacg

SEQ ID NO: 290620 - DNA, 565 bp, Homo sapiens
  misc_feature: GYAE6OF02FMYG3.38.25.C03.1.454.CMB.1.raw
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttggagtggatgggatggatcgagcacttacaatggaaacacaaagtatgacacataatttccagggcagagtcatcatgaccacagacacatcccaacgagccactcgacctacatagaactgacgaacctgagactactagacgaaccgacggtacctttaatacgtttattggtagtacggagaagaccgtaaatttcccttaccgttaacattaacgttaaccggacgtaacgttagggtaacgttagtacttttaacg

SEQ ID NO: 290621 - DNA, 732 bp, Homo sapiens
  misc_feature: GYAE6OF02H0VR2.38.25.C03.1.454.CMB.1.raw
  modified_base (278)..(278): a, c, t, g, unknown or other
  misc_feature (278)..(278): n is a, c, g, or t
  modified_base (383)..(383): a, c, t, g, unknown or other
  misc_feature (383)..(383): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcattcctttttcttggtggcagcagcaacaggtgcccactcccaggttcaattggtgcagtctggagctgcggtgaagaggccgtggggcctcagtgaacgtctccgtgcaaggtcttcgtggttactacgttttagctagttagtggtntcagcgtgggtgcgacacggcccctggacgaagggcttaggagtggagtgggagtggatcgagccgtaactttaacgaagtacggaaaactaacgaaaaggttanagaccgtaataaatttaaccgtttaccggaagggactaaggtacgtactagtacgtaatacgggaaccctaagaacgaccaactaacctacccgaacggaccgacctacgtaccgacttaacgaagttaaccggaaacgacgggtaaacggtaaacccgttggaaagtaccgttaccggtaaggtaacccggaaacccgttaccgggttaaccttttaaagtttaaccgtttaagtttacggtacgggacaacgggttaacaaaccggtttaaaccttttcccgttaacttaaccgttaagttaaccgttacgtaaccggtagtacgggtaattcgttaacttttaacg

SEQ ID NO: 290622 - DNA, 644 bp, Homo sapiens
  misc_feature: GYAE6OF02F7XAG.38.25.C03.1.454.CMB.1.raw
  modified_base (357)..(357): a, c, t, g, unknown or other
  misc_feature (357)..(357): n is a, c, g, or t
tcagtcgatcacgtcacgaccggtgctcgatttagtagtgtagatttgggtttggggacccaaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggctggggcctcagtgaacgtctcctgcaaggcttctggttacacttttagcagttatggtgtcagctgggtgcgacgacggcccctggacgaagggtcttggaggtgggagtgggagtaggatcgagctacttaacaagtaggaaacaanaaagtatagacaactaattaacgtttaccgacgggtacaaggtagtacaatacgtatacgaacccaacgaacggaccaacgaactacccgaacgaacgaccaactcgacctaacagttacggaaactcggaacgaaccgtagacgtaagtcgtacggaacccgacgtaaccggtacctttaataacgtttagtggttacgacggtagaacgtaacttaaacttacccttacctttacaacgttacgtacgtaacggtaacgtaaggtaacgttacgtacttttaacg

SEQ ID NO: 290623 - DNA, 662 bp, Homo sapiens
  misc_feature: GYAE6OF02H3R8F.38.25.C03.1.454.CMB.1.raw
tcagtcgatcacgtcacgaccggtgctcgatttagtagtgtagatttgggtttggggacccaaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacacggcccctggacgaagggtcttggagtggatggggatggatcgagctaacttaacgaatacggaaaacacgtaaaagtatacgacaactaattaactttccgaagggcagagtcatacatcgaaccacgagacaactactacccacgtaacgcctacctcgtaccctaacgtagtacggtaaaccttcgggaaaccggtaaacccgtagaacggtactaccgtacgaacccgaccgtaccggttacctttaaagttacgttagttaggtacgaccgtaggtaaccgtaaccttaaacgtttccccttacttaacctaacgtttacgttaaccggtaacggtaagttacgggtaacgttcgtttactttttaaccgg

SEQ ID NO: 290624 - DNA, 802 bp, Homo sapiens
  misc_feature: GYAE6OF02HYUU1.38.25.C03.1.454.CMB.1.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcgagtgaacgtctcctgcaaggcttcgtggttactacttttagctagttatggtgtcagtcgtgggtgcgacgacggccccgtaggacgaagggtcgttggagtgggtagtggggagtggatcgacggtctacttaagaagtaggaaaacctaacgtaaaaggttatacgaccgtaactaacttaaacgtttccgaagggtacgtaaacggtacgttaacgaagttacctaacgttaccgaacccgtaaaccaacgtaaccaacgtacctaaccccgtaacggaacgtacctaaccgttaccgacccgttaaaccgacgttaacgggtaacgttacggaaaccggtaaacccgtagaacggttaacgttaccgttacggaaacccggtaacccggtaacccgggttaaccttttaaagtttaacgtttaacgtttacgggttaacggtaaccggtaggtaaaccggttaaccgttaaaacccgttttcccctttaacccgtttaaacgtaaacgttttaaaccgttaacggtaaccgggttaaaccgtttaaggggttaacgtttacgtttaaccgtttttaccg

SEQ ID NO: 290625 - DNA, 623 bp, Homo sapiens
  misc_feature: GYAE6OF02FV0XI.38.25.C03.1.454.CMB.1.raw
  modified_base (428)..(428): a, c, t, g, unknown or other
  misc_feature (428)..(428): n is a, c, g, or t
tcagtcgatcacgtcacgaccggtgctcgatttagtagtgtagatttgggttttgggggacccaaaaaccacacccctccttgggagaatcccctagatcacagctcctcaccatggactggacctggagcatccttttcttggtggcagcagcaacaggtgcccactcccaggttccaatttcggtgcagtctggagctgcggtgaagaggcctggggcctcagtgaacgtcgtcctgcaaggcttctggttacacttttagctagttatggtgtcagctgggtgcgacaggcccctggacaaggggcttggagtggatgggatggatcgagctacttacaatggaaacacgaaacgtatacgctacgaattaactttcgagggtcagtatcgatcatcgaccaacagaacactactaccaacggancactcgacctacatcggaactgacgaaaccgtggaacgatcgagaaccgacgtaaccggtactttaacgttaatttacgttaggttggacgtagggaacgtaaccgtaaaacttttaccccggttacctttaacgtaacttaacgtttaaccgaacggttacgttaaggggaacttaccggttactttttaaacg

SEQ ID NO: 290626 - DNA, 715 bp, Homo sapiens
  misc_feature: GYAE6OF02H5EXC.38.25.C03.1.454.CMB.1.raw
  modified_base (290)..(290): a, c, t, g, unknown or other
  misc_feature (290)..(290): n is a, c, g, or t
  modified_base (323)..(323): a, c, t, g, unknown or other
  misc_feature (323)..(323): n is a, c, g, or t
  modified_base (354)..(354): a, c, t, g, unknown or other
  misc_feature (354)..(354): n is a, c, g, or t
  modified_base (362)..(362): a, c, t, g, unknown or other
  misc_feature (362)..(362): n is a, c, g, or t
  modified_base (395)..(395): a, c, t, g, unknown or other
  misc_feature (395)..(395): n is a, c, g, or t
  modified_base (405)..(405): a, c, t, g, unknown or other
  misc_feature (405)..(405): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctctgcaaggcttcgtggttactacttttagctaggttatggtgtcagtcgtgggtgcgacncggccctaggacgaaggcttgagtggatggganggatcgagctaagttacaagtcggaaactanaaaagttnacgcaactataattccaggtacagacgtactancagtgaccanaacgacaactactacgacgaaggtactacgtacggtacctaacgtaacgtacgggtaaactagggtaaccggaaacgttacggaaaccgtaagtacccgttacggaacccgaaaccgttaaaccgggtaacccttttaaaggtttaacctttaaagtttaacgggttacgttaaccgggtaagtaaacgggtaaaccgttaaaaaacttttcccggttaaccctttaaaccgttaaacgtttaaaccgtttaacggaaacccggttagttaaaccggggttaaagttacggtttaacgttttttaaccgg

SEQ ID NO: 290627 - DNA, 699 bp, Homo sapiens
  misc_feature: GYAE6OF02H6QQP.38.25.C03.1.454.CMB.1.raw
  modified_base (299)..(299): a, c, t, g, unknown or other
  misc_feature (299)..(299): n is a, c, g, or t
  modified_base (372)..(372): a, c, t, g, unknown or other
  misc_feature (372)..(372): n is a, c, g, or t
tcagtcgatcacgtcacgaccggtgctcgatttagtagtgtagatttgggtttggggaccctaaaaacctacacccctccgttgggagaatcccctagatcacagctcctcaccatggactggacctggagcatccttttcttggtggcagcagcaaacaggtgcccactcccaggttcaattggtgcagtctggagctgcggtgaagaggcctgggggcctcgagtgaacgtctcctgcgaaggtcttcgtggttaactactttttagcaggtttatggtgtacagtcgtggagcganacggccctggacgaaggcttgagtgagtggactggatcagactattaacaagtacggaaacaacaaaggttanacgacaatattaacttacgaggacagatacatacgatacgacataagacacactacaagacgactacgtacgaccttaagaacgtacggtaaacgtaggaaacccggtaaactaggaaacgtagtaaccggtaacgaaacccgtaaacccgaaccgtttaacccttttaaagtttaaacgttaaggtttacggtaaccggaacggtaaggtaaacgttaaacccgttaaacccgttttaccccgtttaaaccggtaaacttaaaccgtttaaggttaaaccggacgtttaaagggtaacgggttaacgtttaccgtttactttaacg

SEQ ID NO: 290628 - DNA, 647 bp, Homo sapiens
  misc_feature: GYAE6OF02F5J68.38.25.C03.1.454.CMB.1.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcgaaggcttctggttactacttttagctagttatggtgtcagctgggtgcgacacggcccctggacaagggtcttggaggtggagtgggagtggatcgagcgacttacaagtaggaaaacacgtaaagtatcgacactaattaacgtttaccgaagggcaggtagtactatactatacgaacacgagaacacactacccgacgacgacctacgtaccgtacctaacgacgttacggaacgtacggaacgggtaacctaggaacgtataccgtaggaaccgaaccgtaccggttacctttaattacgtttaagttggtacggacgacgtaacgtaaccgttaacgtttcccttaaccttaacgttagttaaccgttaacgtacgtaaggttacggtaagttcgttatttttaccg

SEQ ID NO: 290629 - DNA, 714 bp, Homo sapiens
  misc_feature: GYAE6OF02H552C.38.25.C03.1.454.CMB.1.raw
  modified_base (275)..(275): a, c, t, g, unknown or other
  misc_feature (275)..(275): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcattcctttttcttggtggcagcagcaacaggtgcccactcccaaggttcaattggtgcagtctgggagctgcggtgaagaggcctggggcctcagtgacgtctcctgcaggtcttcgtggttacacttttagctagttagtgggtntcgagtcgttgggtgcgacgacggccccgtgggacgaaggggtcttggaggttggagtgggattgggatcgagctaacttacgaagtcggaaaactaagaaagtagtgactactaattaacgtttaccgaaggtcgagagtacactcagtcgaaccctaacaacggtaccaacgtaacctaccgaaacggacgactaaccgtcgacccgtacgagttacggaaccgtaggtaacggaacccgtaggaacggtacttaccgtaccggtaaccggaaccggtaccggttaccgttttaaattacgtttaacgttagtacgggtacgtacggaaacgtttaaccgtaaacgtttccccctttaacgttaaaccgttaagtttaaccgtttaacgggtaaccgtaaggttaacggtaacgggtttcgtttacctttttaacgg

SEQ ID NO: 290630 - DNA, 605 bp, Homo sapiens
  misc_feature: GYAE6OF02HA608.38.25.C03.1.454.CMB.1.raw
  modified_base (478)..(478): a, c, t, g, unknown or other
  misc_feature (478)..(478): n is a, c, g, or t
  modified_base (543)..(543): a, c, t, g, unknown or other
  misc_feature (543)..(543): n is a, c, g, or t
tcagtcgatcacgtcacgaccggtgctcgatttagtagtgtagatttgggtttggggacccaaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttcgtggttacactttttagctagttagtggtgttcagcgtggggtcgcgacgacggccccgtggacgaagggcttggagtggagtgggatgggatcagctacttacgaagtaggtaaacacgtaaagtatgactaactaataactttacgagggtacaggacgtacatactatcgaacctactaacgaccactaactacccgaacgacacacgtcaccctacaagtacggtaaaccnggaacgtacctgacgtatagtcgaacgaccgaccggttacttaattagttactgtacgagagaanacgttaaacttccttaactaagtacttagtaacgacgtagtacggtaagttcgttatttacg

SEQ ID NO: 290631 - DNA, 808 bp, Homo sapiens
  misc_feature: GYAE6OF02JB0RU.38.25.C03.1.454.CMB.1.raw
  modified_base (205)..(205): a, c, t, g, unknown or other
  misc_feature (205)..(205): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagnggcctggggcctcagtgaacgtctcctgcaaggtccttcgtggttactacttttagctaggttatggtgtcgagtcgtgggtgacgacacggcccccgtgggaacgaacggggtcttggacggtaggacgtggggattgggagttacgagtactaccgttaacgaacgtaggaaaactaacgtaaaaggtatacgcaactaagttaacgtttaccgaagggtacgaagtacggttactaacgtaccgtaagttccggtaacccaacggtaacgtaaaccctaaccgaaacgttaccccgaaacgggtaccgtaaccgtaccttacccgggtacccttaaaccgtaacggttaaccgggaaaccgttaacggggtaaaccgggtaaacccgttagggaaaccggttacttaaccgggtaaccggtaaccggtaaacccggtaaccggttacccgttttaacgttaaacgttttaacggtttaacgtagggttacccgaagttaaccggtaaacttaaccgttttacccttaacccgtttaactaaccgtttaacgtaaccggtaacggttacgttaacgggacgttttacgtcgtttttaacgg

SEQ ID NO: 290632 - DNA, 498 bp, Homo sapiens
  misc_feature: GYAE6OF02HW8AX.38.25.C03.1.454.CMB.1.raw
  modified_base (470)..(498): a, c, t, g, unknown or other
  misc_feature (470)..(498): n is a, c, g, or t
tcagtcgatcacgtcacgaccggtgctcgatttagtagtgtagatttgggtttgggtgtgtctgtggtcatgatgactctgccctggaaattatgcacataatttccagggcagagtcatcatgaccacagacacatccacgagcactgcctacatggaactgagaacctgagatctgacgacacggccttatattattgtgcgagagacaaattcctccttacattatacgacgatggaatgcttatttcttgactcctggggcccagggaccctgactcaccgtctccctccggcctccaccaagggcccctactcggttcccttccccctggcctaccctcctccaaagcgtccaccgtcgtcggggacacgacggccgacccgtgggctcgccgttcgggtacaaggtacctacgttcccacgtgacgtcgacgtggacgcgggactcggcaacggcctacatagnnnnnnnnnnnnnnnnnnnnnnnnnnnnn

SEQ ID NO: 290633 - DNA, 667 bp, Homo sapiens
  misc_feature: GYAE6OF02I05EE.38.25.C03.1.454.CMB.1.raw
tcagtcgatcacgtcacgaccggtgctcgatttagtagtgtagatttgggtttggggacccaaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgacgtctcctgcaaggcttctggttacacttttagctagttatggtgtcagtctgggtgcgacgacggcccccgtggacgaagggcttggaggtgggagtggggatgggactcgagacctacttaacgaagtaggaaaaccaagtaaaagtatagaccaactaattaacttccgagggtacaggtacgtctatacaagtcgaaccacaacgacactacctacccgaacgacgtaccaacgtcgaccctacgaagtacggtaacttagggaacggtaccgtaggaacgtacgtaccgtacggaccgaccgtaccggtacctttaagttattacgttagtacggacgacgtaacgtaaccgtaactttacccgtaaccttaacgtaacgtttaacgttaaccggtaccggtaagttaacgggtaacgttacggttactttttaacgg

SEQ ID NO: 290634 - DNA, 630 bp, Homo sapiens
  misc_feature: GYAE6OF02FJQZA.38.25.C03.1.454.CMB.1.raw
  modified_base (368)..(368): a, c, t, g, unknown or other
  misc_feature (368)..(368): n is a, c, g, or t
tcagtcgatcacgtcacgaccggtgctcgatttagtagtgtagatttgggtttggggacccaaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactactttttagctagttagtggtgtcagtcgtgggtgcgacacggcccccgtggacaagggcttggaggtggagtggggatgggatcgagcaacttacaagtaggaaacacgaaaagtntagactacaattaactttccgagggtacaaggtacgtactatacagtacgaacccaatacgaacaactacacccgtaacgagaccaacgtcgacctacagttacggacctaggacggtaacctagacgtagtacgtgaaccgtaccgacggtacctttaataatttagttgagacgtagacgtaacttaacgtaccctttaccttaactacgttagttaaccgacggttaacgtacggtaacgtttcgtacgtttttaaccg

SEQ ID NO: 290635 - DNA, 809 bp, Homo sapiens
  misc_feature: GYAE6OF02IXL77.38.25.C03.1.454.CMB.1.raw
  modified_base (218)..(218): a, c, t, g, unknown or other
  misc_feature (218)..(218): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctnagtgaacgtctcctgacaaggcttcgtggttactacttttagctagttatggtgtcgagctgggtgcgacacggcccctggacgaaggcttagagtggatgggatggatcgagtactacgttaacaagtaggaaaactaagaaaacgttatacgacaactaattaaacgtttaccgaaggggctaaggtaacgtacgtaattaccgaaagttaccggaacctaacgaacgaacctaaccaacgtacccgaaacgaacgacctaacgtacgaacccgtaaactaacggtaacggaaaccttagggaaaccggtaaaccgtaacggaacgttaaccgttaaccggtaaaacccggtaacccgtaaccgggtttaacccttttaaagttaaacgttttaacggttacggttaaccgggaaccgggttaaacgttaacccgggtaaaaccttaaaaacccggtttttcccccttaaaccgttttaaacccgtaaagttttaaacccgtttaaacccgggtaaaaggtttaaccggttaaacggggttaaacgttttaaccggttaaccgttttttaacccggttttttaacccgg

SEQ ID NO: 290636 - DNA, 669 bp, Homo sapiens
  misc_feature: GYAE6OF02JQMQG.38.25.C03.1.454.CMB.1.raw
  modified_base (229)..(229): a, c, t, g, unknown or other
  misc_feature (229)..(229): n is a, c, g, or t
  modified_base (274)..(274): a, c, t, g, unknown or other
  misc_feature (274)..(274): n is a, c, g, or t
  modified_base (289)..(289): a, c, t, g, unknown or other
  misc_feature (289)..(289): n is a, c, g, or t
  modified_base (328)..(328): a, c, t, g, unknown or other
  misc_feature (328)..(328): n is a, c, g, or t
tcagtcgatcacgtcacgaccggtgctcgatttagtagtgtagatttgggtttggggacccaaaaaccacacccctccttgggagaatccctagatcacagctcctcaccatggactggacctggagcatccttttcttggtggcagcagcaacaggtgcccactcccaggttcaattggtgcagtctggagctgcggtgaagaggcctggggcctcgagtgaacgtcnctgacaaggcttctggttactacttttcgctagttactggtgtcngcgtgggtagcgacncggccctggacagggtctggagtggacgtgggactgggntaccgagtctaacgttacgaagttacgggaaacagtaaaaagttcgaacggtacaataacgttaactttccgaacgggtacacggtacgtcctaagtacccagttacgaaccacgaagtacctaacgtaccacgaaccgacggacctacgtacgacctacgtaacgttacggaagtacgaacgtaaccgtaggagtacgtaccgtagaacgtacgtaccggtaacctttatacgttacgttagacgtacgtaacgtaaccggactaaaacccgtttccgttaaccttaataccgttaataccggtaactaggttaaccggaaggttcttaacttttaccgg

SEQ ID NO: 290637 - DNA, 757 bp, Homo sapiens
  misc_feature: GYAE6OF02I440G.38.25.C03.1.454.CMB.1.raw
  modified_base (471)..(471): a, c, t, g, unknown or other
  misc_feature (471)..(471): n is a, c, g, or t
  modified_base (516)..(516): a, c, t, g, unknown or other
  misc_feature (516)..(516): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatccttttctggtggcagcagcaacaggtccgaccacctccgtagtactaagttcggtcacgtcgttcgaggacgtcgcggtcggtagaaacgggccggtcggggtccggtcccgtacgtaggtaggacccgttcctccgtgaccgtaacgtcctttacgttacggtaccttttacgttacgacgtaggtttacgttggtcgtacgtacgcggttgggcgacgaccggtaccggtcccgacgggacggtaacgggtcgtagggacggtgggtaaagtgggaggtggtaccgtagacgtacctaacgttaaacgagtaaacgggaaactaaacgtaacgtaanacgtacctaataaacgtattaccggacggacgtagactaccgtanaacgacgtaacgaccaacgtaacgacacgtaactacggtaaaccagaaccttcgacgtaccgtaacctaaggtaaggaacccttaggaaccgaaccggtacacggtaactaccgtacggaccgtacgttaaccggtaaccgttattaaacgttcgacggttagacggtataacgtaaccgttaaatcccgttaaactacttacgaagttacgacgaagtacgtaacggttcgtatttaacg

SEQ ID NO: 290638 - DNA, 822 bp, Homo sapiens
  misc_feature: GYAE6OF02HJVTP.38.25.C03.1.454.CMB.1.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacggtctcctgcaaggtcttcgtaggttactacgttttagctagttatggtgtcagtcgtgggtcgcgacgacggccccgtaggacgaagggtcttaggaggtggactgggatggactcgagctaacttacaagtacggaaactaacgaaagtagtacgacaacgtaattaacgtttccgaagggtacacggtaacgtacgtaagtaccgtaacgttaccggaccaaacgtacgaaacctaaccgttaaccgtaccccgaaaccggtaactacccgtaaccgttaccgtaacccgttaaccgtaacggttaaccgggaaaccggttaacgggaaaccgggttaacccgtaaggtaaccggtaacgttaccgggtaaacggaaaccccgggtaaccgaaaccgggttttacccgtttaaagtttaaccgttttaacgttacggggtacgtaacccgggagttaaacccggttaaccttaaacccggttttaccccgttaacgttttaaaccgtaaccggttttaaaccggtttaaccggtaacggttaaccgggttaccggggtttaaaccggtttcgttttaacccttttttaacccgg

SEQ ID NO: 290639 - DNA, 647 bp, Homo sapiens
  misc_feature: GYAE6OF02JVAGZ.38.25.C03.1.454.CMB.1.raw
  modified_base (223)..(223): a, c, t, g, unknown or other
  misc_feature (223)..(223): n is a, c, g, or t
  modified_base (234)..(234): a, c, t, g, unknown or other
  misc_feature (234)..(234): n is a, c, g, or t
  modified_base (371)..(371): a, c, t, g, unknown or other
  misc_feature (371)..(371): n is a, c, g, or t
  modified_base (378)..(378): a, c, t, g, unknown or other
  misc_feature (378)..(378): n is a, c, g, or t
tcagtcgatcacgtcacgaccggtgctcgatttagtagtgtagatttgggtttggggtacccgaaaaaccgaacacccctcccttgggagaatccctagatcacagctcctcaccatggactggacctggagcatccttttcttggtggcagcagcaacaggtgcccactcccaggttcaattcggtgcagtctggagctgcggtgaagaggctggggcctcnggtgaacgtcnccgtgcaggcttcgtggttactacttttagctagttagtggtgtctagcgttgggtcgcgacgacggcccctggactaaggggcttaggaggtggagtgggactggatcgagcagttacgaatagaacacaaaagtntagccanatacgttacagggtacaggtatacgtataccgaagtcgaacctaacgagaaccaataacgcccgaaacgacggacctacgtacgacctaaaccgtacgtaggaacccttagggaaccgaaaccgtagtacgtaacgtcgtaccgaacgtaccgtacccggtaacgtttacgtaaagttcttaagggtcaggttacgaggtaccaaaccgttttcccaacgttactaagtaccgtaacgtagtattaaggggactttagacgttttaacg

SEQ ID NO: 290640 - DNA, 581 bp, Homo sapiens
  misc_feature: GYAE6OF02I55CV.38.25.C03.1.454.CMB.1.raw
  modified_base (352)..(352): a, c, t, g, unknown or other
  misc_feature (352)..(352): n is a, c, g, or t
  modified_base (510)..(510): a, c, t, g, unknown or other
  misc_feature (510)..(510): n is a, c, g, or t
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggagtgggatggatcgagcacttacaatggaaacacaaaagtanagcacataatttaccgagggacagagtcgaatcatacgacctacgaagaacacaatacccgaacgtagacactcgtaccgtactagtacgggaacttggaacggtaactagacgattacgtagaccgacacggtaccttaagtatttatgtacgcganacgtactaaacgtttccctacgtttaacaattaccgttaagtactaggtacgaacggttagtattttaacg

SEQ ID NO: 290641 - DNA, 702 bp, Homo sapiens
  misc_feature: GYAE6OF02HHNHL.38.25.C03.1.454.CMB.1.raw
  modified_base (205)..(205): a, c, t, g, unknown or other
  misc_feature (205)..(205): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagnggccgtggggcctcaggtgaacgtcctcctgcaaggtcttcgtggttactacttttagctagttatggtgtcagcgtgggtgcgacgacggccccgtaggacgaagggtcgttaggaggtgggagtggggtagtggatacgacgctaacgttacgaagtaacggaaacgaacgtaaagtactacggacaagtaattaaacgtttaccgaagggtacagtacgtacaactcgaagtaccgaccgaaccgaacgacctaacgtaactacccgaacggaacgacgtacctacgtaaccctaacgtaacgtaggtaaccgaaggaaaccggtaacgtacggaatacgtacgtacgaacggtaccgtaaccggttacctttaaagttaacgttaacgttggtacgtacggaacgtaagtaaccgttaacttacccttaacgttaacttaacgttaacgttaccgaaggtaaccgttagggtacttacgttacgttttaaccg

SEQ ID NO: 290642 - DNA, 569 bp, Homo sapiens
  misc_feature: GYAE6OF02FI9IZ.38.25.C03.1.454.CMB.1.raw
  modified_base (349)..(349): a, c, t, g, unknown or other
  misc_feature (349)..(349): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttggagtggatgggatggatcagcacttacaatggaaacacaaagtangacactataatttccgaggcagagtcatcatgaccacagacacactccacgagacactcgcctacattacgaacgtggaacggaacctaggaagacgtctacggaccgacgtaccggtactttaatactttattgtacgacgtagaacgtaacgtaaactttcccttacctttaacaatttaagtacccgacgtacgtagggtaagttcgtattttaacg

SEQ ID NO: 290643 - DNA, 675 bp, Homo sapiens
  misc_feature: GYAE6OF02IHOUD.38.25.C03.1.454.CMB.1.raw
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtcgcccactcccaggttcaattggtgcagtctggagctgcggtgaagaggcctggggcctcagtgaacgtctcctgcaaggcttctggttacacttttagctagttatggtgtcagctgggtgcgacaggcccctggacaagggcttggagtggagtggggatggatcgaggctaacttaacaagtacggaaaacaacgaaaagtatagacaactaattaactttaccgaagggtacaaggtagtacactacgaactacgaccaacagtaaccaacactacccgaacgacgaccacgtcgaccctaacacgtacggaactacggaacggtaacccgtaggaacgacttaccggtacgaaccgtaaccgtaaccggttacctttaaagttaacgtttagttaggtacgtaccggtaagtacgtaaaccgtaaactttaccccgttaacctttaacgtaactttaacgtttaaccggtaacgtaaggttaagggtaacggttacggtactttttaacg

SEQ ID NO: 290644 - DNA, 840 bp, Homo sapiens
  misc_feature: GYAE6OF02HR49W.38.25.C03.1.454.CMB.1.raw
tcagtcgatcacgtcacgaccggtgctcgatttagtagtgtagatttgggtttggggacccaaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcgagtgaacgtctctgcaaggtcttctcggttactacttttagctagttatggtgtcagtcgtgggtgcgacgcggcccctaggacgaagggtcttggagtggagtgggatggatcgagctaacgttacaagtacggaaaacacgtaaaagtagtacgacctaactaaacgttaaacgtttacccggaaagggtaccgtaacggtacgttaacctaacgttactaacgttacggaaccccgtaacgaacgggaacctaaccgtaaccgtacccgaaccggaacgtaccgtaaccgttacggaaccccttaacgtaacggttaaccgggtaaaccgttaacgggaaaccgggtaaaccgttacgggaaacggtacgttaacccgggtaacgggaaaccccggtaacccggttaacccgggtaaccttttaaaccgtttaacgttttaacggtttacggggttaacggtaaccgggtaaacggtaaccggtaaacccgtttaaaaccgttttacccccgtttaacccgtttaaaccgttaacgtttaaaccggtttaaccggtaacggttaacgggtttaacggggtaaaaccggtttttcgggttaaccctttttttaaccgg

SEQ ID NO: 290645 - DNA, 719 bp, Homo sapiens
  misc_feature: GYAE6OF02JHQDB.38.25.C03.1.454.CMB.1.raw
  modified_base (695)..(695): a, c, t, g, unknown or other
  misc_feature (695)..(695): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagagcctgggcctcagtgacgtctcctgcaggctctggtacacttttagcagttactggtgtcgagcgtgggtgcgacacggtcccctaggacaagggtcttggaggtgggtacgtggggtaatgggtaacttcgacgggtactaacgtttaaccgtaaagttacgggtaaaaccgtaaccgtaaaaggttacgtacggtaccgaaaccttaaacgtttaaaccgttttaccggaaacggggtacctaagggtaaaccgttaccgtaaacggttcctaaacgtaccgggtaaccctaaacgtaccgggaaaccctaaccgtaacggtaccccaacgggtaaacgtcctaaccggttacgacccgttaacgagtaccgtaacgtacggtaacggacctagtacgactacgtacgaacggctaccgtacttaatacttagtaggtcgagacgtagaacctaacttcctaccgttaaatcttaagtacgaacgtanacgggttaactcttacgtttaacg

SEQ ID NO: 290646 - DNA, 850 bp, Homo sapiens
  misc_feature: GYAE6OF02IMD4J.38.25.C03.1.454.CMB.1.raw
tcagtcgatcacgtcacgaccggtgctcgatttagtagtgtagatttgggtttgggggacccaaaaaccacacccctccttgggagaatcccctagatcacagctcctcaccatggactggacctggagcattccttttcttggtggcagcagcaacaggtgcccactcccaggttcaattggtgcagtctggagctggcggtgaagacggccgtggggcctcgaggtgaacgtctccgtgcgagggtcttacgtacggttaactactttttagacgtagtttacgtggtcgtcagtccgtgggtcgcgacgacggtccccttggaacgtaaggggtcttaggagttcgggtacgttagggggtatacgggtacttaccgacgaccgtaacctttaaacgaaagttacgggaaaaaccaacgttaaaaggtaagtcggtacctaacgtaaagttaacgttttaccggaacgggtacaaagggttagtacctaaagttcctaacgtaccgaacctaacgaagaaccaactaccgtaccgaacggactaaccgaccgttacgtacccttaacgtaacggttaacgttaaacgtacgggttaaacggtaacgtaccggaagttaacgttaccgtaacggtaaacccggtaccggttaaaccggttacccgttttaagtttaaacggttttacgttaacgggtacggttaacccggaaggttaaccggtaaaccttaaaaccgtttttcccccgttaaactttaaacccggtaaagttttaacccgttaaccggttaacggttaaaccggttaaggggttaacccgtttaccgttttaacgttttttaacccgg

SEQ ID NO: 290647 - DNA, 722 bp, Homo sapiens
  misc_feature: GYAE6OF02HQ3YJ.38.25.C03.1.454.CMB.1.raw
tcagtcgatcacgtcacgaccggtgctcgatttagtagtgtagatttgggtttggggacccgaaaaaccaacacccctccttgggagaatcccctagatcacagctcctcaccatggactggacctggagcatccttttcttggtggcagcagcaacaggtgcccactcccaggttcaattggtgcagtctggagctggcggtgaaggaggccgtggggcctcgaggtgaacgtctctgcaggcttcgtggtactacctttacaatagtggtatccaacgtgggtcgcgaacacggccctagggacaaggggtcttgaggtggagtgggatggatcgagcgtacttaagaaataataacacaactacgtatacgaactacgaacgtaacgttaccggagggtactaaggaccgttaccgaaccgtacgaacccgacggaaccaacctactacccgacgacgtaccgaacgacgtacctacgagtcgggtagttaggaaggtacggtacgtagaacgacgtgtaccgaaaccggaccgtaccgggtaccgttacggtttacgttaaccgtgggttacggacggtaacggtagttaaccggtaagtaacgtttagttttaacgggttaaggtacggtaaccggtttaaccggggacgggggtaacccggtaacggggtaaccccggtttacggggttaaccggtacccggttcccgttaaccgg

SEQ ID NO: 290648 - DNA, 788 bp, Homo sapiens
  misc_feature: GYAE6OF02IMC4E.38.25.C03.1.454.CMB.1.raw
tcagtcgatcacgtcacgaccggtgctcgatttagtagtgtagatttgggtttggggacccaaaaaccacacccctccttgggagaatcccctagatcacagctcctcaccatggactggacctggagcatccttttctggtggcagcagcaacaggtcgcccctactcccaggttacaattggtgcctagtctggacgctggcggtagaaggcggtccgtggggtccctagaggtcgaacgtctccgtgcgaaggtcttcgtacggttactacttttaggctaagtttacgtggttacgtcgacggtcgttgggtacgccggtacgaccggtcccgtaggacgacgggtcgttggaggttcggaagttgggattgggtaactcggtagaccgttaaccgttaacgaagttaaccgggaaaactaaacggtaaaacgttcggacgtaaccctaaaggttaacccgttaagtttcccggaacggggtaccaaggtaccgtaaactacgttacccgaaacggttaccgaacccggaactaaccgaccgaacgtaaccgttaccgaacggacgtacgacgtaccgtaccgtacgaacggtacgtaaacgtacgaaccgtacctaggaccgtaacgttaccggaacgtaacccggaccgttaccggttaaccgtttaataacgtttacgtacgggtaaccgtacgaacgtaaacgtaaccttaaacggttccctaacgttacgtaacgttacgtacggtacgtaacgtaccggtagttccgttagtttaccg

SEQ ID NO: 290649 - DNA, 690 bp, Homo sapiens
  misc_feature: GYAE6OF02JQHZW.38.25.C03.1.454.CMB.1.raw
  modified_base (279)..(279): a, c, t, g, unknown or other
  misc_feature (279)..(279): n is a, c, g, or t
  modified_base (313)..(313): a, c, t, g, unknown or other
  misc_feature (313)..(313): n is a, c, g, or t
  modified_base (570)..(570): a, c, t, g, unknown or other
  misc_feature (570)..(570): n is a, c, g, or t
tcagtcgatcacgtcacgaccggtgctcgatttagtagtgtagatttgggtttggggacccgaaaaaccgacacccctccttgggagaatcccctagatcacagctcctcaccatggactggacctggagcatccttttcttggtggcagcagcaacgaggtgccctactcccaggttcaattggtcgcagtcgtggagctgcggtgaacgcggccgtgggcctcacgtgacgtctccgtgacgaagcttcgtgtactacgtttagactagttctggtntcgagtcgttgggcgtacgaccgacggtccccgnggaacgtaacgggtcttgggacgtgggtagtaggggattacgggactccggagtactaacgttacgaagtaacgggaaaacctaacgtaaaagtctacgactaactaacgttaacgttaccgaagggtactaagtacgtactaataccgtaagtaccgaactaacgaacctaaccgtaactaccgaaccgaaccggtactaacctaaccgtccgtaacgtaaacgtcggtaggaaacccgtagtaaccgaacgttanacgtacagtaccgacgtaacgcgtaacttacgtaatcgtagacgtacgacgtactaaccgtacttaccgttagtaaccgtaagttaacgtacgtagtacgtaaggtactcgttattacgg

SEQ ID NO: 290650 - DNA, 851 bp, Homo sapiens
  misc_feature: GYAE6OF02F3Q82.38.25.C03.1.454.CMB.1.raw
  modified_base (174)..(174): a, c, t, g, unknown or other
  misc_feature (174)..(174): n is a, c, g, or t
  modified_base (251)..(251): a, c, t, g, unknown or other
  misc_feature (251)..(251): n is a, c, g, or t
  modified_base (268)..(268): a, c, t, g, unknown or other
  misc_feature (268)..(268): n is a, c, g, or t
tcagtcgatcacgtcacgaccggtgctcgatttagtagtgtagatttgggtttgggggtacccgaaaaaccacacccctccttgggagaatcccctagatcacagctcctcaccatggactggacctggagcattcctttcttggtggtcagcaggcaacaggtgcccactccnggttcaattggtgcagtctggagctgcggtgagaggctgggcctcagtgaacgtctcctgcaaggcttctggttacncgttttagctagttagnggtgtcagtcgtgggtgtcgacaggccccgttggacgtacgggcgtttacgagtacggtacgtggggtattaggacgttaccggaggtcgtaacttaacgtaacgttacggaaaaccgtacgtaaaaaacgggtttcaacgttagaaaccttaaggttaaacgtttttaaccccgggaagggacccggttaaacggaagggttttacccaaacggtttaccaaagtttaccgggtaaccctaaaccgtaaacgggaaccccgtaagtaaagttcccccaagggttaaacggccctttaaaccgtcgggaaccccttacggacgtttaaagggaaccccgtttaaggaaaccgggtaaaccctttcggggtaacaaacggtttacccgtacgggaaaccgggtaaacccgtaacccggggttacccgttttaaattaaccgtttttacgtttaacgggtacgggttaccgtagggtaacgttaaccggtaaaactttccccgggttaaccttaccgttaaaccggttattaacccgttaacggtaaccgtaggggtaacgtttacccgggtatttttaaccggg

SEQ ID NO: 290651 - DNA, 829 bp, Homo sapiens
  misc_feature: GYAE6OF02I8Z0I.38.25.C03.1.454.CMB.1.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtgcagcagcaacaggtgcccactcccaggttccaattggtgcagtcctggagctgcggtgaagaggcctggggcctcagtgaacgtctcctgcaacggtcttcgtacggttactacttttaggctagttactggtgtcgagcgtgggtcgcgacgacggtccccgtgggaacgtaacgggtcttaggacggtggacgtggggtatcgggtactcggacgtacctaaccgttaacgaaacgttcgggaaaaccacgtaaaacgtagtacggactaacgtaactttaacgttaccgaggggtactacgggtacttcgtaacgtaccgacgttacgacccgtaacgtaggtaaccctaaccggtacgtaaccccgtaacgggtaacgtaaccccgttaacggttcccggtaacccctttaaagggtaacccgttaacgggggttaaacccgtaccgggggttaaacgtaaaccccgggtttgggaaaccgttaccgggttaccggtttaacggggaaacccggttaacccgggtaacccggttaacccgttttaaagttaccggttttaacggtaccggtacggtacccgggtaagtaaccgtaaccgttaaccgtttaccccgtacgttaaacctagttaacgttacccggtaaggtaccgtaaggtacgggtttactcttttaaccgg

SEQ ID NO: 290652 - DNA, 642 bp, Homo sapiens
  misc_feature: GYAE6OF02GW59M.38.25.C03.1.454.CMB.1.raw
  modified_base (373)..(373): a, c, t, g, unknown or other
  misc_feature (373)..(373): n is a, c, g, or t
  modified_base (430)..(430): a, c, t, g, unknown or other
  misc_feature (430)..(430): n is a, c, g, or t
  modified_base (452)..(452): a, c, t, g, unknown or other
  misc_feature (452)..(452): n is a, c, g, or t
  modified_base (461)..(461): a, c, t, g, unknown or other
  misc_feature (461)..(461): n is a, c, g, or t
  modified_base (468)..(468): a, c, t, g, unknown or other
  misc_feature (468)..(468): n is a, c, g, or t
tcagtcgatcacgtcacgaccggtgctcgatttagtagtgtagatttgggtttggggacccaaaaaaccacacccctccttgggagaatcccctagatcacagctcctcaccatggactggacctggagcattccttttcttggtggcagcagcaacaggtcgcccactcccaggttcaattggtgcagtctggagctgcggtgagaggccgtgggcctcgagtgaacgtctctgcaaggtcttcgtaggttactacttttagctagttacgtggtcgttcagtcgtgggtcgcgacgtacggtccccgtaggaacgaagggtcttggaaggttcgggaagtggggtatcggtactcgagtacctaacgttanaaagttacggaaacacgtaaaatcgtacgacaacgtattaacttcggagacagactnaatctagacgacacgacacacntacgacganactacgngtaccagtagacgtaacaggaccgtaagtgaacgacttacgacgacgaccgacgtacctttaaggttacttacggttacgtcgaccggtagtaaccggtaaccttaacgttccttaactaaccttacgtaacgtacggtaactaaggttacgacgtttaggtaaccttttacgg

SEQ ID NO: 290653 - DNA, 659 bp, Homo sapiens
  misc_feature: GYAE6OF02H8ZF8.38.25.C03.1.454.CMB.1.raw
tcagtcgatcacgtcacgaccggtgctcgatttagtagtgtagatttgggtttggggacccaaaaaaccacacccctccttgggagaatcccctagatcacccccagctcctcaccatggactggacctggagcatccttttcttggtggcagcagcaacaggtgcccactcccaggttcaattggtgcagtctggagctgcggtgaagaggcctggggcctcagtgaacgtctcctgcaggcttctggttacacttttagctagttatggtgtcagcgtggggtgcgcgacggcccctggacaagggtcttgagtggagtggggatggatcaggctaacttacaagtaggaaacacgaaagtatgacaactattaattccgagggtacagtagtcatcatacgaacccacaacgaacctaaccactaccgaacggacaccaccgtacgtaccctaacgaacgttacggaacgtaggaacggtaacccgtagaacgtactacgtaacggaacccgtaaccgtaccggttaccctttaattaacgtttacgttaggtcggtaccgaaggtaccgtaaaccgttaactttaccccttaccgttaactaactttaccgttaacgtacggtaagttacgggtaagttaccgttatttttaacg

SEQ ID NO: 290654 - DNA, 731 bp, Homo sapiens
  misc_feature: GYAE6OF02IHJMP.38.25.C03.1.454.CMB.1.raw
  modified_base (309)..(309): a, c, t, g, unknown or other
  misc_feature (309)..(309): n is a, c, g, or t
tcagtcgatcacgtcacgaccggtgctcgatttagtagtgtagatttggggtttgggggacccaaaaaccacacccctccttgggagaatcccctagatcacagctcctcaccatggactggacctggagcatccttttcttggtggcagcagcaacaggtcgcccactcccaggttcaagttggtgcgagtctgggagtctggcggtagaaggagggccgtgggggcctcgaggtacgaacgttcctccgtgcgaaggtcttcgttggttactacgttttagctagttagtggtgtcaggcgtgggtncgacgacggcccgtggacgaggcttgaggtggaggtggagtggatcgacgtacgtaacttaacgaaggtacggaaactaacgtaaagtactgactaaactagttaacgttacgaggtacagtacgtactatacgtacgtacaccgaactacggaacctaacgaccgtaaccgacggacgtaccaacggtcccgtaacgtaacgtaacgggtaaacgtacggtaacggtaaaccggtaaccgttaagaccgtttacgtaccggtaaccggaacccggtaacgttaaccggtaacgtttagttaaactttacggtgtacgaacgggtacctaaagttaacccgtaacgttcccttacgttaaactaccggttaaggtaccgtaaggttaccggtaaggttaccgttcgttaacgtttttaccgg

SEQ ID NO: 290655 - DNA, 680 bp, Homo sapiens
  misc_feature: GYAE6OF02IIT5X.38.25.C03.1.454.CMB.1.raw
  modified_base (378)..(378): a, c, t, g, unknown or other
  misc_feature (378)..(378): n is a, c, g, or t
tcagtcgatcacgtcacgaccggtgctcgatttagtagtgtagatttgggtttgggggacccaaaaaaccacacccctccttgggagaatcccctagatcacagctcctcaccatggactggacctggagcatccttttcttggtggcagcagcaacaggtgcccactcccaggttcaagttggtgcagtctggagctgcggtgagaggccgtggggcctcaggtgacgtctcctgcaaggtcttcgtggttactacgttttagcgtagttagtggtgtcagtcgtggtgaccgacgacggccccgtgggaacgagggtcttggaggtggagtgggacgtggatcgagctaacgtacgaagtaggaaacagtaagtangtacaacgtattacgtcgaggcgagtacgtcgatacacgtacgaaccacgagaccaacacgtacccgaagtaacgacctacgtaccgtaaccctaacgtacgtaacggtaacgtacgggtaaaccgacctaggacgtactacggtaacggaccgtaaccgtacggttacccttaaagtttacgtttataaccgggttgtaccggaataccggttaaacgttaaccttttcccgttaaaccgttaaactacgttaacgttaaccggagtaacggttaggtaacggtttccttatttttaaccg

SEQ ID NO: 290656 - DNA, 724 bp, Homo sapiens
  misc_feature: GYAE6OF02ICFVV.38.25.C03.1.454.CMB.1.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggctggggcctcagtgaacgtctcgtgcaaggtcttcgtaggttactacttttagctagttagtggtgtcagcgtgggtgcgacgacggtcccgtaggacgaagggtcttggaggtggagtgggatcggatcgagcgtataacaagtaggaaacaacgaaagtgtacgactaactaattaacgtttaccgagggctaaaggtacgtacctaatacggtaatcggaaccaacgtaacgaccaaccgttaacgtaaccaacggtaacgtacctaacggttaccgacctaacgaacggttaacggtaaccgtacggtaaacgaacccgttgaacgtaactacggtacgaaccgtaaccgtaccggttaaccttaattaaggttacgttaacggtcgtaaccgtagaaccggttaaactaaacccgttttacccgtacttaaaccgttaattaaaacccggtttaccgggtaaactacgggtttaacgggtaaacgttttcccggttaagttttttaaaccgg

SEQ ID NO: 290657 - DNA, 619 bp, Homo sapiens
  misc_feature: GYAE6OF02FGC77.38.25.C03.1.454.CMB.1.raw
  modified_base (360)..(360): a, c, t, g, unknown or other
  misc_feature (360)..(360): n is a, c, g, or t
tcagtcgatcacgtcacgaccggtgctcgatttagtagtgtagatttgggtttgggggacccgaaaaaccacacccctccttgggagaatcccctagatcacagctcctcaccatggactggacctggagcatcctttcttggtggcagcagcaacaggtgcccactcccaggttcaattggtgcagtctggagctgaggtgaagaggcctggggcctcagtgaacgtctcctgcaaggcttctggttacacttttagcagttatggtgtcagctggggtagcgtacacggcccctggaccgaaggggtcttggaggtggatgggatggatcagcacttacaataggaaacacaaagtangacacattaactttcgagggcagagtcatcatcgaccacgaacgacacgtatacccaacggtacgacctaaccgtcggaacccttagaggttacggaacgttacggacggaacctggacacgttcgacgacgaacgtaccggtactttaatacttagttgcgtacgtagaacgtactaaaccgtttccctaacctttaacgtaacgttaaccgtttaccggaacgtacggttacgggaacttcggtttaccttttaacg

SEQ ID NO: 290658 - DNA, 653 bp, Homo sapiens
  misc_feature: GYAE6OF02HAYXX.38.25.C03.1.454.CMB.1.raw
  modified_base (338)..(338): a, c, t, g, unknown or other
  misc_feature (338)..(338): n is a, c, g, or t
  modified_base (371)..(371): a, c, t, g, unknown or other
  misc_feature (371)..(371): n is a, c, g, or t
  modified_base (384)..(384): a, c, t, g, unknown or other
  misc_feature (384)..(384): n is a, c, g, or t
  modified_base (389)..(389): a, c, t, g, unknown or other
  misc_feature (389)..(389): n is a, c, g, or t
tcagtcgatcacgtcacgaccggtgctcgatttagtagtgtagatttgggtttggggacccaaaaaaccacacccctccttgggagaatcccctagatcacagcctcctcaccactggactcggacctggagcattccttttcttgggtggcagcgagcaacgaggtcgcccactcccgaggttacaattcggtgcagtctggagcgtgcggtgaagcggcgtggggcctcgagtgacgtctcctgcgtaggtcttcgttggttacctacttttagctagttagtggtgttcgagcgtgggtgccgacgacggcccctgggaaccgagggtcgtaggnggtggagtgggagttgggactgacgctaactanaactggaaacaanaagtncgactactattacttacgaggtacagtactctatactacggtacaaccgacagtaacccagtacccaccgtacgacgactactacggacctacgagtaacgtacgagtaaccgacgtaggacagtccgacggaacgtaccgacggttaccttagtttaacttacgtttcgaaggacgtacgtaactaacgttacttaccggttaaccctaacgttacttaacgtaacgacggttaagttaggtacggtttacttagtttttacg

SEQ ID NO: 290659 - DNA, 886 bp, Homo sapiens
  misc_feature: GYAE6OF02G2BG3.38.25.C03.1.454.CMB.1.raw
  modified_base (220)..(220): a, c, t, g, unknown or other
  misc_feature (220)..(220): n is a, c, g, or t
tcagtcgatcacgtcacgaccggtgctcgatttagtagtgtagatttgggtttggggacccaaaaaaccacacccctccttgggagaatcccctagatcacagctcctcaccatggactggacctggagcatccttttcttggtggcagcagcaacaggtgcccactcccaggttcaattggtgcagtctggagctgcggtgagaggcctggggcctcgngtgaacgtctcctgcaaggcttcgtgttactacgttttagctagttatggtgtcagcgtggggtgccgacgacggtccccgtagggaacgaagggtcgttggaggttgggaggttggggaagtcgggaatacgacggtactaacgttaacgaaagtaacggaaaacaacgtaaaagtacgtacgacaacgtaattaactttaaccggagggacgtaacggtattaccgaataccgtaacgtaccgaaaccctaacgaaccgaaccctaacgtaaccgtaaccccgaaaccggtaacggaccttaacgtaccgttaacccgtaaaccgttaacggttaacgggtaaccccggtaagtaaaccggtaaacccgtaggtaaacgttacggtaacggttaccggaaaacccgggttaaccgtaaacccggtttaacccgtttttaaaacgtttaaacgtttacgggtttacgttaacggggaaacccggttaaccgggtaaacggttaaaaccggttttaaaccccttttaccccgtttaaaacccgtttaaaaccgttaaccggtttaaaaacgggttttaaaccccgggttaaaggttaaaaccggggtttaacgggggtttaaaaaccgttttaccccggggtttttaaatttttttaaccccgggg

SEQ ID NO: 290660 - DNA, 726 bp, Homo sapiens
  misc_feature: GYAE6OF02HRNJO.38.25.C03.1.454.CMB.1.raw
  modified_base (213)..(213): a, c, t, g, unknown or other
  misc_feature (213)..(213): n is a, c, g, or t
  modified_base (227)..(227): a, c, t, g, unknown or other
  misc_feature (227)..(227): n is a, c, g, or t
tcagtcgatcacgtcacgaccggtgctcgatttagtagtgtagatttgggtttggggacccaaaaaaccacaccccctccttggggagaatcccctagatcacagctcctcaccatggactggacctggagctattcctttttcttgggtggcaggcagcaacaggtgcccactcccaggttcaattggtgcagtctggagctgaggtgaagnggccgtggggcctnaggttgaacgtctccgtgaccgaagggtccttgtacggttaactacgtttttaacgctaagtttagttggtcgtcgagtcggttgggtgacgacgtaccggccccgtagggaacaacggggtcttaggaggtagggtagtgggaagtcggaactgacgtacttaacttaaacgaagtacggaaaacaacgttaaaaggtgtaacgacctaataacggttaactttaccggaaggactaaggtactacgtaacttaggacacgtaacccgaaacgtaaggaccctaaactaccggtaccaggaccgaacgaaccttgacctaagtacggttaacggatacggaacgaaccgttagaacttacgtaagtacgtaccggaaacttccggtacttaactttaggttacgttagggtcaaaccggttgaacctaacgttaaccttccgttaatacttaagtaacgttaacgagtaaccgtaggttaacttcggttaatttaccg

SEQ ID NO: 290661 - DNA, 771 bp, Homo sapiens
  misc_feature: GYAE6OF02GFDIV.38.25.C03.1.454.CMB.1.raw
  modified_base (72)..(72): a, c, t, g, unknown or other
  misc_feature (72)..(72): n is a, c, g, or t
  modified_base (187)..(187): a, c, t, g, unknown or other
  misc_feature (187)..(187): n is a, c, g, or t
  modified_base (280)..(280): a, c, t, g, unknown or other
  misc_feature (280)..(280): n is a, c, g, or t
  modified_base (523)..(523): a, c, t, g, unknown or other
  misc_feature (523)..(523): n is a, c, g, or t
  modified_base (653)..(653): a, c, t, g, unknown or other
  misc_feature (653)..(653): n is a, c, g, or t
  modified_base (735)..(735): a, c, t, g, unknown or other
  misc_feature (735)..(735): n is a, c, g, or t
tcagtcgatcacgtcacgaccggtgctcgatttagtagtgtagatttgggtttgggggacccaaaaaaccanacccctccttgggagaatcccctagatcacagctcctcaccatggactggacctggagcatccttttcttggtggcagcagcaacgaggtcgcccactcccaggttcaattggtncagtctggagctgcggtgagaggccgtggggcctgagtgacgtcctccgtgcgaacgtcttgtggttactacttttagctagtttagtggttntacgagtcgtgggtacgccgacgtaccgggcccctagggaacgtaacgggtccgttagggaacggttggggtaacgggttggtaaacgggttcgggaacgtttccggaacggttaccgttaaaccgtttaaccgaaaaggttaccgggaaaataaaccgtaaaaggttacgtaacggtactaactttaaaccggttaacgtttaaccgggagggtaaacgtaggtaacgttactaacggttanaaccgtaacgacccgtaagaccgtaactaaacgtaccgtcccaaaaggcctacgtaaccggttacctaacctagtaacggttacgaacgttagaccgtaccgtaaggtactaacgtcggtaacgtaaccncggtaaccctttataagttcttacgtgaccgtggaactactaacttaccggttacctaagttactaacgtttggtaaacccnggttagtaacggtttacgtacgtttaacttttacgg

SEQ ID NO: 290662 - DNA, 692 bp, Homo sapiens
  misc_feature: GYAE6OF02F9CO0.38.25.C03.1.454.CMB.1.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggtcttcgtggttaacacgttttagaccgtagttactgggtgtcagtcgtgggtgacgcacgggcccctaggactaagggtcttggagtggagtggagtgggactacgagacctacttaacgaagttacgggaaaacacgaaagtagagtctaacctaataactttacgacggggacaggtacgttcaagtacgatcggaacctacgaacgtacaacacgtaccgacgagaccaacttacggaccttaacgacgttacgaacgtggacgtaacgtacgatacgttgtaacgcgtaacgtaccggtactttaacgtaactttacgttaccggaggttaccgaagttaacggtaacccttaaaccgtttaaccgttaccctttaaacggtaacttaaccggttttaacggaacccgggttaaggttacgggttaaacgttcggttacgttttaaccgg

SEQ ID NO: 290663 - DNA, 669 bp, Homo sapiens
  misc_feature: GYAE6OF02GN40Z.38.25.C03.1.454.CMB.1.raw
  modified_base (354)..(354): a, c, t, g, unknown or other
  misc_feature (354)..(354): n is a, c, g, or t
  modified_base (358)..(358): a, c, t, g, unknown or other
  misc_feature (358)..(358): n is a, c, g, or t
  modified_base (398)..(398): a, c, t, g, unknown or other
  misc_feature (398)..(398): n is a, c, g, or t
  modified_base (446)..(446): a, c, t, g, unknown or other
  misc_feature (446)..(446): n is a, c, g, or t
tcagtcgatcacgtcacgaccggtgctcgatttagtagtgtagatttgggtttggggacccaaaaaaccacacccctccttgggagaatcccctagatcacagctcctcaccatggactggacctggagcattccttttcttggtggcagcagcaaacaggtcgcccacctcccgaggttcaattggtgcagtctggagctgcggtgaaggcggccgtggggcctcgaggtgtaaccgtctcctgcaagtcttcgtggttactacgttttgctagttagtggtgtcagtcgtgggtgacgtacgccggtaccccgtggaaccgaagggtcttggaggtggagtcgggtatgganacgngaacctacttaacgaaagtacggaaaactaacgaaagtanacgactaaccgttaaattaacgtttcggaaggacgtaaggtacgttanaacgttacgactaccgaacaacgagaacctacacgtacccgacgacgaccgtacctcgacctacgaaggtacgtaaccgagtaacgtaaccgtagacgtcgttacgacgtaacgacgtaccggtaccttattaacgttgtcgttagacgtagaccgtaacgttacttacctaacgtactaacgttacctaagtacgtagtaggtacttcgttaacttttccgg

SEQ ID NO: 290664 - DNA, 672 bp, Homo sapiens
  misc_feature: GYAE6OF02GU9K7.38.25.C03.1.454.CMB.1.raw
  modified_base (277)..(277): a, c, t, g, unknown or other
  misc_feature (277)..(277): n is a, c, g, or t
  modified_base (291)..(291): a, c, t, g, unknown or other
  misc_feature (291)..(291): n is a, c, g, or t
  modified_base (356)..(356): a, c, t, g, unknown or other
  misc_feature (356)..(356): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcgaggtcgaacgtctcctgcgaaggtcttcgtgttactacttttagactagttatggtntcgagtcgtgggtncgacgcggtcccccgtaggaacgtagggtcttaggaggtggagtgggatggatcagactacttanaagtaggaaacacgtaaagtatacgacaataacgttaacgttaccgaaggctaacgtactcaactactacacgaacctaacgaggaaacctacaccgtaaccgaacgacgacctacgtccgaactaacgagttaacggactaaggaaccgtaacgtagtaacgtacttaccgacggaaccgtacgaaccttaccttaagttaacgttacttcggtaacgagtaacgtaactaacgttaaacttccctaaacttaaccgtaattaccgttaacgtaccgttaaggtaaccgggtagtttaccgtagtttttaaccgg

SEQ ID NO: 290665 - DNA, 847 bp, Homo sapiens
  misc_feature: GYAE6OF02IH7GG.38.25.C03.1.454.CMB.1.raw
tcagtcgatcacgtcacgaccggtgctcgatttagtagtgtagatttgggtttggggacccaaaaaaccacacccctccttgggagaatcccctagatcacagctcctcaccatggactggacctggagcatccttttcttggtggcagcagcaacaggtgcccactcccaggttcaattggtgcagtctggagctgcggtgaaggaggcctggggcctcgagtgtaaccgtctcctgacgaaggtcttcgtggttactactttttagcgtagttagtggtgttccaggtcgttaggggtcggaccgaacgaccggtcccccgtagggaaccgtaaacggggtcctttaggagggttacggtagggttgggggtaagttagggggtactaccggacggtaccgttaaaccgtttaaaccgtaagttaacgggaaaaacctaaccggtaaaaggttatacggaaccctaaacgttaaacgtttaaaccgttttacccgggaaacgggtaaccgtaaacgggtacgttaaccgtacgttaccaacggttaccggaacccgaaccgtaacggaaccctaaaccgtaaccgtacccgtaaaccgggcggtaaccctttaacggacccgtaacccgttaacgaacggttaacggtaacgtacgggaaaccgtaacgtcggaaacgtactccggtaagacccgaaaccgtccggtttaacttaagtttaagttcgttacggacgaacggttaacgacggttaaacctaacgtttacccgtaacctttaaccgaacgtttaaacgtaccggaacgttaccggttagggtaaccctttagttaccgtttttacgg

SEQ ID NO: 290666 - DNA, 627 bp, Homo sapiens
  misc_feature: GYAE6OF02HPF3G.38.25.C03.1.454.CMB.1.raw
  modified_base (352)..(352): a, c, t, g, unknown or other
  misc_feature (352)..(352): n is a, c, g, or t
  modified_base (403)..(403): a, c, t, g, unknown or other
  misc_feature (403)..(403): n is a, c, g, or t
  modified_base (407)..(407): a, c, t, g, unknown or other
  misc_feature (407)..(407): n is a, c, g, or t
  modified_base (493)..(493): a, c, t, g, unknown or other
  misc_feature (493)..(493): n is a, c, g, or t
  modified_base (558)..(558): a, c, t, g, unknown or other
  misc_feature (558)..(558): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcattccttttcttgggtggcagcagcaacgaggtcgcccctactcccaggttcaagttgggtgcagttcgtggagctgcggtgaagcggccgtggggccctgagtacgtaacgtcctccgtgacgacggtcttacgtggttactacttttagactaagttgtgtcgtcaggtcttagggcgcgacgacggtcccgtaggacgtacggtctaggtagtggtacgngggtactggactcgagacctaacttaacgaagtacggaaacaagtaagtancganactaagttatacgaggactaagcgtacacgtatacgaccgtaaccacgaacgactacctacgaccaagtacgtccaagctaccganacggttacgagttacgaacgtagatagctcgtacgactccgagtccttaatgttagacgtacganagtacgtaactacttaccgtctaacgtactaacgtaccgagttacgtacgtcgttagttacttttacgg

SEQ ID NO: 290667 - DNA, 680 bp, Homo sapiens
  misc_feature: GYAE6OF02F66P1.38.25.C03.1.454.CMB.1.raw
  modified_base (283)..(283): a, c, t, g, unknown or other
  misc_feature (283)..(283): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttactggttgtcagcgtgggtncgacaggcccctggacgaagggcttggatggatgggatggatcaggcacttacaagtggaaacacaaaagtactgacgaactaattaagttccgaagggcaaggtactcaagtcaagtcgaacctaacgaagtaaccgaacctactacccgaaacgtacgacctacctacggctaaaccgagttagggaaacccttaggaaccggtaaccggttagaacgggaacttcgtaacggaccgtaacgaccgggttaccgtttaaacttaacttaacggttttacggtacggacggtaacggaaacgtaaccggttaaaacttaccccgtttaacttaacgtactttaaacgttacccggaacggttagtacgggtaaagttccggttacgtttttaaccg

SEQ ID NO: 290668 - DNA, 615 bp, Homo sapiens
  misc_feature: GYAE6OF02JGRBF.38.25.C03.1.454.CMB.1.raw
  modified_base (184)..(184): a, c, t, g, unknown or other
  misc_feature (184)..(184): n is a, c, g, or t
  modified_base (372)..(372): a, c, t, g, unknown or other
  misc_feature (372)..(372): n is a, c, g, or t
  modified_base (473)..(473): a, c, t, g, unknown or other
  misc_feature (473)..(473): n is a, c, g, or t
tcagtcgatcacgtcacgaccggtgctcgatttagtagtgtagatttgggtttggggacccgaaaaaccacacccctccttgggagaatcccctagatcacagctcctcaccatggactggacctggagcatccttttcttggtggcagcagcaacaggtgcccactcccaggttcaattggtncagtctggagctgcggtgaaggaggccgtggggcctcaggtgaacgtctacctgcaaggcttctggttacacttttagctagttatggtgtcagcgtgggtgcgacaggcccctggacaagggcttagaggtaggatggggagtggatcgaggctaacgtacaagtcggaaacacgaaaagtataganaactagtaacgtttacccgagggtaccgaagtacgtacagtaccaagtcgaaccctacgaacgaacctaacgacgtaccacgacgtacgactcgaccctanacgtacggactaggacgtaaccgtagacgactcgtagaccgacgtaaccggtaccgttaataacgttattaggagtaccgtagaacgacctaaagttacctactaactactagtacgagaattagggaattcgtatttacgg

SEQ ID NO: 290669 - DNA, 636 bp, Homo sapiens
  misc_feature: GYAE6OF02HSXJI.38.25.C03.1.454.CMB.1.raw
  modified_base (367)..(367): a, c, t, g, unknown or other
  misc_feature (367)..(367): n is a, c, g, or t
  modified_base (411)..(411): a, c, t, g, unknown or other
  misc_feature (411)..(411): n is a, c, g, or t
  modified_base (418)..(418): a, c, t, g, unknown or other
  misc_feature (418)..(418): n is a, c, g, or t
  modified_base (455)..(455): a, c, t, g, unknown or other
  misc_feature (455)..(455): n is a, c, g, or t
  modified_base (487)..(487): a, c, t, g, unknown or other
  misc_feature (487)..(487): n is a, c, g, or t
tcagtcgatcacgtcacgaccggtgctcgatttagtagtgtagatttgggtttggggacccaaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctctgcaaggcttctggttactacttttagctagttatggtgtcagcgtgggtcgcgacacggcccctaggactaagggtctggagtggagtgggatggatcgagtctaacttacgaatacggaaaacaacgaaaagtntagactaacgaattaacgttcgaaggtacagtagtacatcaatnaacctanacgaacactaactaccaacgcacacgtagaccctaanagttaacgaacgtaggaacgaacctgaaccgnttacgacgaccgaacgtcgaactttaacgttagttaaatcggttaggacgtaacgtacgtaaacctaacgtttacccttacgttaaaccttaagttaacgtttaaaccggacgttaaggttaaggaaacgtttcgttacttttaaccgg

SEQ ID NO: 290670 - DNA, 716 bp, Homo sapiens
  misc_feature: GYAE6OF02G56UL.38.25.C03.1.454.CMB.1.raw
tcagtcgatcacgtcacgaccggtgctcgatttagtagtgtagatttgggtttggggacccaaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttcgtggttactacttttagctagttatggtgtcgagcgtgggtgcgacgacggccccgtggaacgagggtcttggaggtggagtgggagtggatcgagctaacttaacgaagtaggaaaccaacgtaaagtagtacgacaacgtaacttaaacgtttaccggaagggtacaaggtacgtaacgtactactaacgtacgtaacccgaagaacgaaccaacctacctacccgaacgtacgtacgtaaccgtacgtaccctaaacgtacggtaacggtaacgtacggaaccggtaaacccgtaaggacggttactacggtaccggaaccgtaccgtaaccgggttacctttagttaacgtttacgttacggtacgaacggtaacgtaacgtaaccgttaaaccgtttaccctaaccgttaactaacgttaaccgttaacgtacggtaagtacggtaagtttacgttacttttaaccg

SEQ ID NO: 290671 - DNA, 824 bp, Homo sapiens
  misc_feature: GYAE6OF02IW0G0.38.25.C03.1.454.CMB.1.raw
tcagtcgatcacgtcacgaccggtgctcgatttagtagtgtagatttgggtttggggacccaaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaggtcttcgtggttactacttttagctagttagtggtgtaccagcgttgggtcgacgacgacggtcccccgtggaacgaacgggtcttgggacggtaggaggttcggggagtacgggatcggacgtacgtaaccttaacgtaacgtaaggaaaaccgaaacgtaaaacggtactagaacctaacgtaacttaaaccgtttaccggaagggtactaaacggtaacgtaacgtacgtaaccgtaacgtaccgtaaacccgaacgtaaacgaaccctaaaccgtaaccgttaaaccccgaaccggtaacctaacccgtaacgttcccgtaacccgtaaacgttaccggtaaacgggtaaacccgtaagggtaaacccggtaaccgtaacggaaacgttacgttaccggtaaccggtaacccggaaacccgtacccggttaacttttaaacgttaacgttttaggttccggtaacgggtacggtaaggtaaccgttaaccgtaaaccttttacccgttaaccgtttaacgtaactttaacgttaacggtaccggtaagttaacggggtactttacggttacctttttaaccg

SEQ ID NO: 290672 - DNA, 793 bp, Homo sapiens
  misc_feature: GYAE6OF02JPTW1.38.25.C03.1.454.CMB.1.raw
tcagtcgatcacgtcacgaccggtgctcgatttagtagtgtagatttgggtttggggacccaaaaaccacacccctccttgggagaatccctagatcacagctcctcaccatggactggacctggagcatccttttcttggtggcagcagcaacaggtgcccactcccaggttcaattggtagcagtctggagctagcggtgaagaggcctggggcctcagtgaacgtctcctgcaaggtcttctggttactcttttagctagttagttggtgtcaggtccgtggggtcgtcggacacgggtccccgtgggtaacgaaggggtccttaggtaggtagggtagttgggggaacttggggtacttaccggacggtaccctaacggtttaaccaaaaggttacggaaaaaccgtaaacgtaaaaacgggttaacgttagtaccccgtaaacttaacggttaaaaccttttcccgggaaacggggtactaacgggtaacggttaacctaaatccggtaaacgttacgaacccgttaacgaaggtaaacctacgtaaccgtacccgaaacgtaccgaccttaacgtacccgacctaacgtacgtacggttaaacgtagggtaacccgtaaacggtgaacggtacgtaccgtcgaaccgtacccgtcgttaaccttagttacttaggtacgtactaacggagtaacgtaaccgttaaccgttcctttaaccgtaacttacggttaaccgtttaacgggaaccgtaggttaccggtaaaggttccctttagtttttaacg

SEQ ID NO: 290673 - DNA, 745 bp, Homo sapiens
  misc_feature: GYAE6OF02GTOJE.38.25.C03.1.454.CMB.1.raw
tcagtcgatcacgtcacgaccggtgctcgatttagtagtgtagatttgggtttgggggacccaaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcgagtgaacgtctcctgacaggcttcgtggttacacttttagcagttagtggtgtcagcgtgggtgcgacgacggccccgtaggacgaagggtcttggaggtggagtgggatggatcgagcaacttaacaagtaggaaacaacgtaaagtatacgactaactaagttaacgttaccgaagggactaagtacgtactatacgaacgttacgaaccgtacgaagtaacctaactaacgtaacccaacgaacgaccaacgtccgaaccctaatacggtaacggtaaaccgttagggaaaccggtaacctaggaacgtaactaccgtaacggacccgtaaccggtaaccggtaacctttaaggttaaactttaacggttacggtaaccggtaacggtaacgtaaaccggtaaaccgtttaaaccttttaacccctttaaaccgggttaaacttaaacgtttaaccgtttaacccgggtaacgttaaccggttaacgggtaacggtttaacggtttaacccttttaacgg

SEQ ID NO: 290674 - DNA, 756 bp, Homo sapiens
  misc_feature: GYAE6OF02JVB3S.38.25.C03.1.454.CMB.1.raw
  modified_base (208)..(208): a, c, t, g, unknown or other
  misc_feature (208)..(208): n is a, c, g, or t
  modified_base (221)..(221): a, c, t, g, unknown or other
  misc_feature (221)..(221): n is a, c, g, or t
  modified_base (231)..(231): a, c, t, g, unknown or other
  misc_feature (231)..(231): n is a, c, g, or t
  modified_base (508)..(508): a, c, t, g, unknown or other
  misc_feature (508)..(508): n is a, c, g, or t
  modified_base (581)..(581): a, c, t, g, unknown or other
  misc_feature (581)..(581): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcattcctttttcttggtgcagcagcaacaggtcgcccactcccaggttcaagttggtgcagtctggagctgcggagaagnggccgtgggcctnagtgaactcnctgacacggtcttcgtggttactacttttagcgtagtttactggtcgtacgacgtcgtgggtgcgacggtacggcccgtagggacgaaggtcgttgacggttgggaacgtgggtagtggtatcgacgtaccgtacttaacgtaataacggggtaaacaaacgtaaagtagtagtaacctaaaccgttaagtttaaccgttaccggaacgggtactaaggtacgtacttaagtacgtaactaccgggacctaacggacaacctaacgtcgtaaacccncgggaactactaccgtaccgtaaccgtagaacggttaacggtaaaccgttaggaaccgtaactacgggtaaancgttaaggtaacccgacggtaaccgttaccgttaacttaagtttcggtaagttccgttaggaccggtaacaaccggttaaacgtttaacccttaccggttaaccttaaccgggttaacttaccggttaacgaacggttaccggtaaggttaggtttaccgttagttttttaaccg

SEQ ID NO: 290675 - DNA, 891 bp, Homo sapiens
  misc_feature: GYAE6OF02H7JA3.38.25.C03.1.454.CMB.1.raw
  modified_base (168)..(168): a, c, t, g, unknown or other
  misc_feature (168)..(168): n is a, c, g, or t
  modified_base (192)..(192): a, c, t, g, unknown or other
  misc_feature (192)..(192): n is a, c, g, or t
tcagtcgatcacgtcacgaccggtgctcgatttagtagtgtagatttgggtttggggacccaaaaaaccacacccctccttgggagaatcccctagatcacagctcctcaccatggactggacctggagcattccttttcttggtggcagcagcaacaggtgcccacnccctaggttcaattggtgcagtcnggagctgcggtgaagacggccgtggggcctcgagtcgtaacgtctctgacaaggtcttacgtggttaacttacgttttacgactagttagtggtagtccgaggcgttggggtacgacgtacgacgggtaccctgggaaccgtaaagggtcctttaggaggttcggtaaggtttagggacgtaggtagtccaacggtaccttaagttaacgtaaacgttaaagggaaacctaaacggaaaagtttacgccggtaactaaagtaaaccgtttaacggttaccgtaaacgggtacgtaaaacggtcggtaaaccaaagtttacgaaaccgttaacgaaccccggaacaacgggtaaactaaaccgtaaaccgggttaaccccgaacgggtaaaccggtaccgtaaacccgttaccgggttaccttaaacccgggtaagttaacgggttaaaccgtaaacggttaaacggaaaccggttaagggtaaaccgtaggtttaaacccgttaacggggaacccgttaaaaccggttaacccggggttaacctttttaaacggtaacgttttaacgttaacggggttacgaaacgggacgtaaaaccgttaaccggtaaacctttacccgttaacggttaacctaacgttaacgttaaccggtaacggtaagtaacgggttaaggttaccgttaacgtttttaaccgg

SEQ ID NO: 290676 - DNA, 786 bp, Homo sapiens
  misc_feature: GYAE6OF02IDGJY.38.25.C03.1.454.CMB.1.raw
tcagtcgatcacgtcacgaccggtgctcgatttagtagtgtagatttgggtttggggacccaaaaaaccacaccccctccttgggagaatcccctagatcacagctcctcaccatggactggacctggagcatccttttcttggtggcagcagcaacaggtgcccactcccaggttcaattgggtgcagtctggagctggcggtgaagaggccgtgggctcagtgaacgtctctgcaggtcttcgtggttacctattttagctagttattggtgtcgagcggttgggtgcggtacgccgggccccgtggacgaaggggtcgttggacggtaggtaggtggggtaagtggtactgacggtacctaacgttaacgaaggttaacggaaaacgaaacggtaaaagttagtacgaaccgaacttaaacgttaacgttacccgaagggtacaaggttaacgtaccaacttacgaactaccggaaccgtaacgtaacgaccaacgtaccgtacccgaacgaacgtactaccgtacgacctaaacgacggttaacgaacgtacggaaggtaaccgtaggaacgtacttacggacggtacccgtaaccgtaaccggtttacctttaacgtttaaacgttacggtttagtaacgggtaaccgtacggtaaaacgttaacccgttaaccgttttaaccctttaaccccgttacttaaaaccggtttaccttaaaccgggtaaccggtttaaccgggttaagggtaacccggttttacgttaacttttttaacccgg

SEQ ID NO: 290677 - DNA, 645 bp, Homo sapiens
  misc_feature: GYAE6OF02FX5MR.38.25.C03.1.454.CMB.1.raw
tcagtcgatcacgtcacgaccggtgctcgatttagtagtgtagatttgggtttgggggacccaaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcgaggtgaacgtctcctgcaaggtcttctggttacacttttagctagttatggtgtcagtcgtggtgcgacgcggcccgtaggacgagggcttggagtggagtgggtagtggagtcgagctaacttacgaagtaggaaacaactaaagtatacgacaactaattaacgtttaccgagggtactaggactacgatacgtatacgaccacgtacgaaccacactacccgaagacgacaacgtcgacctagagttacgaacgttacggaacggaaccgtaggacgtactcgacggaaccgaaccgtacggtaccctttaatagtttagtcggtacgacggtagacgtaaacttaacgttcccgttagttaacctagttaaccgttacggtaacgttacggtaggttaacggttcgttacgtttttacgg

SEQ ID NO: 290678 - DNA, 798 bp, Homo sapiens
  misc_feature: GYAE6OF02GA6AY.38.25.C03.1.454.CMB.1.raw
  modified_base (595)..(595): a, c, t, g, unknown or other
  misc_feature (595)..(595): n is a, c, g, or t
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccgaggttcaagttggtgcagtctgggagcgtgacggtgaagacggccgtggggcctcgaggtgaaccgtctccgtgcaacggtccttcgtggtttaacctacgttttagacgtagtttacgtggtacgtacgaggtcggtgggtggaccgtaaccgacgggtcccccgtaggtaacgtaacggggtcttaggaggtacgggaagttggggagtcggacgtcgagtacgtaacttaagaagtacgaaaacacgtaacgtcagactataacttaacgttacggacggtacaagtactactacgtacgatccgaaccaaccgtacaaacccgtacaacgttacccgaaaccgtacgaccgtaaccgtttcccgaacccgttaacgtaacgttaaccgggtaaaccggttaacgggaaaccgggttaaccnggtaaccggtaacgttttaacccggaacggaaccccgggtaaacgttaccccggttaattttaaagttaccggtttaacggttagtaccgggaagtaaccggttaactaaaccgttctttttaaccccgtaacggtttaaactacgttttaaccgacgttaaccggtagttacggtttagtttacccgggtttattttacccg

SEQ ID NO: 290679 - DNA, 782 bp, Homo sapiens
  misc_feature: GYAE6OF02I22TY.38.25.C03.1.454.CMB.1.raw
tcagtcgatcacgtcacgaccggtgctcgatttagtagtgtagatttgggtttgggggacccaaaaaaccacacccctccttgggagaatcccctagatcacagctcctcaccatggactggacctggagcatccttttcttggtggcagcagcaacaggtgcccactcccaggttcaattggtgcagtctggagctgcggtgaggaggccgtggggcctcgagtagaacgtctccgtgcaacggtcttcgtggttactacgttttagcgtagttagttggtgtcagtcgtgggtgccgacgcggccccgtggaacgtaagggtccttaggtacggtggagttggggagtgggtatcgacgctaaccgttaacaagtacggaaaactaacgtaaagttactcgaaccaaagtagttaacgttaccgagggcaagtacgtctaacgtacagtaccgacaaccacgacctaactaccaccgtaacgacgtacacgtaccgacctactaacgtacggtaaaccgacggtaaaccggtaccgtagtacctacgttccgtaacggacccgtaacccggtaaccggttaaccgtttaacggtttagtttaacgtttaccggggtagggtttaaccgaacgggtaacctttaaacccggttaaaccttttacccccggtttaaacccgtttaacccgttaacgttttaaacccggtttaccgggaaaccgtttacggggtttaacggttaacgggttttacccgtttaccggttttttttaaaccccgg

SEQ ID NO: 290680 - DNA, 967 bp, Homo sapiens
  misc_feature: GYAE6OF02IPZF8.38.25.C03.1.454.CMB.1.raw
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacgaggtgccctactcccctaggttccaagtttcggtgctagttcgtggacgcttggcggtagaagaggcccgttggggacctcacggtcggaaccgttcgtccgttcgacgtaacggtccgttttccgtagggtttaaccttacgttttttacggacctttaagggttttaacgttaggggttcggttaccgtaacgggttccggttacggggggttacggtaccggaacccggtacccgggttaccccccccggtttaggggaaaacccggtaacgggggttaaccgttttacggggtaaccggggtttggggtaacgggttttaaccgggggaacggttacggggttaaccgttacggtaaccggtaccgttaaaccgtttaaaccgtaaaacgtaaaccggggtaaaaacctaaaaccggttaaaacgggttacgtaaccggtaacctaaaccgtttaaaaccgttaacgtttacccgggtaacggggttaacccgaaagttaagggtaaccctaacggtaacccgttaacggtaaccgtaacccgtaaccggtaaaccgaacggtaaacctacccgttaaaccggtaaacccggtaaacgacccgtacccgttaacgtacccgaaacgttcggttaaacgtaacggtaaccgtacggtaaaccgtgtaacgtacgtacgtacggtaaccgtaccggtaccgtacttaactagttatcggtagtacgagaaccgttaacgtaacgtttacccgttaactacttaacgttagaacgttacgaacgtacggtacgttacgtagttttaccg

SEQ ID NO: 290681 - DNA, 925 bp, Homo sapiens
  misc_feature: GYAE6OF02F4AE1.38.25.C03.1.454.CMB.1.raw
  modified_base (278)..(278): a, c, t, g, unknown or other
  misc_feature (278)..(278): n is a, c, g, or t
tcagtcgatcacgtcacgaccggtgctcgatttagtagtgtagatttgggtttgggggacccaaaaaccacacccctccttgggagaatcccctagatcacagctcctcaccatggactggacctggagcatccttttctggtggcagcagcaacaggtgcccactccagttcaatggtgcagtctggacgctgtcggtgtaagacgggtcctaggggcctcgagtcgaacgtctcctgcaacgtcttctaggttacacttttagcgtagtactggtntcagtcgtgggtgacgactacgggccccgttggaaccgtaacgggtcgtttacggacggttggtacgtggggtaactcggaacttccgaaggtaccctaacgtttaaacgtaaacggtttaccggaaaactaaccggtaaacgttaacggttacgaaccggtaactaaacggtttaaccgtttacggacgggacgttaacggacggtccctaaggtaactacgttaccgtaacccacgggtaaacctacaaaccgtttaaccggacccgtaaacggtacgtaaaccgttacccggtaccggtaacccgttaaaccggtaacggttaacggtaaaccgtttcgggaaaacccggtaacccggttaggtttaaacccggtaaaccttttacccggtaaaccggggtaacccccgtaaccggttaaaccggtttaccccggttttaaagttaaacccggttttaaacttttccgggggaaccgtttaaccccggggaaaggggttaaacccgttaacccggggttttaaaaacccctttacccgggtttacccggtttaaaacccttaagtttaaacccgggtttaaccgaacccgggttttaagggtaacccgttaacgggttacccggtaacctttttttaacccggg

SEQ ID NO: 290682 - DNA, 730 bp, Homo sapiens
  misc_feature: GYAE6OF02IVD3R.38.25.C03.1.454.CMB.1.raw
  modified_base (214)..(214): a, c, t, g, unknown or other
  misc_feature (214)..(214): n is a, c, g, or t
tcagtcgatcacgtcacgaccggtgctcgatttagtagtgtagatttgggtttgggggacccaaaaacccacacccctccttgggagaatcccctagatcacagctcctcaccatggactggacctggagcattcctttcttggtggcagcagcaacgaggtgcccactcccaggttcaagttggtgcaggtctggagctggccggtgaacggngggccgtcgggggtccctgaggtcgtaacgttcctccgtggtccaaggtcgttcgttcggttacctaccgttttagccgtaagttacggtggtctcgtaggcgtggggtacaccggcgtaacggtcccccgtaggaccgtaacggggtcttagggtacgggtcggtaagtcggggtagttacgggacttaccggaacgtaccgtaaacttaacggtacgtaaccggtaaaactaaaccggtaaaggtacgtacgtacgaacctaacgttacttaccggagtacgaggtactacgaacgttcgacttacggaacccaacgacgtacaacccgtaacaccgtaacgaacgtacaccgtcgaacccgtagtacgtaacgaagttaccgagttaccgagaactaacgtcgaaccgtcgacggtaacctactttacgtacttagtacgagacacgtataacggtaccctttaccaatcgtaacgttagtaaccgtagacgtacgtacgtcgttactttacg

SEQ ID NO: 290683 - DNA, 690 bp, Homo sapiens
  misc_feature: GYAE6OF02GSWY4.38.25.C03.1.454.CMB.1.raw
  modified_base (540)..(540): a, c, t, g, unknown or other
  misc_feature (540)..(540): n is a, c, g, or t
tcagtcgatcacgtcacgaccggtgctcgatttagtagtgtagatttgggtttggggacccaaaaaaccacacccctccttgggagaatcccctagatcacagctcctcaccatggactggacctggagcatccttttcttggtggcaaagcagcaacaggtgcccacctcccaggttacaagttggtgcagtctggagcgtgcggtgaagacggccgtgggctcagtgaacgtctcctgcaggcttcgtcgttactactttagctagttagtggtgtcgagtcgtgggtgcgacgacggcccgtaggacgagggcttggacggtgggagtgggagtaggtactcgagcctaactaacaagtacggaaaacaactaaagtagtagaactaagtaattaaacgtttaccgaagggtaccaaggtagttacaagtacacgtacgaacccaacgaaccggaactaacaccgtaaccaacgagacctaacctcgaaccctacgtaacggtagtaaaccgcgggtaaacggtacccaggtaacgntaaccggtacgaccgaacgtaaccggttactttaatttacgtttagtacgggtacgaggtaagactaacgttaaaccttcccgtttaactaaccgttgttaaaccgttacggaaccgttagagggtttaacttacggtactttttaaccg

SEQ ID NO: 290684 - DNA, 731 bp, Homo sapiens
  misc_feature: GYAE6OF02I2LPU.38.25.C03.1.454.CMB.1.raw
  modified_base (345)..(345): a, c, t, g, unknown or other
  misc_feature (345)..(345): n is a, c, g, or t
  modified_base (590)..(590): a, c, t, g, unknown or other
  misc_feature (590)..(590): n is a, c, g, or t
tcagtcgatcacgtcacgaccggtgctcgatttagtagtgtagatttgggtttggggacccaaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcgtggggcctcagtgaacgtctcctgcgaaggtcttcgtggttactacgttttagctagttagtggtctcgagtcgtgggtgcgacgacggccccgtaggaacgaagggtcttaggaggtaggagtagggagtaggntaccgagtacgtaacgttaacgaagtaacggaaaacctaacgtaaaagttacgtacgaaccgtaagttaaacgttaacgtttaccgaaggggaacctaaggtacggttaacaagttactaagtaaccgtaaaccgaaccgtaagaaccctaacgttaaccgtaaccgaaccggtaacaccgtacgttaacccggacttaaccgtagtaaccggtaacgtacggaaacgtacgtaggaaccgttanaaccggtacggaaccgaaccgtacggttaacctttaaggtaacctttagtaccggtagacctaagaacggtaaccttaaccttcccttaacgtattaacgttagtaaccgtgtaataccggttaattcgttaacttttacg

SEQ ID NO: 290685 - DNA, 562 bp, Homo sapiens
  misc_feature: GYAE6OF01AK8VB.12.13.B02.1.454.CMB.1.raw
  modified_base (400)..(400): a, c, t, g, unknown or other
  misc_feature (400)..(400): n is a, c, g, or t
tcagatacgacgtacacgaccggtgctcgatttagtctagcgacttccgcggggagagctgctcagttaggacccagagggaaccatggaaaccccagcgcagcttctcttcctcctgctactctggctcccagagaccaccggagaaattgtgttgacgcagtctccaggcaccctgtctttatctccgaggggaaagagccaccctctcctgcagggccagtgagaatgttaacaacaggtatctggcctggtaccagcagaacctggccaggctcccaggcctcctcatgtacgttactccagcaggccacgtggcactcccagacaggtcacgtggcaggtggtctgggacagcttacactctcaccatccaccagacgtggacgtcctagaagtntttgctagttgttattagttgtacagtctagtagtggtacgcgtacgtaccgttactacgtttcggaccgtacgggtaccaagtcgtaggagtagtacggaaacgtacgtaggtcggtcgtacgcaccgtattcgtcgttcttactcttccgttcccgtacc

SEQ ID NO: 290686 - DNA, 589 bp, Homo sapiens
  misc_feature: GYAE6OF01BACMW.12.13.B02.1.454.CMB.1.raw
  modified_base (199)..(199): a, c, t, g, unknown or other
  misc_feature (199)..(199): n is a, c, g, or t
  modified_base (391)..(391): a, c, t, g, unknown or other
  misc_feature (391)..(391): n is a, c, g, or t
tcagatacgacgtacacgaccggtgctcgatttagtctagcgacttccgcggggagagctgctcagttaggacccagagggaaccatggaaaccccagcgcagcttctcttcctcctgctactctggctcccagagacccaccggagaaattgtgttgacgcagtctccaggcaccctgtctttatctccaggggaaangcccaccctctcctgcagggccagtgagaatgttaacaacaggtatctggcctggtaccagcaagaaacctggcccaggcctcccgaggcctcctcatgtaccgttactccagcagggccacgtggccatccccaagacgtaggttcacgtgggctaggtggggtctggggacagtaccttcactctcaccntccacagactggacgcctagtaagtatttgactagtgtattattgtcagtctagtagtggtacgcgtacctaccgttactacgtttcggaccgtaggggtacctaagtcgtagggacgtagtacggaaacgtacgtcggtcggtctaggacctaccgtaagttcgttcgttaccttacctacttcccgttccccgtcc

SEQ ID NO: 290687 - DNA, 651 bp, Homo sapiens
  misc_feature: GYAE6OF02JKCOG.12.13.B02.1.454.CMB.1.raw
  modified_base (259)..(259): a, c, t, g, unknown or other
  misc_feature (259)..(259): n is a, c, g, or t
  modified_base (289)..(289): a, c, t, g, unknown or other
  misc_feature (289)..(289): n is a, c, g, or t
  modified_base (308)..(308): a, c, t, g, unknown or other
  misc_feature (308)..(308): n is a, c, g, or t
  modified_base (396)..(396): a, c, t, g, unknown or other
  misc_feature (396)..(396): n is a, c, g, or t
tcagatacgacgtacacgaccggtgctcgatttagtctagcgacttccgcggggaggagctgctcagttaggacccagagggaaccatggaaacccagcgcagcttctctctcctgctactctggctccagagaccaccggagaaattgtgttgacgcagtctccaggcaccctgtctttatctccgaggggaaagacgcctaccctctcctgcagggccagtgagaatgttaacaacaggtatctggcctggtaaccngcagaaacctggccacggctccagctaccnagtgtacgttactcagcgnggtccactggacactaccccgagaacgtacggttcaacgttcggacctaggtcggggtacctaggggaccaaggcctttacgaacctntccaacctatacccacagaccttgggaaccgctacgtagtacgttttacgcgtaacgtagtattacgttcgtactagtactagtacgtaggtagtacggcgtacgtacgttacctttacggtaccgtacgggtaccgtaagtccgtaggttaccgaagtacggtaacgtaacggtacggtacggtacgtacggtaccgtaaccgtacgttacgttcggttaccgttacggttaacttccgttacccgttacccgg

SEQ ID NO: 290688 - DNA, 152 bp, Homo sapiens
  misc_feature: GYAE6OF01DPLXE.18.20.B09.1.454.CMB.1.raw
  modified_base (152)..(152): a, c, t, g, unknown or other
  misc_feature (152)..(152): n is a, c, g, or t
tcagtacgagtatgcacgaccggtgctcgatttagtgtagtgtgagggaaagggaccaaggtggaaatcaaacgaactgtggctgcaccatctgtcttcatcttcccgccatctgacatactcgtactgagcgggctggcaaggcgcatagn

SEQ ID NO: 290689 - DNA, 152 bp, Homo sapiens; identical to SEQ ID NO: 290688
  misc_feature: GYAE6OF01BNMFQ.18.20.B09.1.454.CMB.1.raw
  modified_base (152)..(152): a, c, t, g, unknown or other
  misc_feature (152)..(152): n is a, c, g, or t

SEQ ID NO: 290690 - DNA, 786 bp, Homo sapiens
  misc_feature: GYAE6OF01EELFR.18.20.B09.1.454.CMB.1.raw
  modified_base (207)..(207): a, c, t, g, unknown or other
  misc_feature (207)..(207): n is a, c, g, or t
tcagtacgagtatgcacgaccggtgctcgattttagtgtagtgtgaagggtaaagggggtacccaacgaaccacatccctccgtgacgtaagccccccaggagccaacgaaccttcccttacctagtggactggacctggaggatcctcttttggtggccagcaggccacgaggtgcccacttcccgtagttccagcttgttgacgngtctggggtctggaggtgaagaagccgtggggcctcgaggtggtaaggtttctgcaagtaccttcgtaggactacctccttacactttacgtttttcctatcctattggctcgcgcctacggccccgtaagtaacggtcttggaggtgggtggacgtgggactcgaacgtctacgtacgaaggtcggtctacgtaacgtaaagttactaacgaactaaacgtaagttcggaggaaggtaacgaagtacgtacgtaaccgtattacggtaggtaacgacgtacgtaccgacgaaccgtaacgtaccgtaaccgtagaaacgtggaacgtacgtacggtaacggactaacggtcccgttaagtacgttagtaccgtaagaaacgtacgaaccggtcgttaacgtaacgttaacgttaccggtacgtacggaaccggtacggtagtttacgtaaccggtaagggttaccggttaaggttacccgggtttacccgtttaaacgtaaacccgtttaaccctttaaccggttaaccgttaaccgttaacgggtttcgggttaacccgttacgggtaacccggggg

SEQ ID NO: 290691 - DNA, 152 bp, Homo sapiens; identical to SEQ ID NO: 290688
  misc_feature: GYAE6OF01CGFBJ.18.20.B09.1.454.CMB.1.raw
  modified_base (152)..(152): a, c, t, g, unknown or other
  misc_feature (152)..(152): n is a, c, g, or t

SEQ ID NO: 290692 - DNA, 757 bp, Homo sapiens
  misc_feature: GYAE6OF01ETX9T.18.20.B09.1.454.CMB.1.raw
  modified_base (153)..(153): a, c, t, g, unknown or other
  misc_feature (153)..(153): n is a, c, g, or t
  modified_base (557)..(557): a, c, t, g, unknown or other
  misc_feature (557)..(557): n is a, c, g, or t
  modified_base (568)..(568): a, c, t, g, unknown or other
  misc_feature (568)..(568): n is a, c, g, or t
tcagtacgagtatgcacgaccggtgctcgatttagtgtagtgtgaagggacgaggggacccaacaaccacatccctcctgagacgccccagagcacaactccttaccatgactgactggagatccttcttttggtggcagcagccacaggtcncccgacctcccgaggtccagtcttgtgcagtcgtgggctggaggtagaagacgccgtgggtcctgagtagtaacgtttcagacgaagtcttcgtgtacttcctccttatactttagttttctactcctagttcggtcctcgacccgccgtacccggtaccccggaagtaaacggttccgtagggtagggttcgggggtggtaacggttacggactaccggaaccgtcgtttacgacgttaacgttcggtaccttaactaaaacttaaagttacttaaccaagtaaggttaacggttcgaacggagggacctaaggtacgtacccgtaactaaacgtttacggaacggacctaactcggtaaccgacgtaaacggaccgaccgttaccgtaacgacgttaaaggngtaccggtaanacccggctaaccgtcgtagtactacggttacccgtaagaaccgtcgtacctaaggtaactttagttaccgtaccgttggggtacgaacggttagtggttccaaagggtgttaggtaaaccggttctttaaacccttacctaacgtttactaaccgtttccgaattcgggttaccggtcccggtaagggg

SEQ ID NO: 290693 - DNA, 589 bp, Homo sapiens
  misc_feature: GYAE6OF02FTR3I.18.20.B09.1.454.CMB.1.raw
  modified_base (297)..(297): a, c, t, g, unknown or other
  misc_feature (297)..(297): n is a, c, g, or t
  modified_base (355)..(355): a, c, t, g, unknown or other
  misc_feature (355)..(355): n is a, c, g, or t
  modified_base (374)..(374): a, c, t, g, unknown or other
  misc_feature (374)..(374): n is a, c, g, or t
  modified_base (406)..(406): a, c, t, g, unknown or other
  misc_feature (406)..(406): n is a, c, g, or t
  modified_base (432)..(432): a, c, t, g, unknown or other
  misc_feature (432)..(432): n is a, c, g, or t
tcagtacgagtatgcacgaccggtgctcgatttagtgtagtgtgaagggtaaagggggacccaacgaaccacgatcccgtcctaggagaagcccccagagcacaactccttaccatggactggacctggaggatcctctttttggtggcagcagccacaggtgcccactcccaggtccagcttgtgcagtctggggctgaggtgaagaagcctggggcctcagtgaaggtttcctgcaagacttctggatactccttcactagttttctatccattggctgcgccaggcccccgganaaaggcttggagtggggtgggatgggatcgaacgctgtcgaatggtctcaacaaaatnttcacagaagttgcagggnagagtcaccattacgtagggacacgactccgngagaacagcctaacatggagctgacncgagctgtatactcgtagaagacgacggcttaggtattacgttaactggttagcggtaagggtacttaggcgtaggtacgggagtacgtttacccgtttaacgtaacctttacgtaacctttacgtaacctagttcgggtacgttcggtaacggggg

SEQ ID NO: 290694 - DNA, 658 bp, Homo sapiens
  misc_feature: GYAE6OF02FZV80.18.20.B09.1.454.CMB.1.raw
  modified_base (209)..(209): a, c, t, g, unknown or other
  misc_feature (209)..(209): n is a, c, g, or t
  modified_base (219)..(219): a, c, t, g, unknown or other
  misc_feature (219)..(219): n is a, c, g, or t
  modified_base (221)..(221): a, c, t, g, unknown or other
  misc_feature (221)..(221): n is a, c, g, or t
  modified_base (228)..(228): a, c, t, g, unknown or other
  misc_feature (228)..(228): n is a, c, g, or t
  modified_base (240)..(240): a, c, t, g, unknown or other
  misc_feature (240)..(240): n is a, c, g, or t
  modified_base (290)..(290): a, c, t, g, unknown or other
  misc_feature (290)..(290): n is a, c, g, or t
  modified_base (341)..(341): a, c, t, g, unknown or other
  misc_feature (341)..(341): n is a, c, g, or t
  modified_base (360)..(360): a, c, t, g, unknown or other
  misc_feature (360)..(360): n is a, c, g, or t
  modified_base (422)..(422): a, c, t, g, unknown or other
  misc_feature (422)..(422): n is a, c, g, or t
  modified_base (468)..(468): a, c, t, g, unknown or other
  misc_feature (468)..(468): n is a, c, g, or t
tcagtacgagtatgcacgaccggtgctcgatttagtgtagtgtgagggaaggggacccgaacaaccacatccctcctgagaagccccacgagcacaactccttaccatggactggacctggaggatctcttttggtggtcgagcagccacaggtgcccactcccaggtccagctgtgcagtcgtgggctgaggtgagagccgtgggccnagtgagttcngnaagctcnggatactcttcncgttagttttctactccgtattcgcttgccgtcgacgggcccccggtaanaaacgggtcttaggacgtgggggttacggagtgggtactgtaccgacgttntacgactggtacacgtaanaaacgtttccagacgtaaacgttgacgagggtcagacgtcaacgacttagacgggacactanccgtacggagtaacacggtccgaacaggtcgtaaacgctaaggacncgaacgttcgaccgttagactacgtaggtaaaccgacgtacgggacttcggtaacttacgttaactagtcgaccggtaatagtcgttaccgtaggtcgggtaacgttacggttacctttacccgtttaaacggacctttaacgggtacccttaacggtacgttacgggttacgtaccgggttaacggggg

SEQ ID NO: 290695 - DNA, 815 bp, Homo sapiens
  misc_feature: GYAE6OF02FGYZR.18.20.B09.1.454.CMB.1.raw
  modified_base (145)..(145): a, c, t, g, unknown or other
  misc_feature (145)..(145): n is a, c, g, or t
tcagtacgagtatgcacgaccggtgctcgatttagtgtagtgtgaagggtaaaggggacccaacaaccacaagtccctcctgagaacgcccccagagcacaactccttaccgatggactggactcgtgaggatcctctttttggnggtctagcacgccacgagtcgcccactcccgagtccagtcgttgtgcagtcgtgggtctggaggtgaagaacgccgtagggtcctcgagttacgtaacggtttccgtgacgaacgtacctttcgtaggtaacttccgtttacccttacgttaaccttttacggttttttaccaacgttaccgtacggttcggtccgttccggacccgtaccccgtacccgggtacccccggaaagtaacgggtcgtttacgggtacggtggggttacggtaacgttacgtaacgtaccggaactcggtacgttactaacggttcgttaccaactaacgttaaacttcgtacgaacgtaacggttagtcgacggacggaacgtacgtacgtaccgtaacgttacgttaacggacgtactacgtacgtaccgaacgaacgaacgacgtacctaacgtacggtcgaacgtccgtacgacgacgtaccgtacgtagtaacgtacgtacgtaacggaacgtaccggaggttaccgttaaggttaacttacgtttaacgtcggtaccggtacgttaacggttacgtagacggtacggttaacgaccgtttaccgttaaccctttaacccgttaaccgttaaccgttaaccttaccgtaacgtacccggttaccgtaaccgtcgggg

SEQ ID NO: 290696 - DNA, 175 bp, Homo sapiens
  misc_feature: GYAE6OF02HL9B5.29.13.B02.1.454.CMB.1.raw
  modified_base (156)..(175): a, c, t, g, unknown or other
  misc_feature (156)..(175): n is a, c, g, or t
tcagatagagtactcacgaccggtgctcgatttagtctagcgacttagggttgggaaggtcagcgtcctaggtcagcccaaggccaacccacgtgtcacgtctgttcccgacctcctctactgctagtctgagcgggctggcaaggccgcgatagnnnnnnnnnnnnnnnnnnnn

SEQ ID NO: 290697 - DNA, 384 bp, Homo sapiens
  misc_feature: GYAE6OF02JGCLH.29.13.B02.1.454.CMB.1.raw
  modified_base (372)..(384): a, c, t, g, unknown or other
  misc_feature (372)..(384): n is a, c, g, or t
tcagatagagtactcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccacaagggcccatcggtcttcccctggcgccctgctccaggagcacctcgtgggggcacgacgcggccctgggctcgccgtggtcaaggactacttccagacagcgtactgagccgggctggcaggcgcagtagnnnnnnnnnnnnn

SEQ ID NO: 290698 - DNA, 772 bp, Homo sapiens
  misc_feature: GYAE6OF01BGA9D.48.22.B11.1.454.CMB.1.raw
tcagagtatacatacacgaccggtgctcgatttagacgacagctctaggggtcggaggtacccagtcaggactacgacgcagtacggacagtagaccggtcccgctcagctcctgggtctcctgctgctcgtgcctccaggtgccacggatgtgtccagttccgagttcgaccctagtcctccactccttccctgttcgtcgtccaggtactgtacggacgacacgagtcctccgactcgaccgttggccgggtacctaaggttcctaggggctagttaacgaaagttagttaacgccgtcggtttacgacgtccaaggaaaccctacgggtaaacgaccccttaaactcctaggaacttcgtaccgtcctacgacgtactacctacgtttcgcccacgtacggttcgggtacccgttcgtacggtcgagggtccggtcggacgacggacttccgtacgggtacctacggtactttccactctaccgacccgtagtccgacgtacgaacgtccgtttcggaccgttacgtaccttaggtaacgtagttcgttacgtaccgttaaccgtttacgttacgttcgtacctaaacgttacgggtaccggttaacgtaacgggttaacccgttaccggtaacgttaaccgttttacgggaccggtaacggggtaccgtaacgggttacgggaacgtaaccgtaccgtaaaccggttacgttcggttcggtaccgttaccggtccctacccgtagtttcccgttggttacccttaccg

SEQ ID NO: 290699 - DNA, 535 bp, Homo sapiens
  misc_feature: GYAE6OF01BM0DZ.48.22.B11.1.454.CMB.1.raw
  modified_base (310)..(310): a, c, t, g, unknown or other
  misc_feature (310)..(310): n is a, c, g, or t
tcagagtatacatacacgaccggtgctcgatttagacgacagctcagggcagtcccagtcaggacacagcatggacatgagggtcccgctcagctcctggggctcctgctgctctggctcccaggtgccagatgtgccatccagttgacccagtctccatcttccctgtctgcatctgtaggagacagagtctccatcacttgccgggccagtcagggcattagaagttattagcctggtttcagcagaaaccagggaaagcccctaaatcctgatctacgctgcatccactttgcacagtgggtccctntaggttcagcggcagcggatctgggacagatttcactctcacatcagcagcctgcagcctagagatgtgactaacttattactgtacaactagtcttaagtacgtaaccctccgtaactacttttacggacctaacggggtaccaagggttacggaagtacgtacgaaaccggaacttcggtacgggtacttacggacctaccctaagttccttgttcgtttacc

SEQ ID NO: 290700 - DNA, 653 bp, Homo sapiens
  misc_feature: GYAE6OF01C9KWQ.48.22.B11.1.454.CMB.1.raw
tcagagtatacatacacgaccggtgctcgatttagacgacagctcagggggcgagtcccaggtcgaggacacagcagtaggacatcgaggtcccgctcgacgctcctgggctccctgctgtctctgctccaggtgccaggctcgtgccatccagttgacccagtcctcccagtcttccctgtctcgcataccgtgtaggagacacgagtctccagtcacttgaccggtccagtacgaaggcagttagtaagtttagtttaacgccgtgggtttacaaggtccaaggaaacccaggggaaaccgtcccctaaactccgtagaattcgtacgcgtacgacaactcccaacgttttcgcctacgaacgtggggtccctcgtaggttcagtccggacacggcggaagtccgtagggacagtaactttcactctcacctagtccagcagcctgacgagactacgaagtatacgtcgactaacgttattacgtagtacgaactagtactttaaggttacggttaacccgttaccggtaaccgtaacgttttacggaccgacggggtaacctaacgggtacggtaagtacgtacgaaaccgtaaacggtcggtaccggtcccgttacgaccgtacctagtccgttccgtccctttacccg

SEQ ID NO: 290701 - DNA, 552 bp, Homo sapiens
  misc_feature: GYAE6OF01AT8SY.48.22.B11.1.454.CMB.1.raw
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggcagtcagggcattagaagttatttagcctggtttcagcagaaaccagggaaagccctaaactcctgatctacgctgcatccactttgcacagtggggtcccgtctaggttcagcggcagcgatctgggacagatttcactctcaccatcagcagcctgcagcctgaagactgttgactaaactttacttactgtacaactacgtacttaagttaacggttaaccccttaccgttaacctaccgtttttacggcccgtaaggggacccaagggttggagtaagtacgaaaacggtaacgtggtcgggacctaggacctaaccgattcttcggttccttctaccg

SEQ ID NO: 290702 - DNA, 499 bp, Homo sapiens
  misc_feature: GYAE6OF01CK3ST.48.22.B11.1.454.CMB.1.raw
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagagttattagcctggtttcagcaagaaaccagggaaacgcccctaaactcctgatctacgctgcatccactttgcacagtgggtccctctaggttcagcggcagcggatcgtgggacagatttcactctcaccatcagcagcctgcagcctagaagatgtgactaacttatactgtacaacagcttaagtacgtaaccctcgtactactttggaccgtagggaccaaggtgagtagtacgaaacgtaatggtcggctgcaccatctcgtctctac

SEQ ID NO: 290703 - DNA, 527 bp, Homo sapiens
  misc_feature: GYAE6OF01AU5VH.48.22.B11.1.454.CMB.1.raw
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttattagcctggtttcagcagaaaccagggaaacgcccctaaactcctgatctacgctgcatccactttgcacaggtcggggtcccgtctaggttcaggcggcagcggatcgtgggacagtatttcactctcaccatcagcacgcctgcacgcctgaagatgttgactaacttattactgtacaactagtacttaagtacgttaaccctccgtaactacgttttcggaccgtacggggtaaccagggtacggagacgtacgaaacgacgtggtaggtctacgacacctatctgtcttc

SEQ ID NO: 290704 - DNA, 522 bp, Homo sapiens
  misc_feature: GYAE6OF01EQ6QA.48.22.B11.1.454.CMB.1.raw
  modified_base (313)..(313): a, c, t, g, unknown or other
  misc_feature (313)..(313): n is a, c, g, or t
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttatttagcctggtttcagcagaaaccagggaaagcccctaaatcctgatctacgctgcatccactttgcacagtgggtcccgtntaggttcagcggcagcgatctgggacagatttcactctcaccatcagcagcctgcagccctagaagtatgttgactaacttattactgtacaacagtacttaagttacgtaaccctccgtaacctaccgttttcggaccgtaggggaacctaagggtacggagtaatacgaaacgtaacgtgtcggctggcctacatctgttcttctac

SEQ ID NO: 290705 - DNA, 492 bp, Homo sapiens
  misc_feature: GYAE6OF01BUFGP.48.22.B11.1.454.CMB.1.raw
  modified_base (313)..(313): a, c, t, g, unknown or other
  misc_feature (313)..(313): n is a, c, g, or t
  modified_base (483)..(483): a, c, t, g, unknown or other
  misc_feature (483)..(483): n is a, c, g, or t
  modified_base (485)..(485): a, c, t, g, unknown or other
  misc_feature (485)..(485): n is a, c, g, or t
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttattagcctggtttcagcagaaaccagggaaagcccctaaactcctgatctacgctgcatccactttgcacagtggggtccctntaggttcagcggcagcggatctgggacagatttcactctcaccatcagcagcctgcagcctgaagatgttgctaacttattactgtacaactagtcttaagtacgtaaccctccgtactacttttcggccagggaccaaggtgagatacgaaacgatggtgctgcacatntntctctac

SEQ ID NO: 290706 - DNA, 571 bp, Homo sapiens
  misc_feature: GYAE6OF01AZJDG.48.22.B11.1.454.CMB.1.raw
  modified_base (379)..(379): a, c, t, g, unknown or other
  misc_feature (379)..(379): n is a, c, g, or t
tcagagtatacatacacgaccggtgctcgatttagacgacagctcaggggagtccccaagtcaggacacagcatggacatgagggtccccgctcagctcctggggctcctgctgctctggctccaggtgccagatgtgccatccagttgacccagtctccatcttccctgtctgcatctgtaggagacagagtctccatcacttgccggccagtcagggcattagaagttattagcctggtttcagcagaaaccaggaaagcccctaaactcctgatcgtacgctgcatccactttgcacagtgggtcccgtctagttcagtcgcagcgatcgtaggacagattcactctcaccatcagcacgcctgcagccgtgaagntcgttgctaacttattactagtactaaagtactactaccgtttacgaccccctataccgtacccgttacccgggtaccgaacgggtaaccctaccgtaaccgtagggtaacgtaacggtttaaaaccggaaccgttacggtcggtaccgtacgtacccaacccgtacttaccgtccgttccttcttaacccg

SEQ ID NO: 290707 - DNA, 548 bp, Homo sapiens
  misc_feature: GYAE6OF01D7NGS.48.22.B11.1.454.CMB.1.raw
  modified_base (262)..(262): a, c, t, g, unknown or other
  misc_feature (262)..(262): n is a, c, g, or t
  modified_base (313)..(313): a, c, t, g, unknown or other
  misc_feature (313)..(313): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccggcagtcagggcattagaagttattagcctggtttcagcagaaaccagggaaacncccctaaactcctgatctacgctgcatccactttgcacagtcgggtccctntaggttcagcggcagcggatcgtgggacagtatttcacttcctcaccatcagcacgcctgacacgcctaggaagtattgttagactaaacttattactgtacaacagtcttaacgtacgttaaccctccgttactacgttttcggaccgtaacggggaacctaagggtggaagtaacgtaccgtaaacgtaacgtggtacggtctacgtacctactaactcgttcgtcgttaccg

SEQ ID NO: 290708 - DNA, 551 bp, Homo sapiens
  misc_feature: GYAE6OF01A5T8R.48.22.B11.1.454.CMB.1.raw
  modified_base (265)..(265): a, c, t, g, unknown or other
  misc_feature (265)..(265): n is a, c, g, or t
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttatttagccttggtttcagcagaaaccagggaaacnccctaaactcctgactctacgctgcactccactttgacacgaggtcggggtccccgtcgtaggttcacggcggcagcggatcgtgggacagtatttcactctcaccatcagcagcctgcagcctagaagtagtgttagactaacgtttattactgtacaactagtacttaacgtaacgttaacccctcgttaaccttacgttttcggaccgtacggggacctaagggtacgaagtactaacgaaacgtagtcggtggacctgactaccattactgtccttcgtacg

SEQ ID NO: 290709 - DNA, 649 bp, Homo sapiens
  misc_feature: GYAE6OF01BM91S.48.22.B11.1.454.CMB.1.raw
  modified_base (142)..(142): a, c, t, g, unknown or other
  misc_feature (142)..(142): n is a, c, g, or t
  modified_base (198)..(198): a, c, t, g, unknown or other
  misc_feature (198)..(198): n is a, c, g, or t
tcagagtatacatacacgaccggtgctcgatttagacgacagctcaggggcgaggtcccagtcaggacacgagcatggacatgaggtccccgctcgagtctcctggggctcctgctgctctggctcccaggtgcctagatgngccagtccagttgacccagtctccatcctccctgtctgcatctggtacgagacagntctcatcacttgccgggcagtccaggcaattagtaagttattagcctggttcaggcagaaaccaggaacgcccgtaaaagtcctaggaacttccgtacgcctagtacctaatcctaacgtttgacgaacgtacggtcggggtcccctagttaacggttcgaggccggcaggcgggaagtccgtagggaccagtactttcacgtcgtacaccagtcaagacacgcctgactacgacctagaaagtcgtaggtcactaacttattacgcgtacaaacgtacgtacgtttaacgtaccgttaaaccccgttccgttaaccgtacgttttacgggaacccggtaacgggggaaccctaaagggtcggtaaacgtaaccgtaccgtaaaacgtaccggttaggtacggtacgtacggtacccgaccgttaacggtccgttaacggtcgttaacccg

SEQ ID NO: 290710 - DNA, 644 bp, Homo sapiens
  misc_feature: GYAE6OF01DBFIB.48.22.B11.1.454.CMB.1.raw
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctcatcacttgccggccagtcgagggcattagaagtttatttagccttggtttcagtacaagaaaccgaggaaacgacccctaaactctagactctacgctagcactcctactttcgactacgaggttcgggtccctagttacggttcaggccggcaaggtcggatcgtagggactagtatttcactctaccacctatacacgcacgcctagactacgtcctaggaacgtagttacgtacgtaactaactttactttaactcgtaactaactacgttacttaacgttaccgttaacccgttaccgtaccgttaaccgttttacgggaccggtaacggggaacccgtaagggtacgggtaacgtaacgtaaccgtaaaacggtaacgttcgggtaaccggttaccgtacggtaccctaacccgtactttaccgttacgttccgtttaacccg

SEQ ID NO: 290711 - DNA, 519 bp, Homo sapiens
  misc_feature: GYAE6OF01B5A0L.48.22.B11.1.454.CMB.1.raw
  modified_base (410)..(410): a, c, t, g, unknown or other
  misc_feature (410)..(410): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttatttagcctggtttctagcagaaaccagggaaagacccctaaactcctgatctacgctgcatccactttgcacagtgggtcccgtctaggttcagcggcagcggatcgtgggacagatttcactctcaccatcagcagcctgcagcctgaagatgttagcaacttattactgtcaaacngtcttagtacgtaaccccttccgtaactacttttaggccgaacggggacctaaagggtggaagtactacgaaacggaactggtggactacggcaccattctgtcttacc

SEQ ID NO: 290712 - DNA, 510 bp, Homo sapiens
  misc_feature: GYAE6OF01A3MZC.48.22.B11.1.454.CMB.1.raw
  modified_base (319)..(319): a, c, t, g, unknown or other
  misc_feature (319)..(319): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttatttagcctggtttcagcaagaaaccagggaaacgcccctaaactcctgatctacgctgcatccactttgcacaggtcggggtccctntaggttcagcggcagcggatcgtgggacagatttcactctcaccatcagcagcctgcacgcctagaagtatgttagactaactttattactgtacaacagtcttaagtacgtaaccctccgtactacgtttcggaccgagggaccaaggtggaagtagtacgaaacgacgtgcgctgcacatctgtcttac

SEQ ID NO: 290713 - DNA, 684 bp, Homo sapiens
  misc_feature: GYAE6OF01CZXX2.48.22.B11.1.454.CMB.1.raw
tcagagtatacatacacgaccggtgctcgatttagacgacagctcaggggagtcccagtcaggacacagcatggacatgagggtccccgctcagctcctggggctcctgctgctctggctccaggtgccagatgtgccatccagttgacccagtctccatcttccctgtctgcatctgtaggagacagagtctccatcacttcggccggccagtcagggcagttagagttattagcctggtttcagcaacgaaaccagggaaacgccctaaactcctagatctaacgcttcgcactccactttgacacgtagtcggggttccccgtgtacgggttcaggcggtacacggcggtaactcggtaggggtaacctaggtactttacacgttctaccaaccgtactcgaacggccaacggtccctgaccgtacgaccctaggtaaacgtacgttcggttacgtaccttaaacgtttaactttaacgttcgttaaccaaacgtacgtactttaacgtaacgttaacccccgttacgttaaccttaaccggttttcgggaaccggtacggggaaacccgtaaaggggttacggaacggttaaacaaccggtaaaaccgtaaggttcggtacgggtacgttacccgactaaacccgttacttccgttacgttccgtttaccgttaaccccg

SEQ ID NO: 290714 - DNA, 485 bp, Homo sapiens
  misc_feature: GYAE6OF01E117M.48.22.B11.1.454.CMB.1.raw
  modified_base (313)..(313): a, c, t, g, unknown or other
  misc_feature (313)..(313): n is a, c, g, or t
  modified_base (482)..(482): a, c, t, g, unknown or other
  misc_feature (482)..(482): n is a, c, g, or t
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttatttagcctggtttcagcagaaaccagggaaagcccctaaatcctgatctacgctgcatccactttgcacagtgggtcccgtntaggttcagcggcagcggatctgggacagatttcactctcaccatcagcagcctgcagcctgaagatgttgctaacttattactgtcaacagcttagtagtaaccctccgtactacttttgccagggaccaaggtgagatacgaaacgactgtgctgcacatctgtctntac

SEQ ID NO: 290715 - DNA, 540 bp, Homo sapiens
  misc_feature: GYAE6OF01E35VB.48.22.B11.1.454.CMB.1.raw
tcagagtatacatacacgaccggtgctcgatttagacgacagctcaggggcaggtcccagtcaggacacagcatggacatgagggtccccgctcagctcctggggctcctgctgctctggctcccaggtgccagatgtgccatccagttcgacccagtctccatcttccctgtctgcatctgtaggagacagagtctccatcacttgccgggccagtcagggcattagaagtttatttagccttggtttcagcaagaaaccagggaaacgacccctaaaactccctagactctacgctgcatcctactttgccacgtaggttcggggtccctcgtaggttcaggcggcaggcggatcgtagggacagtactttccacttcctcacctatccacgccacgcctgccacgcctagaagtattagttagactaactttattactgtacaacagtcttaagtacgtaacccttacgttacttacgtttcggccgaggggacaggtaggagagtacgaagacgtgagctcgccacatctgtcttc

SEQ ID NO: 290716 - DNA, 523 bp, Homo sapiens
  misc_feature: GYAE6OF01DMG2X.48.22.B11.1.454.CMB.1.raw
  modified_base (392)..(392): a, c, t, g, unknown or other
  misc_feature (392)..(392): n is a, c, g, or t
  modified_base (413)..(413): a, c, t, g, unknown or other
  misc_feature (413)..(413): n is a, c, g, or t
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttggccgggcagtcagggcattagaagttatttagcctggtttcagcaagaaaccagggaaacgcccctaaactcctgatctacgctgcactcctactttgcacgtaggtcggggtccctgtaggttcagcggcaggcgatcgtgggacaggtactttcactctacacatcagcagctgcagcctagaatntgtgactaattattactgtanaactagtacttagtaacctaaccctcgtaactcgtttcggccgagggacaagggtgaagactaacgaaacgtagtggtcggtctaggccactatctgttccttcgtaccg

SEQ ID NO: 290717 - DNA, 542 bp, Homo sapiens
  misc_feature: GYAE6OF01DD7SA.48.22.B11.1.454.CMB.1.raw
  modified_base (231)..(231): a, c, t, g, unknown or other
  misc_feature (231)..(231): n is a, c, g, or t
  modified_base (387)..(387): a, c, t, g, unknown or other
  misc_feature (387)..(387): n is a, c, g, or t
  modified_base (414)..(414): a, c, t, g, unknown or other
  misc_feature (414)..(414): n is a, c, g, or t
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttnttagcctggtttcagcagaaaccagggaaacgcccctaaactcctagatctacgctgcatccactttgcacagtcgggtccctcgtaggttcagcggcaggcggatcgtgggactagatttcactctcaccatcagcagcctgcagcctagaagtntgttgctaactttattactgtacaacngtactttaacgtacgttaacccttccgtacttacgttttcgggacccgtaggggaccctaagggtggaacgtaagtaccgaaaacggtactggtacggctcgacctaccacttctcgttcttctaccg

SEQ ID NO: 290718 - DNA, 504 bp, Homo sapiens
  misc_feature: GYAE6OF01B5R8C.48.22.B11.1.454.CMB.1.raw
  modified_base (310)..(310): a, c, t, g, unknown or other
  misc_feature (310)..(310): n is a, c, g, or t
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccggccagtcagggcattagaagttattagcctggtttcagcagaaaccagggaaagcccctaaatcctgatctacgctgcatccactttgcacagtgggtccctntaggttcagcggcagcggatctgggacagatttcactctcaccatcagcagcctgcagcctagaacgatgttgctaacttattactgtcaactagtcttaagtacgttaaccctccgttactacttttcggccgaaggggaccaagggtcggagactacgaaacgacgtggtggctgacacatctgtcttctac

SEQ ID NO: 290719 - DNA, 524 bp, Homo sapiens
  misc_feature: GYAE6OF01CA8TU.48.22.B11.1.454.CMB.1.raw
  modified_base (314)..(314): a, c, t, g, unknown or other
  misc_feature (314)..(314): n is a, c, g, or t
  modified_base (378)..(378): a, c, t, g, unknown or other
  misc_feature (378)..(378): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggcagtcagggcattagaagttatttagcctggtttcagcagaaaccagggaaagcccctaaactcctgatctacgctgcatccactttgcacagtgggttccctntagttcagcgcagcggatctgggacagatttcactctcaccatcagcagcctgcagcctgaagntgttgctaacttattactgtcaacagtacttaacgtagtaaccctccgtaactacgttttacggaccgacggggtaccctaagggtcggaagtacgtacgaaaacgtaacgtggtacggcgttagcctaccattctgtctttaccg

SEQ ID NO: 290720 - DNA, 522 bp, Homo sapiens
  misc_feature: GYAE6OF01CKLQ3.48.22.B11.1.454.CMB.1.raw
  modified_base (403)..(403): a, c, t, g, unknown or other
  misc_feature (403)..(403): n is a, c, g, or t
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggcagtcagggcattagagtttattagccttggttcagcaagaaaccagggaaacgcccctaaactcctgatctacgctgcatcctactttgcacgtaggttcggggtccccgtgtaggttcaggcggcaggcggtatcgtgggacagtactttcactctcaccatcagcagcctgacacgccgtgaagtatgttnactaactttatactgtacaacagtcttaagtaactaccctacgttactacgtttcgaccgtacgggacgtaagggtggagatacgaaacgtatggtggctgctacatctcgttctctac

SEQ ID NO: 290721 - DNA, 476 bp, Homo sapiens
  misc_feature: GYAE6OF01AEXAR.48.22.B11.1.454.CMB.1.raw
  modified_base (379)..(379): a, c, t, g, unknown or other
  misc_feature (379)..(379): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttatttagcctggtttcagcagaaaccagggaaagcccctaaactcctgatctacgctgcatccactttgcacagtgggtcccgtctaggttcagcggcagcggatctgggacagattcactctcacatcagcagcctgcagcctgaagntgttgcaacttatactgtcaacagcttagacgtaaccctcgtactctttggcctagggaccaggtgagagtcaagactgtgctgcacatctgtcttc

SEQ ID NO: 290722 - DNA, 547 bp, Homo sapiens
  misc_feature: GYAE6OF01CUAOS.48.22.B11.1.454.CMB.1.raw
  modified_base (309)..(309): a, c, t, g, unknown or other
  misc_feature (309)..(309): n is a, c, g, or t
tcagagtatacatacacgaccggtgctcgatttagacgacagctcaggggagtcccagtcaggacacagcatggacatgagggtccccgctcagctcctggggctcctgctgctctggcctccaggtgccagatgtgccatccagttgacccagtctccatcttccctgtctgcatctgtaggagacagagtctccatcacttgccggcagtcagggcattagaagttattagcctggtttcagcaagaaaccagggaaagcccctaaatcctagatctacgctgcatccatttgcacagtgggccctntaggtcagcgcagcggatcgtgggactagatttcgactctacaccatcagcagcctgcacgcctaggaagcgtagttcgacctaactttatttaactgtaccaagtacgtactttaacgtaacgttaacccctccgttaactacgtttcggacccgaaggggacccgtaaagggtcgaagtaacgtaaccgaaacggaacttggtaggcctgaccaccgtatcgttcgtcttcgtacg

SEQ ID NO: 290723 - DNA, 568 bp, Homo sapiens
  misc_feature: GYAE6OF01CCXHO.48.22.B11.1.454.CMB.1.raw
  modified_base (271)..(271): a, c, t, g, unknown or other
  misc_feature (271)..(271): n is a, c, g, or t
  modified_base (338)..(338): a, c, t, g, unknown or other
  misc_feature (338)..(338): n is a, c, g, or t
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttgacccagtctccatccttccctgtctgcatctgtaggagacagagtctccatcacgttcggccgggccagtcagggctagttagaagtttattagccttggttcagcaagaaaccagggaaacncccctaaactcctagatcacgctgcatcccactttgcacgtaggtcggggtccccttgtaaggttcnggtcggcgaggcggtatcgtagggacagtactttcactctaccactatcagcagcctgactcgccttagaagtgttgtcacttaacttattactagtaactaaagttctctactttccgacccctagtaccctaccgttacgaccggtaaggacctacgtaacgtagggaactaacggttaaaccgattcggtcggactcgacctaccttattccgtacgttctcctacc

SEQ ID NO: 290724 - DNA, 516 bp, Homo sapiens
  misc_feature: GYAE6OF01CI9NC.48.22.B11.1.454.CMB.1.raw
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttatttagcctggtttcagcagaaaccagggaaagcccctaaactcctgatctacgctgcatccactttgcacagtgggtcccgtcgtaggttcagcggcagcggatctgggacagatttcactctcaccatcagcagcctgcagcctgaagatgtagctaacttattactgtacaacagtacttaagtacgtaaccctcgtacctacgtttacggcctaggggacctaagggtacggagacgtacgaaacgacgtgtacggctacgccactatcgtgtccttaccg

SEQ ID NO: 290725 - DNA, 507 bp, Homo sapiens
  misc_feature: GYAE6OF01DY6FT.48.22.B11.1.454.CMB.1.raw
  modified_base (314)..(314): a, c, t, g, unknown or other
  misc_feature (314)..(314): n is a, c, g, or t
  modified_base (504)..(504): a, c, t, g, unknown or other
  misc_feature (504)..(504): n is a, c, g, or t
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttattagcctggtttcagcagaaaccagggaaacgccctaaactcctgatctacgctgcatccactttgcacagtcgggtcccgtntaggtcagcggcagcgatcgtgggacagtatttcactctcaccatcagcagcctgcagcctgaagtatgttgactaactttattactgtacaacagtcttaagtacgtaaccctcgtactacgtttggaccgaggggaacctaagggtggagagtacgaaacgtactgtcggctgactacatctgtcttntac

SEQ ID NO: 290726 - DNA, 634 bp, Homo sapiens
  misc_feature: GYAE6OF01DNML0.48.22.B11.1.454.CMB.1.raw
  modified_base (185)..(185): a, c, t, g, unknown or other
  misc_feature (185)..(185): n is a, c, g, or t
tcagagtatacatacacgaccggtgctcgatttagacgacagctcaggggagtcccagtcaggacacagcatggacatgagggtccccgctcagctcctggggctcctgctgctctggctccaggtgccagatgtgccatccagttcgacccagtctccatcttccctgtctgcatctgtagganacagagtcctccatccacttcggccgggccagtcgagggctaattagaagtttattacgccttggtttcagacaagaaaccgaggaacgaccctaaactcctgactcctacgctgctactcctactttcgcacgtaggtcgggtcccttgtaacggttcaggtccggacacggcgtacgtcggtcgggactacgtacgttttccaccgttcctacaacctatacagaccacgtcctacgacgacgtccgtagaacgtacgtgttacgtaaccttaaactttacttactacgtaactaactaggttacttaacggttaaccgtaccccgttaccgttaaccgttacgttttacggacccggtaacgggaaccgtaagggtacgaacgtaactaaccggtaaacgtaagtggtcgcgtacgacctactacgttactcgttacttcgtaccg

SEQ ID NO: 290727 - DNA, 740 bp, Homo sapiens
  misc_feature: GYAE6OF01C4EC8.48.22.B11.1.454.CMB.1.raw
  modified_base (286)..(286): a, c, t, g, unknown or other
  misc_feature (286)..(286): n is a, c, g, or t
tcagagtatacatacacgaccggtgctcgatttagacgacagctcaggggcaggtcccagtcaggacacagcatggacatgagggtccccgctcagctcctggggctcctgctgctctggctcccaggtgccagatgtgccatccagttcgacccagtctccatcttccctgtctgctatctgtaggagacagacgtctccatcacttgccggccagtcagggctagttagtaagtttattagccgttgtttcagtacaagaaaccagggaaacgacccctaaacncctagactctacgctgctactccactttcgcacgtaggtcgggtcccgtgtagttcaggcggcaggcggacgtcgtggaactaggtacttttccgacttccgtaccaacccgtatccgtacgcctaacggtcccgttacggacccgtaacggtcccgttaaggtaaacgtaacgtttaggttacggtaacctttaaaccgtttaactttaacccgttacggttaacctaaaccgtaacggttaaccgtttaaaccgggttaacccgtttaaaccccgttaccccgtttaaccgttaaccggtttttacccgggacccgggtaaccgggggtaaaacccgtaaggggtaacgggtaacggtaaaccgttaaccgaaaacggtaacggttacggtacgggtacccgttacggtacccgtaacccgtacgttaccgttccgttacccgtttaacccg

SEQ ID NO: 290728 - DNA, 535 bp, Homo sapiens
  misc_feature: GYAE6OF01BN6E1.48.22.B11.1.454.CMB.1.raw
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttattagcctggtttcagcagaaaccagggaaagcccctaaactcctgatctacgctgcatccactttgcacagtcggggtcccgtctaggttcagcggcagcggatcgtgggacagtatttcactctcaccatcagcagcctgcagccctagaagtagtgttagactaacttattactgtacaactagtacttaagtaacgtaaccctaccgttactacgttttcggaccgtagggaccgtaagggtacggagtaacgtacgaaacgtaagtggtcggcgtagactaccactactgtcttctaccg

SEQ ID NO: 290729 - DNA, 564 bp, Homo sapiens
  misc_feature: GYAE6OF01CKJLN.48.22.B11.1.454.CMB.1.raw
  modified_base (265)..(265): a, c, t, g, unknown or other
  misc_feature (265)..(265): n is a, c, g, or t
  modified_base (322)..(322): a, c, t, g, unknown or other
  misc_feature (322)..(322): n is a, c, g, or t
  modified_base (403)..(403): a, c, t, g, unknown or other
  misc_feature (403)..(403): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccggccagtcagggcattagaagttatttagccctggtttcagcagaaaccagggaaacncccctaaatcctgatctacgctgccagtcctactttgcacgaggtcggggtcccgtntaggttcaggcggcagcggatcgtgggacagtatttcactcgtccaccatccagccacgtcctgaccagtcctaggaagtnttggttagtactaaactttattacgtagtactaacagtacctttaaggtaaccttaaccccgttcgttaaccttacgtttacggaccgtaggggaccctaagggtcgaagtagtaccgaaagtacgtggtacgtctacgactacctattcctgtccttacc

SEQ ID NO: 290730 - DNA, 571 bp, Homo sapiens
  misc_feature: GYAE6OF01CCYN2.48.22.B11.1.454.CMB.1.raw
  modified_base (323)..(323): a, c, t, g, unknown or other
  misc_feature (323)..(323): n is a, c, g, or t
tcagagtatacatacacgaccggtgctcgatttagacgacagctcagggggagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttattagcctggtttcagcaagaaaccagggaaacgccctaaactcctgatctacgctgcactcctatttgcacgtaggtcggggttccccgtntacggttcaggccggcaaggcggatcgtgggacaggtatttcactctacacatcagcagcctgcagcctagaagattgttgactaacttattactagtacaactagtacttaacgtacgttaacccgtccgttaaccgttacgttttacggaccgtacggggtaccgtaagggtacggagtaacgtaacgaaaacggtaacgttcggtcggccgtacgaccgtaccacttactcgttcttccgtaccg

SEQ ID NO: 290731 - DNA, 857 bp, Homo sapiens
  misc_feature: GYAE6OF01CNW19.48.22.B11.1.454.CMB.1.raw
  modified_base (187)..(187): a, c, t, g, unknown or other
  misc_feature (187)..(187): n is a, c, g, or t
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttgacccagtcctcatcctcctgtctgctatcgtggtagganacagtacgtcctacatctacgttcggccggaccagtcgagggtactagttaaggtaagttttagttacgtccgttaggtttacacggacaaacggaaaacccgaaaggggtaaacctacccccttaaaaccgttccgttagtaacgttacctaaccggtccgtacggacctaacctttaccccgttaacgtttttcgaccgtaaccggttacggggtttacccgggggttcccctttacggttaacgggtttaccgaacgggtccggtacgtacgggtacgggtaacgttccgggtaacggggaactaaggttacctttaccgacccgtttcctaccgaaccttaacgtaccgacgtaccgaaccgtccgtaccggaccgtacggtacccgttaaggaacgttacgttcggtttaacgtaacctttaaaccgttttaacttaaccgttacgttaacccgtaacgtaaccggtttacgtttaacggttaaacccgtttaaccccgttacccgtttaaccgttaccggtttttaccgggaacccgggttaacggggaaccggttaaagggtacgggaaacgttaaccgtaaaccggtaaaacggtacgttacgggtcgggtaccttacggaccctaccgttacttaccgtttctaccgtttcgttaaccccg

SEQ ID NO: 290732 - DNA, 819 bp, Homo sapiens
  misc_feature: GYAE6OF01CFJ5S.48.22.B11.1.454.CMB.1.raw
  modified_base (257)..(257): a, c, t, g, unknown or other
  misc_feature (257)..(257): n is a, c, g, or t
tcagagtatacatacacgaccggtgctcgatttagacgacagctcaggggagtcccagtcaggacacagcatggacatgagggtccccgctcagctcctggggctcctgctgctctggctccaggtgccagatgtgccatccagttgacccagtctccatcttccctgtctgcatctgtaggagacagagtctcatcacttgccgggcagtcagggcattagattattagcctggttcagcaagaaacagggaaacnccctaaatcctagactctaacgcgtacgcaactccactttcgacacgtaacggttcgggggtccccgttacgttaacgggtttccgaaggtcccggggtacgaacggggacccgggtaagttccggttacggggggaacctaagggtaaactttttccgaaacctttctaccgaaaccctaattacccgacgtccgtaaacggcccgttacggacccgtacggtaccccgttagggaaacggtaacgtttggtttaacgtaaccggttaaaaccttttaacgtttaaacgttcggttaaactaaaccgtaacggttaaccgtttttaaacgggttaaccggtttaaaacccccgtttaccccggtttaaacccgtttaaccgttttttaccggggaacccggtaaccggggggtaaaccccgtaaagggggttacgggtaaacggtaaacgttaaaccggtaaaaaccgggttaaacggttacggtttacggggaacccgttacgtaacccgtaacccgtaacgtttacccgttacggtttacccgttcgtttaaacccccg

SEQ ID NO: 290733 - DNA, 576 bp, Homo sapiens
  misc_feature: GYAE6OF01DT8VX.48.22.B11.1.454.CMB.1.raw
  modified_base (313)..(313): a, c, t, g, unknown or other
  misc_feature (313)..(313): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccattccagttgacccagtctccatcttcctgtctgcatctgtaggagacagagtctcatcacttgccgggccagtcaggcattagagttatttagccttggtttcagtcagaaaccagggaaacgcccctaaactcctgatctacgctgcatccatttgcacagtgggtccctntaggttcagcggcagcgatcgtgggacagatttcactctcacatcagcagcctgcagcctagaacgattgttgactaaactttattactgtacaacagtactttaagtaacgttaaccccttccgttaaccttaccgtttttagggaccctaagggggtaaccctaaaggggttcgggaagtaacgttaccgaaaaacggtaacgttaggtacgggtacctacgggtacctaacccgtatttacccgtggttcctttaacccg

SEQ ID NO: 290734 - DNA, 815 bp, Homo sapiens
  misc_feature: GYAE6OF01D6BXN.48.22.B11.1.454.CMB.1.raw
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttcgacccagtctccattcttccctgtctgcatctgtaggagacagacgtctccatcacgttcgccggccagtcgagggctagttagtaagtttattagccttggttcagtacaagaaaccgaagggaacctacccctaaatcctagactctacgctgacctactcctactttcgaccgtacgtacgggttccggggttccccttagttaacgggttccgaacgggccggacgtacgggtacggtaacttcggtacggggtaactaaggttacttttaccaaccgtttcccttaccaacccgtaacgttccgaacggtaccgtaaccgtcccgttacggaccgtaaccggtacccgttaaggaaacggttacggtttacggtttaacgtaaccctttaaaccgttttaacgtttacccgttaacggttaacctaaaccgtacggtttaaccgttttaaaccggttaacccgtttaaacccccgttaacccgtttaaccgtttaacccggttttaccggggaacccggtaacgggggtaaacccgtaaaggggttaccggtaaacggtaaaccgttaaaccggtaaaaccggttacgttacgggtaccggtaccgtacggtaacccgtaaccttaacgtttaccgttacgtttcccgttacgttaaccccg

SEQ ID NO: 290735 - DNA, 666 bp, Homo sapiens
  misc_feature: GYAE6OF01CQC0C.48.22.B11.1.454.CMB.1.raw
  modified_base (184)..(184): a, c, t, g, unknown or other
  misc_feature (184)..(184): n is a, c, g, or t
tcagagtatacatacacgaccggtgctcgatttagacgacagctcaggggagtcccagtcaggacacagcatggacatgagggtccccgctcagctcctggggctcctgctgctctggctccaggtgccagatgtgccatccagttgacccagtctccatcttccctgtctgcatctgtagganacagagtctccatcacttgccggcagtcaggctattagaagtttattagccttggtttcagacaacgaaacgaagggaaacgcccctaaatcctagatctacgctgcactcctactttgcacgtacggtcgggtcccgtgtaggttccaggccggcaggcgagtccgtagggacaggtacttttcgaccttctaccgtaacctctacgagccaaccggtcctacggacctaacgcccgttaaggaaacgtacgttcggtttacgaccttaaacttttacttacgtacgttacaaacgtgtacgtttaacgtaaccgttaaccccgttaccgttaacgttaccgttttacgggaacccggtaggggtaaaccgtaagggtaacggtaacgtaactaacccgggaaaaccgttaaggtacggttcggaccttaccgggtacctaaacccgttagtttcccgttacgttccgtttacctaacccg

SEQ ID NO: 290736 - DNA, 566 bp, Homo sapiens
  misc_feature: GYAE6OF01ESWW2.48.22.B11.1.454.CMB.1.raw
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccggccagtcagggcattagaagtttattagcctggtttcagcaagaaaccgagggaaacacccctaaactcctagactctacgctgcatcctactttgcacgaggtcgggtccctcgtaggttcagcggcaggcggatcgtagggacagtactttcacttctacacctatcagcacgcctgcagcctagaagtatgttacgactaacttattactgtacaactacgtacgttaacgtacgtaaccctaccgttaacgttacgttttacggaccggtaacggggtaccgtaagggttacggaagtacgtaacgtaaacgtacgtggtcggtactacgtaccacctattcgttgtcttaccg

SEQ ID NO: 290737 - DNA, 668 bp, Homo sapiens
  misc_feature: GYAE6OF01B69H8.48.22.B11.1.454.CMB.1.raw
  modified_base (186)..(186): a, c, t, g, unknown or other
  misc_feature (186)..(186): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtagganacagagtctcatcacttcggccggccagtcgaggcattagaagtttattagcgttgtttcagcaagaaaccgagggaaacgacccctaaactcctgatctacgctgctactcctactttgactacgtagggtcgggtcccgttcgtaggttcacggcggacgaggcggtactcgtagggaacaggtactttccacttcctcacctatacacgcacgcctgaccacgtcctaggaagtacgttagttacgtaactaacttttaacgttacttacgtaacaaacgtacgttacgttaaacgttaacccgttaaacccgttacccggttaacctttaccgttttaccgggaacccggtaacgggggtaaccgtaaacggggttacggaaacggttaacgtaaccggtaaaaacgggttaccggtagggttaccggtacgtaccgtaccgtaacccgttagtttccttacggtttcccttaacccg

SEQ ID NO: 290738 - DNA, 495 bp, Homo sapiens
  misc_feature: GYAE6OF01BE3G3.48.22.B11.1.454.CMB.1.raw
  modified_base (384)..(384): a, c, t, g, unknown or other
  misc_feature (384)..(384): n is a, c, g, or t
  modified_base (390)..(390): a, c, t, g, unknown or other
  misc_feature (390)..(390): n is a, c, g, or t
  modified_base (485)..(485): a, c, t, g, unknown or other
  misc_feature (485)..(485): n is a, c, g, or t
  modified_base (492)..(492): a, c, t, g, unknown or other
  misc_feature (492)..(492): n is a, c, g, or t
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttatttagcctggtttcagcagaaaccagggaaagcccctaaactcctgatctacgctgcatcccactttgcacaggtgggtcccgtctaggttcagcggcagcggatcgtgggacagatttcactctcaccatcagcagcctgcagcctagaagntggttnactaacttattactgtcaactagcttagtactaaccctccgtactactttggccgagggacaggtgagatacgaaacgatgtcggctgctacatntcgtctntcc

SEQ ID NO: 290739 - DNA, 511 bp, Homo sapiens
  misc_feature: GYAE6OF01EKBRR.48.22.B11.1.454.CMB.1.raw
  modified_base (506)..(506): a, c, t, g, unknown or other
  misc_feature (506)..(506): n is a, c, g, or t
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttattagcctggtttcagcagaaaccagggaaagcccctaaactcctgatctacgctgcatccactttgcacagtcggggtcccgtctaggttcacggcggcagcggatcgtgggacagatttcactctcaccatcagcagccgtgcagcctgaagatgttgactaacttattactgtcaacagtacttaagtaacgtaaccctccgtactactttggaccgaggggaccaaggtggagagtacgaaacgtatggtcggctcgctaccatactgtctntaccg

SEQ ID NO: 290740 - DNA, 560 bp, Homo sapiens
  misc_feature: GYAE6OF01C6SZE.48.22.B11.1.454.CMB.1.raw
  modified_base (379)..(379): a, c, t, g, unknown or other
  misc_feature (379)..(379): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttcctgtctgcatctgtaggagacagagtctccatcacttgccggcagtcagggcattagagttattagcctgttcagcagaacaggaacgcccctaaatcctgatctacgctgcatccactttgcacgagtcgggtcccgtgtacggtcagcggcaggcgatcgtagggacagtacttcactctacaccatcagcacgcctgcagcctagaagtnttgttagactaacttattactagtaccaactacgtactttaacgtaccgttaaccccttcgtaaccttacgttttcgggacccgtaacgggggtaacccgtaagggtcggtaagtacgtaaccgaaacgggttactgggtacgtacgtacgtacctaaccgtattaccgtgttccttaccg

SEQ ID NO: 290741 - DNA, 513 bp, Homo sapiens
  misc_feature: GYAE6OF01CJ9Y5.48.22.B11.1.454.CMB.1.raw
  modified_base (186)..(186): a, c, t, g, unknown or other
  misc_feature (186)..(186): n is a, c, g, or t
  modified_base (319)..(319): a, c, t, g, unknown or other
  misc_feature (319)..(319): n is a, c, g, or t
  modified_base (387)..(387): a, c, t, g, unknown or other
  misc_feature (387)..(387): n is a, c, g, or t
  modified_base (493)..(493): a, c, t, g, unknown or other
  misc_feature (493)..(493): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtagganacagagtctccatcacttgccgggccagtcagggcattagaagttatttagcctggtttcagcagaaaccagggaaagcccctaaactcctagactctacgctgacatccactttgcacgagtgggtcccgtntaggttcagcggcagcggatcgtggacagtatttcactctcaccatcagcagcctgcagcctgaagtntgttagactaacttatatttcgtcagcagggtacacgtacgtttcccaccgttacgttacggcggtacgggccgagggtcggacgtacgaaacggactggtcggcngcacctatctgtcttgtacc

SEQ ID NO: 290742 - DNA, 683 bp, Homo sapiens
  misc_feature: GYAE6OF01DG2OT.48.22.B11.1.454.CMB.1.raw
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccggcagtcagggcattagagttatttagctggttcagcaagaaaccagggaaacacccctaaactcctagactctacgctgcactcctactttcgacacgtaggtcggggtcccgtacgtacggttcaggcggcgaggcggtatcgtagggacagtactttcactctacacatcacgcacgcctgacacgtcctaggaagtagttcggttacgaccttaaacgtttactttaccgttacgttaaccaaacgttacggttaacctttaacgggttaaacccgttaaacccccgtttacccggttaaccgtttaccggtttttaccggggacccggtaacgggggtaaaccccgtaaaggggtccgggtaaaggtaacccgttaaaccgaaaaccggttaaccggttcgggttaccgggtaccgttacggtaaccccgtaaccgttacgtttaccgtttcggtttacccttttaacccg

SEQ ID NO: 290743 - DNA, 551 bp, Homo sapiens
  misc_feature: GYAE6OF01CZZUL.48.22.B11.1.454.CMB.1.raw
  modified_base (263)..(263): a, c, t, g, unknown or other
  misc_feature (263)..(263): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagagttatttagctggtttcagcagaaaccagggaaacncccctaaatcctgatctacgctgcactccactttgcacgtaggttcggggtccccttcgtacggttcagtcggcaggcggatcgtgggactagtactttcactctcacatcagcacgtcctgccagtcctaggaatacgttgttcgtactaactttacttactagtaccaactacgtacttacgtaaccgttacccttacgttactacgttttcggaccgtaaggggacctaagggtggagaacgtaccgaaagtacgtgcggctacgccacattccgtgtcttaccg

SEQ ID NO: 290744 - DNA, 830 bp, Homo sapiens
  misc_feature: GYAE6OF01BSNE5.48.22.B11.1.454.CMB.1.raw
  modified_base (186)..(186): a, c, t, g, unknown or other
  misc_feature (186)..(186): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcctcctgtctgcatctggtggganacagagtccaccctcacgttcggccgggacaacgtcgaggtccctatttacctaatttctttacgtcccgttggttacttacgacgacgaaacgaaaacccgacggaaacctaaaacctaccctaacctaacctccttacgaacttacctaatacggtaacttcggtccgttaccgtaaggtttaacggtaacgggtacgggtccgggggaccccctaaggttaccgggtacggtttaccgaacgggtcccgggacgtaacggttagggaacgttacgggaaggggaacgtaaggtaacggtttaccgtaacgtttccctaccaacccgtaacgttcccgaacggtaccgaaccggttcccgacggtaaccgaccgttaccgtaacggttaacgttacgtttttacgaacctttaaacgtttaacctttacgttacgttaaacctaaccttaaaccttttaaacctaaccctttaaccctacgttaaaccgttacggttaacccggttacccgggaaaccggtaacccgggtaacccggtaaacgggtaaaccggtaaaaccggtaaacggaaccggtaacggttcgggtacggtaccttacggtaacccgtaccgttacttaccggttcttaccgtttacccg

SEQ ID NO: 290745 - DNA, 592 bp, Homo sapiens
  misc_feature: GYAE6OF01AY5OR.48.22.B11.1.454.CMB.1.raw
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttatttagcctggtttcagtcaagaaaccagggaaacgcccctaaactcctgatctacgctgcatccactttgcacgaggtcgggtcccgtcgtaggtcaggcggcaggcggatcgtagggactaggtactttcacgtctacaccatcacgcacgcctgcacgcctagaagtagtgttacgactaacttattactgtacaacgtacgtctttaacgtaaccgttaacccgttaccgttaccgttacgttttacggaccgtaacggggtaccgtaaggggtacggtaaggtaacgtaaccgtaaaacggtacgttggtacggactacggtaccctacgtacgttcgttcgttccgtttaacccg

SEQ ID NO: 290746 - DNA, 734 bp, Homo sapiens
  misc_feature: GYAE6OF01AT5BC.48.22.B11.1.454.CMB.1.raw
tcagagtatacatacacgaccggtgctcgatttagacgacagctcagggggagtcccagtcagggacacagcatggacatgagggtccccgctcagctcctggggctcctgctgctctggctcccaggtgccagatgtgccatccagttcgacccagtctccatcttccctgtctgcatctgtaggagacagagtcctcatcacgttcggccgggccagtcgagggctagttagtagttattagccttggtttcagcaagaaaccgagggaaacaccctaaactcctagatctacgctgcactcctactttcgactacgaggtcgggtcccgtcgtaggttcacgcggcgagcggtatcgtgggacgtacgtactttacactacctacaccctagtaccacggtccaacggtcccgtagaccgtacgtaccgtaaggtaacgttacgtttacggttacctaacgttaaaccttttacgtttaaccgtttaccgttaaacccttaaaccgtttaaaacccttttaaaccgttaaaccctttaacccccttaacgtaaccggtttaaaccggttcccccgggttaaaccgggtaccccggtaaaccggggtacccccgttaaaggggttaacccggaaaaacccgtaacgggaccggttaaaccggttcgggtaacggtccgtaccgtacccgaaccgtacttacgttccgttaacttcccgttacgttacccccg

SEQ ID NO: 290747 - DNA, 596 bp, Homo sapiens
  misc_feature: GYAE6OF01EV88D.48.22.B11.1.454.CMB.1.raw
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgcccgggccagtcagggcattagaagtttatttagccttggtttcagcaagaaaccagggaaacacccctaaactcctgatctacgctgccatcctactttgcacgaggttcgggtccctcgtaggttcaggcggcaggcggtatcgtagggaactagtatttcacttctacaccatcagcctacgcctgacacgtcctagaagtattgttacgacttaactttattaccgtgtacaacgtagtaccgtttaagtaccgttaaccccgttaccgttaaccgttaccgttttacgggacccgtaaggggtaaccgtaaggggttcggaacgtaacgtaaccgaaaacggtacgtggtaccgtctacgaccaccgtattcgttcgtccttaccg

SEQ ID NO: 290748 - DNA, 508 bp, Homo sapiens
  misc_feature: GYAE6OF01BVOBM.48.22.B11.1.454.CMB.1.raw
  modified_base (409)..(409): a, c, t, g, unknown or other
  misc_feature (409)..(409): n is a, c, g, or t
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttattagcctggtttcagcagaaaccagggaaacgcccctaaactcctgactctacgctgcatccactttgcacagtcggggtcccgtcgtaggttcagcggcaggcggatcgtgggacagtatttcactctcaccatcagcagcctgcagccctagaagatgttcgctaacttattactntacaacagtcttaagtacgtaccctccgtactacgtttcggaccgtagggaccaggtggagtactacgaacgtactggtgctgctacatctctctctac

SEQ ID NO: 290749 - DNA, 534 bp, Homo sapiens
  misc_feature: GYAE6OF01AT25X.48.22.B11.1.454.CMB.1.raw
  modified_base (186)..(186): a, c, t, g, unknown or other
  misc_feature (186)..(186): n is a, c, g, or t
  modified_base (392)..(392): a, c, t, g, unknown or other
  misc_feature (392)..(392): n is a, c, g, or t
  modified_base (506)..(506): a, c, t, g, unknown or other
  misc_feature (506)..(506): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtagganacagagtctccatcacttgccggccagtcagggcattagaagttattagcctggtttcagcagaaaccgagggaaacgacccctaaactcctgtatctacgctgcactcctactttgcacgagtcggggtcctcgtacggttcagcggcacgcgatcgtaggacagtacttcactctcactatcagcagcctgcagcctagaagtntgttacgactaacttatacgtgtacaactagtcttaagtaccgtaaccctcgttacctacgtttcggaccgtacgggaccaaggtcgaacgagtaaccgaagtacgttgacggntaccgactacctagtctcgttcttaccg

SEQ ID NO: 290750 - DNA, 645 bp, Homo sapiens
  misc_feature: GYAE6OF01BOUNW.48.22.B11.1.454.CMB.1.raw
  modified_base (261)..(261): a, c, t, g, unknown or other
  misc_feature (261)..(261): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccggcagtcagggcattagaagttattagcctggttcagcagaaaccagggaaacncccctaaactcctgactctacgctgcatccactttgcacgaggtcgggtcccgtgtacggttcacggcggcaggcggatcgtgggaactaggtactttaccaccgttcctaccacctaattccaacggccaacggtcccctggacccaaggtccctaggaaacgtattggttacgtacctaaactttattaccgtagtaccctaaacgtagttacctttaaggtaacccgttaaaccccttacccgttaaccttaaccggttttccgggacccgtaacgggggtaacccgtaagggtacggtaagtaaccgttaaccgaaaaccggtaacgtcgggttacggaccgttacggaccgtaacctacgttcgttcgttcctttaccg

SEQ ID NO: 290751 - DNA, 612 bp, Homo sapiens
  misc_feature: GYAE6OF01EU4I1.48.22.B11.1.454.CMB.1.raw
  modified_base (266)..(266): a, c, t, g, unknown or other
  misc_feature (266)..(266): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcgagggcattagaagttattagcctggtttcagcaagaaaccagggaaacncccctaaactcctgactctacgctgcactcctactttgcacgaggtcggggtccccgtcgtaggttcaggcggcaggcggatcgtgggacagtatttcactctcaccatcagcacgcctgcacgtcctagaagtatgttacgactaaactttattacctgtaccaacgtagtactttaacgtaaccgttaaccccgttacccgttaaccttaccgttttacgggacccggtaacgggggaacccgtaaaggggttacgggtaaacggtaacgttaaccgaaaacggttacggttagggtacggtacctacggacctaaccgtaatttccgttcgttcctttacccg

SEQ ID NO: 290752 - DNA, 623 bp, Homo sapiens
  misc_feature: GYAE6OF01BP10N.48.22.B11.1.454.CMB.1.raw
  modified_base (415)..(415): a, c, t, g, unknown or other
  misc_feature (415)..(415): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttattagcctggtttcagacaagaaaccagggaaacgcccctaaactcctgatctacgctgcactcctactttgccacgtagggttcggggtccccgttctaggttcaggcggcaggcggatcgtgggactaggtactttccacttctaccaccatcacgcacgcctgcagcctagaagtattgtnactaactttattactgtaccaagtacgtacgtttaacgtaaccgttaaccccgttaccgttaactttaccgtttcgggacccggtaagggggtaacccgtaaaggggttcgggaaacgtaacgtaaccgtaaaaacgggtaccggttagggtccgggtacccttacggtaccctaacccgttatttcccgttcgttaccctttacccg

SEQ ID NO: 290753 - DNA, 605 bp, Homo sapiens
  misc_feature: GYAE6OF01DLZYW.48.22.B11.1.454.CMB.1.raw
  modified_base (350)..(350): a, c, t, g, unknown or other
  misc_feature (350)..(350): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatccttccctgtcctgcatctgtaggacacagagtctccatcactcggccgggccagtcagggctagttagagttattagcctggtttcagtcaagaaaccgagggaaacgccccctaaactcctagacttcgtacgctgctactccactttgcacgagtcggggtccctctaggttcagcggcaggcgntcgtaggactagtacttcgactcctccaccatccagtccacggtccgtggaccacggtcctaaggaaaggtacttggttacgtacctaagtttcttacgtcgttactaactagtaccgtttagtaaccgttaacccttccgttaacttaccggtttttacgggaccgtaagggggaacccgtaaggggtcgtaacgactaaacgaaacgtacgtcggtacgtccgacgtaccacctactcctggttccttacccg

SEQ ID NO: 290754 - DNA, 669 bp, Homo sapiens
  misc_feature: GYAE6OF01BJUYW.48.22.B11.1.454.CMB.1.raw
  modified_base (277)..(277): a, c, t, g, unknown or other
  misc_feature (277)..(277): n is a, c, g, or t
  modified_base (433)..(433): a, c, t, g, unknown or other
  misc_feature (433)..(433): n is a, c, g, or t
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttgacccagtctccatccttccctgtctgcatctggtaggagacagtagtctccatcacgttcggccgggcagtcgagggctagttagaagtttattagccttggtttcagcaacgaaaccgaggggaaacncccctaaatcctagactccgtacgctcgctactcctacgtttcgacctacgtacggttcggggttccccttcgttagggttccaggtccggactaggccgggtatccggtagggactaggtacttacactcgaccaccagtccagtccacggtccngccgacgcctagaagtattgttacgacttaacgtttattacgtcgtacaacgtagttaccgttaaggtaaccgttaaccccgttccgttaacgtttaccggtttcgggaaccccggtaacggggtaccgaaggggttacggtaaaccgaacgttaaaccggaaaacggtgttacgggttaccggtctaccgggtaccctacgttactttaccgttccgtttaccttaccggtaccc

SEQ ID NO: 290755 - DNA, 650 bp, Homo sapiens
  misc_feature: GYAE6OF01D2APV.48.22.B11.1.454.CMB.1.raw
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccggccagtcagggcattagaagtttattagcctggtttcagcaagaaaaccagggaaacgcccctaaaactcctgatctaacgctgcactcccactttgccataggtcggggtcccctgtaaggttcaggtccggcacggcgggtaactcggtacgggactaaggtactttcgaaccttctactacccgattcgaacgcacgcctgaccagtcctagaagtagttgttacgacttaactttattacgttagtacaaacgtacgtacgttaacggtaaccttaaccccgttaccgttaacttaccgtttttcgggaaccccggtagggggtaaccctaaaggggttcggaaaggtaaccgtaaacgaaaaccggtaaccgttgggttcggaccgttacgggacccaaaccgttacgttacctttcggttacctttcgttaaccccg

SEQ ID NO: 290756 - DNA, 576 bp, Homo sapiens
  misc_feature: GYAE6OF01DYMZ0.48.22.B11.1.454.CMB.1.raw
  modified_base (311)..(311): a, c, t, g, unknown or other
  misc_feature (311)..(311): n is a, c, g, or t
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagtttattagccttggttcagcaagaaaacccgagggaaacgcccctaaactcctagactctacgctgcactcctactttgcacnggttcggggtcccctgtaggttcaggtcggcaggcggatcgtgggacagtatttcactctacacatcagcagcctgcacgccctagaacgtagtcgttgtactaactttattactgtactaacgtagtcgttaacgttaacgttaacccgttaccgttaacttacgttttcggaccgtacggggtaaccgtaagggtggaacgtagtaaccgtaaaacgtagtaggtcggaccgtagaccgtacctattcttcgttcttctaccg

SEQ ID NO: 290757 - DNA, 632 bp, Homo sapiens
  misc_feature: GYAE6OF01CDWG8.48.22.B11.1.454.CMB.1.raw
  modified_base (187)..(187): a, c, t, g, unknown or other
  misc_feature (187)..(187): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatccttccctgtctgcatctgtagganacagagtctccatcacttgccggccagtcgagggctaagttagaagttatttacgccttggtttacagacaagaaaccgaagggaaacacccctaaactcctagactctacgctgctatcctactttgactacgaggtcgggtccgtctaggtcagcggcagcgatcgtggactagtactttcactctacacatcagcacgcctagctacgctagaacgtattcgtacgtacttaactttacttaacgttacgtactaaacgtacgttacgttaaacgttaccgttaaaccccgttaccgttaaccgttacgttttaccgggaccggtaacggggtaaccgtaaacggggtcggtaaagtaaccgtaaaccggtaaaacggttaacgtcggtacgggtacctacggtacctaaccgttacgtttaccttcggttcctttaacccg

SEQ ID NO: 290758 - DNA, 560 bp, Homo sapiens
  misc_feature: GYAE6OF01AT9ZK.48.22.B11.1.454.CMB.1.raw
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcgagggcagttaagaagttatttagcctggtttacagtcagaaaccgagggaaacgcccctaaactcctagactctacgctgcactccactttcgcacgtacggtcgggtcccgtactaggttcagcggcacgcggatcgtgggactagtactttcactctcaacatcagtcagtcctcgcgacgcctagaacgtatgttacgactaactttacttactgtactaacctagtacttaacgtacgttaaccctccgttaactacgtttcggaccgaagggtaccgaagggtacgaagacgtaccgaaacgtacgtcgacgtcgtacgtacactagtctgttcttcc

SEQ ID NO: 290759 - DNA, 501 bp, Homo sapiens
  misc_feature: GYAE6OF01CF775.48.22.B11.1.454.CMB.1.raw
  modified_base (380)..(380): a, c, t, g, unknown or other
  misc_feature (380)..(380): n is a, c, g, or t
  modified_base (482)..(482): a, c, t, g, unknown or other
  misc_feature (482)..(482): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccggccagtcagggcattagaagttattagcctggtttcagcagaaaccagggaaagcccctaaactcctgatctacgctgcatccactttgcacagtcggggtcctctaggttcagcggcagcggatcgtgggacagtattcactctcacatcagcacgcctgcagcctgaagnttgtagactaacttattactgtacaactagtcttaagtacgtaaccctcgtactacgtttggacctagggaccaggtgagtacgtacaaacgtactggtcgntcgacacatctgttctacg

SEQ ID NO: 290760 - DNA, 685 bp, Homo sapiens
  misc_feature: GYAE6OF01BW4Q7.48.22.B11.1.454.CMB.1.raw
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagatctcatcacttgccggcagtcagggcattagaagttattagcctggtttcagcaagaaaccgaggaaacacccctaactcctgatctacgctgctatccactttgctacgaggtcgggtccctgtacggttcacggcggcaggcggtatcgtcgggaactagtactttcaccgttcctacgaaccctattccgaagtcctaacggcccttacggacctacgacccgttaggaaacgtagttcggttactaccgttaaaccttttacgttaccgttacgtaaccgtaacctacgttaccgtttaaacggttaacccgttaaacccccgtttaccggttaaccgtttacccggttttacggggacccggtaacgggggtaaacccctaaggggtaccggtaaacggtaacgtaaacccggtaaaacggttacgttacgggtacggtacccgttacgtacccgtaccctaagtttcccttacggttcctttaacccg

SEQ ID NO: 290761 - DNA, 690 bp, Homo sapiens
  misc_feature: GYAE6OF01DMQ1U.48.22.B11.1.454.CMB.1.raw
  modified_base (139)..(139): a, c, t, g, unknown or other
  misc_feature (139)..(139): n is a, c, g, or t
  modified_base (192)..(192): a, c, t, g, unknown or other
  misc_feature (192)..(192): n is a, c, g, or t
  modified_base (202)..(202): a, c, t, g, unknown or other
  misc_feature (202)..(202): n is a, c, g, or t
tcagagtatacatacacgaccggtgctcgatttagacgacagctcaggggagtcccagtcaggacacagcatggacatggagggtccccgctcagctcctgggggcctcctgctgctctggctcccaggtgccagatgngccatccagttcgacccagtcctccattccttccctgtctgcatctgtagganacagacgtcnccatcctacgttcggcccgggccaggtcgaagggtctaagttaaggtaaagttttattttacgtccctttagggttttcaacgacaaggaaaaaccgaagggaaaccgacccctaaaactcctagattacctaacggctcgacctaactcctaactttcgacctaacgaggttcggggtcccgttacgtagggttacaggtcgcgaaggcggagttaccgtggggaacagttactttacaacctctacaacctataccgacgtacgacgcctgacacgtacctgtaaagagttagtagacttaaactttacttacgtagtaacaactagtacttaacgtaacgttacccgtacgttaacgtacgttttcggaccgtacggggaacctaagggttaggaacgtaacaaacgtaaaccgtaaggtacggttacgggaccgttacggacctaaacccgtacttaccgtttcggttacctttccgtaacccg

SEQ ID NO: 290762 - DNA, 590 bp, Homo sapiens
  misc_feature: GYAE6OF01EG8XQ.48.22.B11.1.454.CMB.1.raw
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggcagtcagggcattagaagttattacgccttggtttcagcaagaaaccaagggaaacgcccctaaactcctagactcctacgctgctactcctactttgcacgtagggttcggggtcccgtgttaacggttcaggcggacaggcggatcgtagggacagtattcactctacaccatcagcacgcctgcacgccgtagaacgtatgttcaccttaactttacgttactcgtacaacgtagtacgtttaacgtaaccgttaaccccttacgttacttaccgttttcgggaccgtaacggggaccgaagggtcggaacgaacgtaaccgaaacgtaagtacggtcggacgtacgaccgtacctactaccttcgttcctcgtaccg

SEQ ID NO: 290763 - DNA, 643 bp, Homo sapiens
  misc_feature: GYAE6OF01AJBJE.48.22.B11.1.454.CMB.1.raw
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagtttatttagccttggttcagcaagaaaccgagggaaacgacccctaaactcctagactctacgctcgcactcctactttcgcacgtaggtcgggtccccgttcgtacggttcgacggcggcgaggcggatcgtagggactagtactttcacttctaccaccatcgacgcacgccgtcgcacgaccgtagaagtagtgttacgtactaacttacttactacgtactaactacgtcttaaaaaaaaaaaacgttccgttaacccgttaccgttaccgttaccgtttacggtaccggtacgggtaaccggtaacgggtacggtaacggtaacgtaaccgtaaaccggtaacgttacggtcggtaccgtacggtacccgtaaccgtacgttaccgttccgtttccgttaccgttacccg

SEQ ID NO: 290764 - DNA, 942 bp, Homo sapiens
  misc_feature: GYAE6OF01BNFLH.48.22.B11.1.454.CMB.1.raw
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttcgacccagtctccatccttcctgtctgctatctggtaggagacagacgtcctccattccacgttcggcccgggtccaggtccgaggggtctaagttaaggtaagttttacgttttacgccgtttgggtttacaggtaccgaaacggaaaacccggaaacggggtaaaaccgtaacccccttaaaaccttccgtagtaacttacccgtaccgtccgtcgtacctaccttaccctaacgttttcgaccgtacggtacgggttccggggttaccccgtttacgttacgggttacgacggccgggacgtacgggcggtaagttcggtacggggtaacctagtttaacgtttcccaacctttacctaccaacccgtaacgttacccgaacggtacccgtaaccggtcccgtaaccgggtacccggaaccggttaaccccggttaaagggtaaacgggttaccgtttacgggtttaaccggttaaccctttaaaacggttttactttaaccgtaccggtttaaactaaacccggttacggttttaacccgtttaaccggttaaaccccgtttaaacccccggtttacccgttttaaaccggtttaaccccgggtttttacccggggaaacccgggggtttaaaccggggggtaaccgtaaaggggggttaaaccggtaaaggttaaacccgggttaaacgtaaaacccgggtttaacgggttacggttacgggggtacccctaggggttaaccctaaccttacgggtttcccttaccggttacccttttcggttacccccg

SEQ ID NO: 290765 - DNA, 624 bp, Homo sapiens
  misc_feature: GYAE6OF01DFF2N.48.22.B11.1.454.CMB.1.raw
  modified_base (233)..(233): a, c, t, g, unknown or other
  misc_feature (233)..(233): n is a, c, g, or t
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacgttgccgggcagtcgaggctattagtaagttnttagccttggttcagacaagaaccgtagggaacaccctaaactccagacttctacgctgacacgtacctacttgacgtatacgggtcgggtcctcgtaggtcagcgacaggacgatcgtagggactagtacttccacgtcactacagtccagcacgtccgtagacgtacggtacgtagaagtgttacgttacgtaacttaactttaattacgtcgttaacaaccgtagttaacttaacggtaaccgttaacccgttcgttaaccgtttacggtttaaccgggaccgtaacgggggtaacgtaagggtcggtaacgtaacgtaaccgtaaacggttaacgttcggtacgtacgtcgaacccgtctaactttaccgtcttacctcgttaaccc

SEQ ID NO: 290766 - DNA, 530 bp, Homo sapiens
  misc_feature: GYAE6OF01CNNMO.48.22.B11.1.454.CMB.1.raw
  modified_base (383)..(383): a, c, t, g, unknown or other
  misc_feature (383)..(383): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttatttagcctggtttcagcagaaaccagggaaagcccctaaactcctgatctacgctgcatccactttgcacagtgggtcccgtctaggttcagcggcagcggatctgggacagatttcactctcacatcagcagcctgacagcctagaagtntgtgctaacttattactgactaacagtactttaagtacgtaaccctccgtactacttttggacccgtaggggaccaagggtcggaagtaacgtaccgaaaacgtaacttggtacggctacgaccaaccattcctggttcccttaccg

SEQ ID NO: 290767 - DNA, 622 bp, Homo sapiens
  misc_feature: GYAE6OF01BDVF4.48.22.B11.1.454.CMB.1.raw
  modified_base (271)..(271): a, c, t, g, unknown or other
  misc_feature (271)..(271): n is a, c, g, or t
tcagagtatacatacacgaccggtgctcgatttagacgacagctcagggggagtcccagtcaggacacagcatggacatgagggtccccgctcagctcctggggctcctgctgctctggctcccaggtgccagatgtgccatccagttgacccagtctccatccttcctgtctgcatctgtaggagacagagtctccatcacttcggccgggccaggtcagggctattagaagttatttacgctggtttcagcaagaaaccgagggaaacnccctaaactcctagactctacgctgcatcctacttcgccacgaggtcggggtccctacgtacggttcacggcggacaggcggtatcgtgggacagtactttcactctaccactactcagcacgtcctgaccacgtccgtagaagtgttcgttacgacttaacttacgtactacgtacactagtacttacgtaaccgtacccgtaccgtacgttaccgtttcggaccggtagggtaaccgtaagggtacggtaacgtaacggtaaccgaaaacggtaacgttcgggtcgggtaccgtaaccggtacccgtaaacccgttcttaccgtttccgttccgttaacccgttacccg

SEQ ID NO: 290768 - DNA, 752 bp, Homo sapiens
  misc_feature: GYAE6OF01D16EY.48.22.B11.1.454.CMB.1.raw
tcagagtatacatacacgaccggtgctcgatttagacgacagctcaggggagtcccagtcaggacacagcatggacatggacgggtccccgctcagctccgtggggctcctgctgctctggctcccgaggtgccagatgtgccatccagttcgacccagtcctccattccttccctgtctgctatctaggtaggagacagacgtcctccatcacgttcggcccgggccaggtccgagggctaagttagtaagtttattacgtccgttggtttacagtaccgaacggaaaaccggtaagggaaaccgtacccccttaaaacgttcccgtagtactttaccgtaacgcgtacgacctacttcccttaacgtttcgaccgtacgtacgggttccgggttaccccgttacgttaacgggttcgacgggccggtacgacgggtaccggtattccggtaggggtacctaaggttacctttaccaccgttacctaccaaccgtactacgacgtaccgacgtcccgtacgcgtaacggtacctaaggtaacgtagttcggttacgtaccttaactttacgtacgttcgaactaacgtagttacgttaacgtaacccgttaacccgttacgttaccttaccgggtttacggaccggtaacggggtaaccgtaaaggggttaccgaacgtaacgtaaccggtaaacgtacggttcggacgtactacgaccctacgtacttacgtacgttctaccgttacccg

SEQ ID NO: 290769 - DNA, 675 bp, Homo sapiens
  misc_feature: GYAE6OF01BPKCQ.48.22.B11.1.454.CMB.1.raw
  modified_base (189)..(189): a, c, t, g, unknown or other
  misc_feature (189)..(189): n is a, c, g, or t
  modified_base (270)..(270): a, c, t, g, unknown or other
  misc_feature (270)..(270): n is a, c, g, or t
tcagagtatacatacacgaccggtgctcgatttagacgacagctcaggggagtcccagtcaggacacagcatggacatgagggtccccgctcagctcctggggctcctgctgctctggcctccaggtgccagatgtgccatccagttcgacccagtcctccatccttccctgtctgcatcgtgtagganacagtacgtctccatcactcggccggcagtcgaggctagttagagttattagccttggttcagacaacgaaccgaggaacnccctaatccgtagactcgtacgcgtcgactactcctacgtttgaccgtacgtacgggttcgggtaccctacgttacgggttaccgagggccggtacgtaggtcgggaactcggaacggggtacctaaggtacgtttaccaccgttacctaccgtacctacgtcaacgtcgaccgtcgtagaccgaacgtcgtaaggtaacttacgtttacgaaccttaaagttttacctaactcgttaaaccaaaccgtttaactttaaaccttaacgtttacccaattaacgtaaccgtccccggtaaccgacgaacccggtaccgaaggtaaccgaaaccgaggtaccgacgtcggtagctaccgaccaaccgttagtcccgttacttacccttactccgttacccccttccg

SEQ ID NO: 290770 - DNA, 731 bp, Homo sapiens
  misc_feature: GYAE6OF01EB9RK.48.22.B11.1.454.CMB.1.raw
  modified_base (189)..(189): a, c, t, g, unknown or other
  misc_feature (189)..(189): n is a, c, g, or t
  modified_base (226)..(226): a, c, t, g, unknown or other
  misc_feature (226)..(226): n is a, c, g, or t
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttgacccagtctccatcttccctgtctgcatctgtagagacagntctccatcacttgccggcagtcaggcattagaagttnttagcctgttcagcagaaccagggaaactacccctaaaactcctagacttctacgacttcgactactcctaaccttttggacctacgtaggttccggggttccccgttcgttaacgggttccacggccggctacgggccgggtaatccggttacgggggaacctaaggttattttacccgacctttccctaccaaacccgtacgttacaacggtaccgaacgtcccgtagtccgtaacggacccgttaaggtaaacggtacgtttacggttaccggtacttaaacgttttaacttacctttaggtaacctaacgtaacgttacgtttaacgttaaccgttaaaccccgttaccgttaaccgttaccgtttttacgggacccggtaacggggtaacccgtaaaggggtacggtaaacggtaactaaccggtaaaaccgtaacggttagggtacggtaccgtacgaccgtaccctacgttaccgttacgtttccttacgttaacccg

SEQ ID NO: 290771 - DNA, 782 bp, Homo sapiens
  misc_feature: GYAE6OF01DR07O.48.22.B11.1.454.CMB.1.raw
tcagagtatacatacacgaccggtgctcgatttagacgacagctcaggggcagtcccagtcaggacacagcatggacatggacgggtccccgctcagcctccgtggggctcctgctgctctcggcctcccgaggtcgccagatgtcgccactccgtacgttacgaccctacgggggggggggggggtcctcctacttcctttcccttcgtctcgctactcgtaggtaggagacgagtacgtcctcctactctacgtcggccggccgtacgtcggacggtacgtagttagttaagtttacgtttacggtccgttcggtttcgagtacgaagaaaccgaacgggaaaccgtacccctaaccgtacctacgtactactacgctcgtacctactcctactttcgtctacgtacggtccgggttcccgtcgttacggttacgtacggtcggcgacggtacggtacgtacggtacgggtaacgtacgttactttaccgtactaccgtacctacctacgttacacggccgtaacgtccccgtagaccgtacggtcctaaggtacgtagtttcggtactacttaactttactttacgtcgtaacgtaacctacggttaaccttaacggttacccgtttaaccccgtcgtttaacctttacgggttaccgggacccgtaaacggggtaccctaaagggggtccgtaaagtaccgtaaccggtaacggttacgttcgggtacgtacccgtacgtaaccctacttaccgtttcgttcccgttacgtttacccg

SEQ ID NO: 290772 - DNA, 508 bp, Homo sapiens
  misc_feature: GYAE6OF01BOKMT.48.22.B11.1.454.CMB.1.raw
  modified_base (265)..(265): a, c, t, g, unknown or other
  misc_feature (265)..(265): n is a, c, g, or t
  modified_base (322)..(322): a, c, t, g, unknown or other
  misc_feature (322)..(322): n is a, c, g, or t
  modified_base (416)..(416): a, c, t, g, unknown or other
  misc_feature (416)..(416): n is a, c, g, or t
  modified_base (422)..(422): a, c, t, g, unknown or other
  misc_feature (422)..(422): n is a, c, g, or t
  modified_base (504)..(504): a, c, t, g, unknown or other
  misc_feature (504)..(504): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccggccagtcagggcattagaagttatttagcctggtttcagcagaaaccaggggaaacncccctaaactcctagatctacgctgctatcctatttgcacgtaggtcggggtccctntaggttcaggcggcaggcggatcgtgggacagtacttcacttcacaccatcagcacgcctgcagcctagaatatgttacactaactttatactntcaacngtacttagtacgtaccctcgtactcgttcggaccagggacctaggtgaacgagtacgaagacgtgacgctacgcactatctntctc

SEQ ID NO: 290773 - DNA, 660 bp, Homo sapiens
  misc_feature: GYAE6OF01DB55O.48.22.B11.1.454.CMB.1.raw
  modified_base (290)..(290): a, c, t, g, unknown or other
  misc_feature (290)..(290): n is a, c, g, or t
  modified_base (339)..(339): a, c, t, g, unknown or other
  misc_feature (339)..(339): n is a, c, g, or t
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttcgacccagtctccattccttccctgtctgcatctggtaggagacagagtctccatcacgttcggccgggcagtcagggcagttagagtttacttagccttggttcagacaacgaaaccgacgggaaacaccctaaactccgtnactctacgctgctactcctacttgactacgacggttcgggtacccgttntaacgggttcacggacggcgacggacggtatcggtaggggaactaggttactttccacttcaccactactcgacacacgtccttaggaccgtacgtacgtaacggaaagttcgttaggttcgaaacctttaaacgtttacttacgtacgtaactaacctagggttacctttaaagtaacccggtttaccccttacggttaaccttacgggttaccgaccggggtagggaacctaagggggtacgaactaacgtaaccgaaaaccgtaggttcggtcggccttacgaacctactaacgttcttacgtcccttagttaccccg

SEQ ID NO: 290774 - DNA, 810 bp, Homo sapiens
  misc_feature: GYAE6OF01DLHG8.48.22.B11.1.454.CMB.1.raw
tcagagtatacatacacgaccggtgctcgatttagacgacagctcaggggagtcccagtcaggacacagcatggacatgagggtccccgctcagctcctggggctcctgctgctctggctccaggtgccagatgtgccatccagttgacccagtctccatcttccctgtctgcatctgtaggagacagagtctccatcacttgccggccagtcgagggctattagaagttattagccttggtttacagacaagaaaaccgagggaaacgcccctaaactcctgactctacgctagcctactcctactttcgcacgacggttcggggtcccgtcgtaggttcaggcggcaggcgatcgtagggactagtacgtttccacgtccctacaacccgtagtaccaacggtacgtaacggtcccgttacggcccgtaaacgggtccccttaaagggtaaaacggttagtttaccgggttttacggtaaactttaaaccccgtttttaaacgttttaacccggttaacgtttaaccgtaaaaccgttaacggtttaaccggttttaaaacggttttaaaccccggtttaaaaccccccgttttaccgggttaaacccgttttaaccgggttttttaccgggggtaacccgggttaaccgggggggaaaaccggttaaaccggggttaacggggtaaacggtaaaaccgttaacggtaaaaaaaccggttaacgggttacgggttaccgggaccgttaacggaacccgttaacccgttaaacttccggtttaaccttcccgtttaacgttaacccccg

SEQ ID NO: 290775 - DNA, 628 bp, Homo sapiens
  misc_feature: GYAE6OF01CAEX7.48.22.B11.1.454.CMB.1.raw
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttattagccttggttcagcaagaaaccaggaaacgaccctaaatcctagatctacgctgcatccctatttcgacacgtacggtcggggtcccgtgtacggttcgaggcggcaggcggtatcgtagggactaaggtactttaccgaccttctaccgaacctatccgagtccaacgtcctcgactaggtccctaagaagtacttggttactaacttaacgtttattaccgtagtaccaatacgtacttaagtacctaacccgttcgttaaccgttcgtttagggacccgtaacggggtacctaaacggggtcggaaagtaacgtaaccgtaaacggtaacgttcgggtacgaccgttacgaaccgtaaccttattaccgttcgttaccttccgttaacccgg

SEQ ID NO: 290776 - DNA, 743 bp, Homo sapiens
  misc_feature: GYAE6OF01EG6UZ.48.22.B11.1.454.CMB.1.raw
  modified_base (268)..(268): a, c, t, g, unknown or other
  misc_feature (268)..(268): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaaggagacagagtctccatcacgttgccggcagtcagggctattagaagttatttagcctggtttcagacaagaaaccagggaaacncccctaaactcctgtatctacgctgcacttcctactttcgactacgtaggttcggggtacccgttgtacggttccaggtccggacgacggcggtactcgtagggactagtacttttccgaccttcgtaccaacctacgtacacgtccacgtccttacgaccgtacgtaccgtaggaaacgtacgttcggttacgaaccgttaaacttttaacgtttaccgtacggttaaccctaaacgtacgttaaccgttttaaccggttaaacccgtttaaccccccgttacccgggtttaaaccgtttaccggtttttacccgggaacccgggtaaccgggggtaaacccgtaaacgggggttacggtaaaccggttaaccgtaaaccgtaaaaacccggggtaacttaccgggtaccgggtaccttaccgggtaacccgttaaccctaacgtttccgtttacccgttacccgtttaacccg

SEQ ID NO: 290777 - DNA, 819 bp, Homo sapiens
  misc_feature: GYAE6OF01EMBPT.48.22.B11.1.454.CMB.1.raw
tcagagtatacatacacgaccggtgctcgatttagacgacagctcaggggcagtcccagtcaggacacagcatggacatgagggtccccgctcagctcctggggctcctgctgctctggctcccgaggtgccagatgtgccatccagttcgacccagtcctccactccttccctgtctgcatctgtaggagacagtcgtcctccatcctacgttcggccggccaggtccgagggctagttaagtagtttagtttacgtccgttggtttcaggacaacggaaaccgaacgggaaaccgtacccctaaactcctagtactacgtaccgctcgacctacttccgtactttcggacctacgtcgggttccggggtacccttagttacggtcgacggtcggcgtacggcggtagtcggtacggaactacgtctttaccgaccttctaccctaacgtacgtaccgacgtacccgaccggtcctacggacgtacccgtacgtaacgggtaagttaaccggttacggtttacgtaaccccgtttaaaacgttttacgttacggttaacccgtaaccgttaaccggttaaccggttttaaccgtttaaacccggttaaaccccggtttaaacccccgtttccggtttaaaccccggttttaccggtttaccggggaacccgggttaaaccggggtaaccggttaagggttacgggtaaaccgtaacggttaaacccggtaaaacccgggtaacgttcggggttaaaccggtcccttaacccggtcccttaaccgttacggtttaccctttccgtacgttttacccccg

SEQ ID NO: 290778 - DNA, 824 bp, Homo sapiens
  misc_feature: GYAE6OF01DBHZI.48.22.B11.1.454.CMB.1.raw
  modified_base (313)..(313): a, c, t, g, unknown or other
  misc_feature (313)..(313): n is a, c, g, or t
tcagagtatacatacacgaccggtgctcgatttagacgacagctcaggggagtcccagtcaggacacagcatggacatggagggtccccgctcagctcctggggctcctgctgctctggcctccgaggtgccagatgtgccatccagttcgacccagtctccatccttcctgtctgcatcgtggtaggacgacagagtcctcatctacgtcggccggcagtcgaggcagttagtaagtttacgttacgtcgttggttcagacaacgaaacgaagggaaacctaccctaaactccgtagacgttactaccggtntacgtactactaccttacgttcgaaccgtacgtacgggttcggggttaccctacggttaggtaccgaggccggacgaggacgggtacgtacggtacgggaaccttaacggttacttttaccgaacccttccgtaacctaccgtaaactcggaacggaacccgtccgtaccgtacggaccctaacgggtacccgttaaaggtaacgggttaactttacgggtttaaccgtaaccgttttaaaaccgtttactttaaacccgttaacggtaaacctaaaccggtttacgttaaccggttttaaaccggtaacccgttaaacccccgtttaccggttaacgtttaacccgggttttaacgggacccgggtaaacgggggtaaccgtaaaggggtacgggtaaacgtaaaccgttaaaaccggtaaaacgggtaccggttaggttacccgggaccgttaacgaccccgttaaacgttctttaacggttccgtttaacccgttcgttaacccccgg

SEQ ID NO: 290779 - DNA, 753 bp, Homo sapiens
  misc_feature: GYAE6OF01DCW2U.48.22.B11.1.454.CMB.1.raw
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttcgacccagtctccattccttccctgtctgcatctgtaggagacagagtctcatcacgttggccggccagtcgagggctagttaagtaagtttattacgccttggttcagactaagaaaccgagggaaccaccctaactctagactcgtacgctagacctactacctactttcgacctacggtacgggttccggggttacccctagtttacggtacgacggtaccggtacgaacggcggtacgttcggtacgggtaactacggttacttttccaacccgttcgtacctaccgtaacgtaccgaccggacctacggtaccgttacgaccgtaacggtaccgttaaagggaacgttaggtttacgtacgtaaccgttaaaacttttacgtttaacccgtaggttaacctaaacgtacggttaacgtttaaccggttaaccgttaacccccgttacggttacgttaaccgttttaccgggaccggtaaacgggggttaacctaaaggggtaccggtaacgtaaacgtaaccggtaaaacccggttaggtccgtaccgggacgtttaaccgaccgtactttaacgggtccttaaggttcccttaaacccg

SEQ ID NO: 290780 - DNA, 748 bp, Homo sapiens
  misc_feature: GYAE6OF01B6209.48.22.B11.1.454.CMB.1.raw
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttcgacccagtctccattccttccctgtctgctatcgtaggtaggacgacgaggacgtcctccatcctacgttcggccgggccagtcgagggctagttagtaagtttattacgccgttggtttacagtacgaacggaaaccgaacgggtaaaccgacccctaactcctagtactccgtacgctacgcctactacccgtactttcgaccgtacgtcgggttccggggttacccccttaggttacgggttaccgaacggccgggtacgacggtacggtagttccggtaggggaaccttagttacgtttccacgttccaccgaaccgtactacgaccgaccaccgtccgtacgaccgacgtacgtaaggtaagttagttacggttacgtaactttaaacgtttactttaccgtacgtaaccaacgttaccgttaacgtttaacgtaacccgttaaccccgttaccgttaacccgttacggttttaccgggaacccgggtacggggtaaacggtaacgggtacgaaggtaaaccgtaaccggtaaacggtacggttagggtacgtccgtaagaccctacgtacttacttacttcccgtattaccccg

SEQ ID NO: 290781 - DNA, 665 bp, Homo sapiens
  misc_feature: GYAE6OF01DUE5J.48.22.B11.1.454.CMB.1.raw
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttcgacccagtctccattccttccctgtctgcatctgtaggagacagacgtctccatccacttcggccgggccagtcgagggctagttagaagtttattagtccttggtttcagcaacggaaaccaggggaaaccaccccttaaactcctagactctacgctgctactcctactttcacacgtacgggttcgggttcccgtagttagggttcaggcgcaggcgtagtcgtgggactagtacttcactctcctaaccataccgagccgtaacgccctgccgacgtaccgtaggaagtagttcgttagtaccgttaacttacttacggttacacctaacgtacgtacgtttaacgtaaccttaaccccgttaccgttaacgttaccggttttaccggaccggtaacggggtaaccgtaagggtaacggtaacgtaacgttaacccggtaaaccgtaacggtcggttacgggacttccggaaccctaccgttacgttcgtttacgtcctttacccgttacccg

SEQ ID NO: 290782 - DNA, 721 bp, Homo sapiens
  misc_feature: GYAE6OF01C9REB.48.22.B11.1.454.CMB.1.raw
  modified_base (409)..(409): a, c, t, g, unknown or other
  misc_feature (409)..(409): n is a, c, g, or t
  modified_base (712)..(712): a, c, t, g, unknown or other
  misc_feature (712)..(712): n is a, c, g, or t
tcagagtatacatacacgaccggtgctcgatttagacgacagctcaggggcagtcccagtcaggacacagcatggacatgacgggtccccgctcagctccgtggggctcctgctgctctcggctcccgaggtcgccagatgtcgcctactccgagttcgaccctacgtcctacctacttccttccctggtctgctactcgtaggtaggagacaggtctctccatcgtacgtcggccggcagtcgaggtactagttaagtagttacgttacgtccgttagttacagacgaaacggaaaccggaacgggtaaaccaccccgttaacgtccgtagtactacgtacgctacgcctacgttcctacgtttcgacgtaccggtacgggttccgggtccctaggttacggtaccgngaccgggactacgggtacggtacgtcggtacgggtactagttaccttactcctacgtaccaacctagtaccgaaccggtcctaacggcccgtacgtaccgtacgttaccgtaaggtacgttcgttacgttaacgttaaccttaacgtttaacttaccgtgtaacacgttagtaccgttaacgtaccccgttaaccgtacgttaccgttacgttacggacggtaacgggtaactaacggggtgaaacgtacgttaacggaacgttacggtcgtaaccgggtctacgacttactagtcccggttntcgttaccg

SEQ ID NO: 290783 - DNA, 725 bp, Homo sapiens
  misc_feature: GYAE6OF01BQIWS.48.22.B11.1.454.CMB.1.raw
tcagagtatacatacacgaccggtgctcgatttagacgacagctcagggggagtcccagtcaggacacagcatggacatgacgggtccccgctcagcctccgtggggctcctgctgctctggcctcccgaggtgccagatgtcgccatccagttcgacccagtcctccatccttccctgtctgctatcgtggtaggagacagacgtcctccatctacgttcggccggacagtcgagggactaagttaagtaagtttagttacgtccgtttaggttacaagacgaacggaaaccggaacgggaaccgtaacccctaaactccgtagactaccgtaccgactcgactacttcctacgttcgaccgtacggtacgggttccgggtccccgttacgttacggtaccgacggccggtacgacggacggtagtcggaggactacgttacttccaccgttcaccactcgtacgacgccgtacgcctgaccgtacgctaaggaattgttacggtacgtaaacctttaatttacgtacgtacgtaactacggttaacgtttaaccgttaaccgttaaaccccgttaccccgttaccgttaacccgttttacgggttaaccgggaccggtaaacggggtaaccgtaaggggtacggtaaactaaaccggaaccgtaaacggtacgtcggtacgtccgtaacgcctaccgtgttaccttcgttccctacgtacccg

SEQ ID NO: 290784 - DNA, 817 bp, Homo sapiens
  misc_feature: GYAE6OF01CDQJM.48.22.B11.1.454.CMB.1.raw
tcagagtatacatacacgaccggtgctcgatttagacgacagctcagggggagtcccagtcaggacacagcatggacatgagggtccccgctcagctcctggggctcctgctgctctggctcccaggtgccagatgtgccatccagttcgacccagtctccatccttccctgtctgcatctgtaggagacagagtctcatcacttggccgggccagtcgagggctagttaagagtttattagccgttggtttacagtacaaacggaaaccgaagggaaaccgacccctaaactcctagatcctacgctgctactcctacgttgctacgacgggttcggggtcccgttgtacggttccgaagggtccggcgaggtcgggtacgttcggtaggggtaactaaggtacttttccaccgtttcctaccgaaccctacgtaccgaacgtaccgaacggtcccgtacggaccgtaaccggtacccgttaacgggtaaacgttacggttacgtttaccggttaacgttaaaacctttttaacgtttacgttaacgttaacccttaaaccgttaaccggtttaaccgttttaaaccgggtttaacccgttttaaaccccccggtttacccgttttaaacccggtttacccggttttttaaccgggggaaccccgggttaaacgggggtaaccccgttaaaggggttacgggtaaacgtaaaccgttaaacccggtaaaaaccgggtaacgttacggggtacggtaccgtacgtaaccccgtaccttaacgtttccggttaccgtttccgttacccttaaccccgg

SEQ ID NO: 290785 - DNA, 611 bp, Homo sapiens
  misc_feature: GYAE6OF01BWGNO.48.22.B11.1.454.CMB.1.raw
  modified_base (407)..(407): a, c, t, g, unknown or other
  misc_feature (407)..(407): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtcctccatcacttcggccgggccagtcagggcattagaagttatttagcctggtttcagtacagaaaccgaggggaaacgacccctaaaactcctagactctacgctgcactccactttcgcacgtacggtcggggtcccgtcgtacggttcgaggcggctaggcggatccgtagggactagtactttcgacttctccactatcgacgcacgccngacacgcctagaagtacgttgttacgtactaaactttacgttaccttagtacaacgtacgtaaccgtttaacgttaccgttaacccgttacccgttacgttaaccgtttcgggtacccgaacgggtaccggtaagggttaggacgtacgtaacgtaaacgtaacgtggtacggtacgcgtactaccgtatcgtgtttcctaccg

SEQ ID NO: 290786 - DNA, 811 bp, Homo sapiens
  misc_feature: GYAE6OF01DR224.48.22.B11.1.454.CMB.1.raw
tcagagtatacatacacgaccggtgctcgatttagacgacagctcaggggagtcccagtcaggacacagcatggacatggagggtccccgctcagctccgtggggctcctgctgctctggcctcccgaggtcgccagatgtcgccatccagttcgacccagtcctacctattccttccctgtctcgactatcgtagtagggacgacaggtacgtcctacctactaccgtaccgttcgggacccgggacctacggtaccggacgggtactaaaggtttaaacggttaaagttttacgtttacggtccgtttagggttaccacggtaacgaaaaccggaaaccggtaacgggtaaaccctaccctaacgtccggtataccgttacacgtctacgtaacctaccttacgttacgttacgaccgtagggtaccgggttccgggtaccgttacgtacggtacggacggcggtacgacgggtccgtagtacgggtacgtactacgtttctactacctccaccgtactacgtacgaccgctacccggtacgacgtacgtacgtaccggtaaggtaaccttggtttaaccgtaccttaaactttacgttaacgtgttaacccgtaactaacggttactttaaccgttaaccggttaaccccttacccggttaaccgtttaccggttcgggtaccgggaaacgggacgggttaaaccggtggtaaacgaccgttaacgaaaacccggtacggttacgggtttaagcccggtaaagccctacgttaacgttcgttaccgtccgttaccttcgtaacccccg

SEQ ID NO: 290787 - DNA, 721 bp, Homo sapiens
  misc_feature: GYAE6OF01B1BGK.48.22.B11.1.454.CMB.1.raw
  modified_base (251)..(251): a, c, t, g, unknown or other
  misc_feature (251)..(251): n is a, c, g, or t
tcagagtatacatacacgaccggtgctcgatttagacgacagctcagggggcagtcccagtcaggacacagcatggacatgagggtccccgctcagctcctggggctcctgctgctctggctcccagggtgccagactgtgccatccagttgacccagtactccatcttccctgtctgcagtctagtaggacgacagactctaccatccacttcggcccgggccaggtccgagggcagtttagaacgtttntttagaccttggtttacagtcagaaaccgagggaaacgcccctaaactcctagtatctacgctgcactccagtttgcacgacggtcggggtaccccgtctacgggttacagcggtaccgacgggcgggacgtccgtgggacctaaggtactttcgtacctccgtaccacccgtaactacgaaccgtaccgaccggtaccctcggtacccgtaccgtaccccgtttacggaaacgttacgttacgttaccggtaaccgttaaaccgtttaacgtttaccgtaacgttacccaaccgttacggttactttaaccgggttaacccgttaaacccccgttacggtaacctttaccggttttaccgggacccgttaacgggggaacctaacgggttacggaacgtaaccggtaccgaaacggttacggtcggtacggacgttacgaaccgtactaggttacctcgttacttaccg

SEQ ID NO: 290788 - DNA, 724 bp, Homo sapiens
  misc_feature: GYAE6OF01A9JSK.48.22.B11.1.454.CMB.1.raw
  modified_base (291)..(291): a, c, t, g, unknown or other
  misc_feature (291)..(291): n is a, c, g, or t
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttcgacccagtctccatcttccctgtctgcatctgtaggagacagcgtctcatcacttggccgggacagtccgagggctagttaagtagtttattacgccttggtttcagacaaggaaaccgagggaacacccctaaactccgtanactctacgcgtagcctacgtcctactttcgactacgtacggttccggggttaccctcgttacgggttccgagggtccggcgaacgggtcggtaacgtccggtagggaacgtagttaccgttttaccacctttaccctaccgtaacccctaattccggaaccgaccgtaccgtacccgtacgaccgtaccggtacccgttaggaaagttacgtttcgttaacggtaacctttaacgtttaccgtttaacttagtaaccctaacgtacgtacgttttaaacgaacccttaaccccgtacgtaccttaaccgttacggtttaccgggaccggtaacgggtaccggtaacgggagtaacggtacctaacggtaaaccggtacggttacggtcggtacctcggtaccctaaccgtacgtttccttacgttccttaccg

SEQ ID NO: 290789 - DNA, 571 bp, Homo sapiens
  misc_feature: GYAE6OF01D98AS.48.22.B11.1.454.CMB.1.raw
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccggccagtcgagggcaattagaagtttatttagccttggtttcagtacaagaaaaccgaggggaaaacgccccctaaaactcctgactcctacgctgccatcctactttgaccacgtaggtcggggttccccgttcgtaggttcaggcggcgtagcggtatcgtgggacagtattcactctacaccatcagcacgcctgcagcctagacgtattgtacactaactttatactagactaactagtacttaacgtaccgttaacccttcgtaacgtttacgttcggaccggaagggtacgtaggtacgaagtactaacggaacgtacggttgacgtctacgacctacctatcgttcgttccttaccg

SEQ ID NO: 290790 - DNA, 619 bp, Homo sapiens
  misc_feature: GYAE6OF01BB6HX.48.22.B11.1.454.CMB.1.raw
  modified_base (231)..(231): a, c, t, g, unknown or other
  misc_feature (231)..(231): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccggcagtcagggcaattagaagttnttagcctggttcagcagaaaccgaggaacgccctaaatcctgactctacgctgctactctactttgactacgaggtcgggtccctacgtacggttcacggtccggcgacggtcggtaactcgtacgggaacaggtactttccgacttcctaccgaacctatccaagtacacgtcctaggacctaacgtaccgtagaacgtacgttcgttacgtactaaactttacttaccgtacgtacaaacgtagtacttaacgtaacgttaacccgtaccgttaactacgtttcggaccgtaacgggtaaccgtagggtacggtaagtaacgtacgaaaacggttacggtcggtacggtacctacgaccctaactattcgttacgttcttaacccg

SEQ ID NO: 290791 - DNA, 806 bp, Homo sapiens
  misc_feature: GYAE6OF01E1M6T.48.22.B11.1.454.CMB.1.raw
tcagagtatacatacacgaccggtgctcgatttagacgacagctcaggggcagtcccagtcaggacacagcatggacatgacgggtccccgctcagcctccgtggggctcctgctgctctcggctcccgaggtcgcctagtactgtcgcctactacccgtagttccgaccctacgttcctccctacttcccttccctgtctgactatcgtaggtacggacgacgtacgtactcctacctacgtccgtaccggttccggaccggaccgtacggtacggtacggttacgttaacgttaacgttaacgttttaccgttacggacccgtttacggttacccgaacggtaacccgaaaaacccgggtaacccggtaaacccggggtaaaaccccctaccccgttaaaacccgttccgtacgtttaaaaccccccggtaccgtaccgtacctaccgtaccgtaccgtaccgttaccggttaccggtaccggtaccggttaccgggttaccggtaccggtacggtacggtacggtacggtacggtacggtacggtacggtacgtacgtacgtaccgtaccgttacctacctacctaccgtaccgtaccgtaccgtaccgtaccgtacgtaccgtacgtacgtacgtacgtacgtacgacttacgttacgtacgtagtcctaacgtactacttacgtacgtaaccgtaccgtaccgttacgttaccgtaccgtacggtacctaggtacgaggtacgtacgaacgacgtacgtacgacgtacgtacgtacgtactctactacctactctccgtcc

SEQ ID NO: 290792 - DNA, 729 bp, Homo sapiens
  misc_feature: GYAE6OF01A2Y8V.48.22.B11.1.454.CMB.1.raw
  modified_base (128)..(128): a, c, t, g, unknown or other
  misc_feature (128)..(128): n is a, c, g, or t
tcagagtatacatacacgaccggtgctcgatttagacgacagctcaggggagtcccagtcaggacacagcatggacatgagggtccccgctcagctcctggggctcctgctgctctggctcccaggtnccagatgtgccatccagttgacccagtctccatcttccctgtctgcatctgtaggagacagagtctccatcacttgccgggccagtcagggtcattagaagtttattagccttggtttcagcacgaaaccagggaaacgcccctaaactcctgatcctacgctagcacgtccactttgcctacgaggttcggggtccccgtacgttacggttccgacggtccgggacgacggcggtaactcgtaggggactaggacttttaccgaccgttacctaccgaaccctacgttaccgacgccgtaacggtcccttacggccgtaacggtccctaaggtaacggtaagtttacggttaccgtaacgttaaaccgtttactttaaccgttacgtaaccttaacgtaacgttaccgttttaaacggttaaccgtttaaaccccgttacccgtttaacccgttaaccggtttttaccggacccggtaaccggggtaaccgttaagggtacgggtaacggtaaccgttaaccgtaaaaccggtacgttacggtacggtaccgtacgtaccgtacccgtacttaccgttaccgttccgtttcgttaacccg

SEQ ID NO: 290793 - DNA, 630 bp, Homo sapiens
  misc_feature: GYAE6OF01EO8RT.48.22.B11.1.454.CMB.1.raw
  modified_base (305)..(305): a, c, t, g, unknown or other
  misc_feature (305)..(305): n is a, c, g, or t
  modified_base (320)..(320): a, c, t, g, unknown or other
  misc_feature (320)..(320): n is a, c, g, or t
  modified_base (379)..(379): a, c, t, g, unknown or other
  misc_feature (379)..(379): n is a, c, g, or t
  modified_base (400)..(400): a, c, t, g, unknown or other
  misc_feature (400)..(400): n is a, c, g, or t
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggcagtcagggcagttagaagttattagccttggtttcagtcaagaaaccgagggaaacgtcccctaaactcctgactctacgctgcatcctactttncacagtcgggtcctntacggttcagcggcagcggatcgtggactaggtactttcacctctcaacctatcgagcncgtcctgcacgcctagaagtntgttagacctaatttacttacgtcgtactaacgtagtactttaagtaaccgttaaccccgttccgttaaaccgttacgtttttaccgggaccggtaacggggtaacctaaaggggtacggtaacggtaaaccgttaaccgtaaaaaccggtaacgttcggttaacgggtccgtaccggacccgtaaaccccgtagtttaacccgttcggtttccttacccgttaaccccg

SEQ ID NO: 290794 - DNA, 777 bp, Homo sapiens
  misc_feature: GYAE6OF01BUIB9.48.22.B11.1.454.CMB.1.raw
tcagagtatacatacacgaccggtgctcgatttagacgacagctcaggggagtcccagtcaggacacagcatggacatgacgggtccccgctcagcctcctgggggctcctgctgctctggcctcccgaggtcgccaggatgtcgccactccgtaggttaccgaccctacgttcctccctacttccctttccccgttgtcctcgactatcgtaggtaggacgacaggtctacctcactccgtacgttccggcccggtacctaggtccggacgggtacttaagtttaaggttaacgtttacgtttacggtccgtttaggttaccaagaaccgaaacggtaaacccggaaacgggaaccctaacccgttaacgtccgtacgaccttacccgtacgccgtacgtacctaccgttaccttacgttacgaccgtaccggggtacggttcccggggtaccttacggtaggttccgacggccggtacgaggtacggttacgtcggtaacggtacgtagttcctttacccgtactaccgtaaccaaccgtcgtaacgccgtaacgtcccgtaccgtaccgacgtacgtaccggtaagtaacgtacggtttacgtactaacgtttaacttacgtacgtaacacttaacgtagttaccgttaaccgttaaccgttacccgtgttaccgttaccggtccggtacggacggtacggtcgtaacgacgtaacgaccgtacgttagacggtcgacgtacgtacctcttacgttattcgttccgcttacccg

SEQ ID NO: 290795 - DNA, 849 bp, Homo sapiens
  misc_feature: GYAE6OF01EAMQT.48.22.B11.1.454.CMB.1.raw
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttcgaccctagtctcctattccttccctgtctgctatcgtggtaggagacagtacgtcctccatctacgttcggccggacctagtcgagggtctaagtttaagtaagtttagttacgtccgttggtttacagtaccgaaacggaaaaccggtaacgggtaaaacccgtaccccttaaaacgtcctaggtaacttaccgtacgtccgtagtacctacttcccgtaacgtttcggacccgttaacgtacggggttccgggttaccccgttaggtaacggttccgaacggttccggacgtacgggtaccggtacgttaccggtacgggtaactagttaccgtttaccaccttcctaacccgtaccgtagtaccgacggtacctaccggtaccttacggacctacggtaccgtaaggtaacgttacgttcgttaacgtactttaaacgttttacgtaccgttaacgttaaccgtaaccgttaggttaaccttttaaaccggtaccccgtttaacccttacggtttaaccgttttaccggggttcccggaaacccggggttaacggggtaaccgtaagggggttaaccggaaagttaaacccggtaaaccggttaaaccggttacgggttcgggaacccgggttaccttaacccggtacccgtttaaaccgttacgtttacccggtttcggttaccccttaaccccgg

SEQ ID NO: 290796 - DNA, 785 bp, Homo sapiens
  misc_feature: GYAE6OF01CC00T.48.22.B11.1.454.CMB.1.raw
tcagagtatacatacacgaccggtgctcgatttagacgacagctcaggggcagtcccagtcaggacacagcatggacatgagggtccccgctcagctcctggggctcctgctgctctggctcccaggtgccagatgtgccatcccagttcgacccagtcctccattccttcctgtctgctatctaggtaggagacaggtacgtctccatcacgttcggcccggcagtcgagggctaattagtaagtttactttacggtccttggtttacacgtacgaaacggaaaccgaacggggtaaacctacccccttaaaacgtccgtagtaacttaccgtaccggtctcgtacctacgttccctacgtttcgacctacggtacgggtccggggttaccccttagttacgggttacgacggtacggctacgggacggtacgtcggtacgggaaactacggttacttcctactacctacctaccctatccgaacgtccgtacgtccttaggaccctagtaccgtaaggtaaggttagttcgtaacgtaacctttaactttaaccgtttacgtacgaactaaaccgttcgttaaccggttttaacccggttaacgtaaccccccgtttacgttaaaccggtttacccgggtttaccggggaccggtaaccggggttaacgtaacggggtcggaaaacgttaacggtaaacccggtaaaccgtaaggttccggggtacgtaccgttaaccgtaccttaaacccgttacgtttcgttacccgttcccgtttacccg

SEQ ID NO: 290797 - DNA, 660 bp, Homo sapiens
  misc_feature: GYAE6OF01ANO7R.48.22.B11.1.454.CMB.1.raw
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagacgtctccatcacgttcgccgggccagtcgagggctattagaagttattagtcgtggtttcagacaagaaaccgagggaaacacccctaaactcctagactctacgctgactactcctactttgacctacgtacggtcggggtccctacgttacggttaccgaggccggacgacggcggtacgtcgtacggggaactaggtactttaccaaccttccgtactaccctacgttaccgacgaccgtaacgtccgttacgaccgacgtacccgtaagtaacgtacgttagttacgaacttaactttagttacctagtaccaactagttaccgttaacgtaccgttaacccttacgttaaccttacggtttacggaccggtaacggggtacctaagggtacgtaagtacgttaaacgaaacgtacggttcgtacggtacctacgtaacctacgtacttcgttcgttccttaccg

SEQ ID NO: 290798 - DNA, 629 bp, Homo sapiens
  misc_feature: GYAE6OF01CZBZS.48.22.B11.1.454.CMB.1.raw
  modified_base (193)..(193): a, c, t, g, unknown or other
  misc_feature (193)..(193): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttcgacccagtctccattctcctgtctgcatctgagagacagagtcncatcacttgccggcagtcgaggcattagaattattagcgttgttcagtcaagaaaccgtagggaaactaccccgtaaaactccgtagacttaccgtaacgcgtacgctactaccctactttcgcctaacgtacggtcggggtccctcgttacggtcacggtcgcgaacggtcggatcggtacggactagtacttccactctacgaccatcgaagtcacgtcctcgacacgcctagaagtacgttgtactaccgttaacttacttaccgtagtacaacgtacgttacttaacggtaacttaaccccgtaccgttaacgttaccgttttaccggaccggtaacgggtaaccgtaagggtcgtaacggtactaaaccggtaaacgtaacggttggtacggtacgtcgtaaccctaactactttcgtcgttcttaacccg

SEQ ID NO: 290799 - DNA, 841 bp, Homo sapiens
  misc_feature: GYAE6OF01DHF0C.48.22.B11.1.454.CMB.1.raw
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttcgacccagtctccatccttccctgtctgctatctgtaggagacagagtctccatcacgttcgccggcagtcgagggctagttagtagttattacgccgttggtttcagtacgaacgaaaaccgaagggaaacctaaccccctaaacgtccgtacgtaacttaccgtaaccgctacgacctacttaccctacgtttcggacctaacggttacgggttccggggtccccgttacggttaacgggttccgagggtcccggacgtacgggtacggtacgttccggtaacgggtaacctacggttactttccgtaaccttccgtaccctaaccctactaccgacgtaccgtaccggtccctaggaccctacggttacccgtaaggtaaacgtcgtttcggttaaccgttaaccgtttaaaccttttacgttaaccgtttacgtaaccgttaaaccgttacggtttaaaccgttttaaccggttaaccccgtttaaaccccgttcccggtttaaccgtttaaccgggttttaccggggacccgggttaaaccgggggtaacccggttaaaggggtacgggtaaaccgtaaaccggttaaacccggtaaaaacggtttaccggttaacgggttaccggtaccgttaacccgggaacccttaaccgttaccgtttacccgttcgtttacccgtttaacccg

SEQ ID NO: 290800 - DNA, 697 bp, Homo sapiens
  misc_feature: GYAE6OF01BNJAK.48.22.B11.1.454.CMB.1.raw
  modified_base (186)..(186): a, c, t, g, unknown or other
  misc_feature (186)..(186): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtagganacagagtctccatcacttcgccggcagtcaggcattagaagttattagcctggttcagcagaaaccagggaaacgcccctaaactcctgactcgtacgctgctatcctactttcgactacacggtcggggtccctgttacggttcacggcggcaggcggtatcgacgggacagtacttttaccgaccttacgtaccaacctacgtaccacgtcaacggtccctaggaccgtacggtacccgttaggaaacggtacttggttacgtaaccttaaacgtttacgttacgttacgtaacaaacgtacgttaccgtttaaacggtaacccgttaaaccccgttacccgtttaacgttaccggttttacgggacccggttaaacgggggtaaccgtaaaggggtacggaaaccgttaacgtaaacccggtaaaacgggtaaccgttacggggttaccggtaccgttaccgtacccgtaaccgttacgtttcgttaacccgtttccgtttaaccccg

SEQ ID NO: 290801 - DNA, 746 bp, Homo sapiens
  misc_feature: GYAE6OF01DKX2K.48.22.B11.1.454.CMB.1.raw
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagacgtctccatcacttgccggccagtcaggcagttacgtagttattagcctggttcagacaagaaacgaggaacaccctaactcagtatacgtacgctacgctactcctactttcgacacgtaggtacgggtccctcgttaggttcaggcgacgaggtcgactcggtaggactaggtactttccaactcgtacctaacctactaccgacgtaccacgtcccttaggaccctaacgggtcccgttaaggtaaacgttacgttaccgtttacgtaaccgttttaaaccgttttacgttttaaccgtacgttaacccgtaaacgttacggttaaaccgttttaccgtaaacccggtttaacccccgtttacccgttaaccgtttacccgggtttttaaccgggaccgggtaaaccgggggttaaaccccgtaaagggggttaccggtaaacgggtaaccgttaaaaccggtaaaaccggttacggtttacgggtaccgggttcgtaacccgttaccccgtaaacttaccggtttaacggttcccgtttcgtttaaccccg

SEQ ID NO: 290802 - DNA, 686 bp, Homo sapiens
  misc_feature: GYAE6OF01A8UCO.48.22.B11.1.454.CMB.1.raw
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctcatcttcctgtctgcatctgtaggagacagagtctcatcacttcgccggcagtcagggctagttagaagttattagcttggtttcagcaagaaaccgagggaaacgacccctaaactccgtagactctacgtctcgaccactccctacgtttcgactacgaggttcggggtcccgtacgttagggttccagggccggtcgaggcggtaacgtccggtaggggaacctaaggtaacttttaccgaaccgttcctaccaaccctacttccgacgtaccgaacgtccccgtggacccgtaacgtacccgttaaggaaacgtacgtttgttacggtacttaaaccgtttattaccgttacgtacaaacgtagtaacgtttaacggttaccgttaacccttccgttaaaccgttaccgttttacgggaccgtaacgggggtaaccgtaaacgggttacggaaacgtaacgtaaccgtaaacgtaacggttacggtcgggtactacgaccaccgtaattcgttcgttcttaccg

SEQ ID NO: 290803 - DNA, 785 bp, Homo sapiens
  misc_feature: GYAE6OF01CQ31E.48.22.B11.1.454.CMB.1.raw
tcagagtatacatacacgaccggtgctcgatttagacgacagctcaggggagtcccagtcaggacacagcatggacatggagggtccccgctcagctccgtggggctcctgctgctctggctccaggtgccagatgtgccatccagttcgacccagttcctccattccttccctgtcctgcattcgtaggtaggagacaggtacgtcctccatcacgttcggcccggcagtcgaggctagttaagtagtttattacgtccgttggttacagacgtaacggaaaccgaacgggaacctaccctaaactccgtagtacctctacgctacgactacctccgtactttcgacgtacgtacgggttcccgggtacccgtacgttagggttccacggtaccggacgaggtccggtacgtacgggtaggactaggtacctttacgaccttactacccgtaactacgtccgaacgccgtaccgtacccgttacgaccgtaaccggtaaccgttaagtaacggttacgtttacggttaccgaaccttttttaaccgttaaacgtttaccgttacgtaaccgaaacgtttaccgtttaacggtttaaacccgtttaccgttaaccccgtttaacccgtttaccgtttaccggttttaaccggggaccggtacggggtaaaccggttagggtaacgtaaacggttaaccctaaacggtaaaccgttacggttcggtaaccggtccgtacgggtaccctaacgttaccgttacctttacgtcccgtttcttaccccg

SEQ ID NO: 290804 - DNA, 950 bp, Homo sapiens
  misc_feature: GYAE6OF01BYF03.48.22.B11.1.454.CMB.1.raw
  modified_base (476)..(476): a, c, t, g, unknown or other
  misc_feature (476)..(476): n is a, c, g, or t
tcagagtatacatacacgaccggtgctcgatttagacgacagctcaggggagtcccagtcaggacacagcatggacatgagggtccccgctcagctccgtggggctcctgctgctctggcctccgaggtgccagatgtcgccatccagttcgacccagtctccattccttccctgtctcgactatcgtaggtaggacgacgagtacgttcctaccgacttccgtacgttcggcccgggtacctaggtccggacgggacttaaggtttaaaggtaacgttttacgttacggtccgtttaggtttacgaacggtaaccgaaacggaaaaccggaacgggtaaacctacccttaaacgtccgtagtactaccgtacgcgtcgacctacttaccgtactttacgacgtacggtacgggtccggggttacccttacgtacggttaccgacggtaccggcgtacggtacggtacgttacggngggtaaccctggttaaccttccgtacttaccctaacgtaccctaagtacccgacgtaccgtaccgtacccggtacgtacccgtacggtaaccgtttaaacgggtaacgttacgttttacgggttaccgttaaacctttttaaaaccgtttacctttaacggtaacccgttaaaacgttaacccgttaaacgggtttttaacccgtttaaaaccgggttaacccccgtttttaaaccccgggtacccgtttttaaaaccccggggtttcccgggttttaaaacccgggggaccgggttaaaacccggggaaccgggttaagggggttaaaacctaaccgggttaaaccgttaaaaccccgggtaaaacgggtttacggttaccggggtaaccggtttaaaccgtcccgttaaacccgtaaccggtttaccgtttaacccgtttacccggttttaccgtttacccttaaccccggg

SEQ ID NO: 290805 - DNA, 694 bp, Homo sapiens
  misc_feature: GYAE6OF01CT27Y.48.22.B11.1.454.CMB.1.raw
  modified_base (135)..(135): a, c, t, g, unknown or other
  misc_feature (135)..(135): n is a, c, g, or t
  modified_base (156)..(156): a, c, t, g, unknown or other
  misc_feature (156)..(156): n is a, c, g, or t
tcagagtatacatacacgaccggtgctcgatttagacgacagctcaggggcagtcccagtcaggacacagcatggacatgagggtccccgctcagctccgtggggctcctgctgctctggctcccaggtgccagntgtgccatccagttcgacccngtctccatcttcctgtctgcatcgtaggtaggagacagactctccaatccgacgttcggccggccaggtcgagggctaagttagagtttattacgtcctggtttacagtacaagaaaccgaacggaaacgacccctaaacgtcctagtactaccgtacgactcgaccacgttaccacgtttcgactaacgtacgggtcgggtacccgtacgtacggttcgacgcggtcgaggtcggacgtcgtacgggacgacgttaacttcgtacttcctaccgacctagtcctacgaccgacgtcctacgacgtacgtcctaagggaaacgtgttacgttacgtaaccgttaaacttagtttaacctacgtaacgtaaacgtacgttaaccgttaacgttaaccgttaaccccttaccggttacgttaccgttttacgggaccgtaacggggtaaccgaagggtacggtaggtaacgtaacggtaaacgtacggttagtacgggtacgtaccgtcgtaaccttagttaccttcgttccgttaaccg

SEQ ID NO: 290806 - DNA, 946 bp, Homo sapiens
  misc_feature: GYAE6OF01A0WS4.48.22.B11.1.454.CMB.1.raw
tcagagtatacatacacgaccggtgctcgatttagacgacagctcgagggggcagtcccagtcaggacacagcatggacatggagggtccccgctcagctccgtggggctcctgctgctcgtggctccgaggtcgccagtattgtgacctatccgtagttcgaccctagtctcctacttccttccctgtctcggactagtcgtaggtacgggaagaccgtagtacgtcctaccgtacgttccggtaccgtttccgggacccgggtaccctaaccggtccggtacggggtactaaacggttttaaacggttaaacggttttacgttttaccggtccccggttttaggttttacccgaacggtacccgtaaacggaaaacccggtaaccgggtaaaacccgtaccccccgttaaaccgttcccgtacggtaccgtacccgtaccggtacgtacggtacctaccggttacccgttacgtttcggaccgttaccggtacggttcccggggttacccttacggttacggttccgacggaccggtacggaaccggtcgtacgttccggtaacggactaggttaccttacgtacccttaccgtaccctacgttaccgaccgtaacggaccctaacggtccgttacggacgtacctacgttaacggtaacgttcgttacgtaacgtttaacctacgttttaaccgtaccgttacgtaacccgtaaggttaccggttaaccgttaaccgggttaccccctttacccggtttaccggtttaaacgtttcccggttaccggggaaccgggtaaccgggttaaccggtaagggttaccgggtaaacgtaaccggttaaaccgtaaacggggtttacccgtaggggttcccgtacccgtaaccgttaacccggttaacttacccgggttttaccgtaccgttttaccccggttaacccg

SEQ ID NO: 290807 - DNA, 747 bp, Homo sapiens
  misc_feature: GYAE6OF01EUUEV.48.22.B11.1.454.CMB.1.raw
tcagagtatacatacacgaccggtgctcgatttagacgacagctcaggggcagtcccagtcaggacacagcatggacatgagggtccccgctcagctcctggggctcctgctgctctggctcccaggtcgccagatgtgccatccagttcgacccagtcctccattccttccctgtctgctatcgtggtaggagacaggacttctaccatcctacgttcggcccgggcctaaggtcgagggtactaagtttagtaagttttagtttacgccgtttggtttacagtaccaaacgtaaaccgacgggaaaccgtaccccttaaactcctagtactacgtaccgctcgactactccgtactttcgcctagtacgggttccgggtccgtacgtacggtcgacggtccggcgaggtcggaactcggtacgggaactacgttacgtttaccaccgttacctaccgactacgtacgacgtaccgtacgccgttaccgacgacggtaccgtaaggtaaacgtcgttcgggttaactaaccgtttaaactttacttaacggttcgtaaccctaacgtaacggtttactttaaaccgtaacccggtttaaccccgttaccgttaacccgtttacggttacccgggaaccgggtaacggggtacgttaacgggtaccgtaacgtaaccgtaaccggtaaaaccgttcggtccggtacgtccgtaacgtcctacgttacttacgtttccgtcttacccg

SEQ ID NO: 290808 - DNA, 760 bp, Homo sapiens
  misc_feature: GYAE6OF01DB84Q.48.22.B11.1.454.CMB.1.raw
tcagagtatacatacacgaccggtgctcgatttagacgacagctcaggggcagtcccagtcaggacacagcatggacatgagggtccccgctcagctcctggggctcctgctgctctggctcccgaggtgccagatgtgccatccagttcgaccctagtctccattccttccctgtctgctatctaggtaggacgacagtacgtcctaccactcctaccgttcggcccgggaccaggtcgagggtctaagttagtaagtttattacgtccgttggtttaccgagtaccgaaacggaaaccgaacgggtaaaccgtacccccttaaactccgtgtaacttccgtacgcgtacgtacctaccttacccgtaccgtttacgacctacggtacggggttccgggttcccgttacggttacggttcgacggccggtacgtacgggaccggtagttccggtacgggtaacctagttaacctttccgaccttcctaccgtactacgtaccgacgtaccaccgtccgtacgaaccgtaccgtacgagtaacgtgtttcggttactaaccgttaatttacgtacgtacgtaacgtaccgtagtaccgtttaacgttaacccgtaccccgtttattaccgttacccggtttacgggacccggtaacgggtaaccgtaacggggtgaaacggtaacgtaaaccgtaaaccggtacggtcggaccgtacacccggttacctaccttaggtttcccgttgtttcccttaccgg

SEQ ID NO: 290809 - DNA, 701 bp, Homo sapiens
  misc_feature: GYAE6OF01BIDPH.48.22.B11.1.454.CMB.1.raw
  modified_base (201)..(201): a, c, t, g, unknown or other
  misc_feature (201)..(201): n is a, c, g, or t
tcagagtatacatacacgaccggtgctcgatttagacgacagctcaggggcagtcccagtcaggacacagcatggacatgagggtccccgctcagctccgtggggctcctgctgctctggctcccgaggtcgccagatgtcgccatccagttcgacccagtcctcctacttccttccctgtcctgctatcgtaggtagganacgagtacgtcctaccatcctacgttcggcccggacctaggtcgagggtctaagttaaggtaagtttacttacgtccgttaggttacacgtacgaaacggtaaaccgaacggggaaacctaccccctaaactccgtagtacctaccgtaccgtctacgacctacttccgtacgttacgacctacggtacgggttccgggttccctaggttaaccggtcgaacggcggacgacgggtacggtacgtacggtacggtactagttacgtttaccacccgtacctaccgtactactaccgagtaccctgccgtacgacgtacgaccgtagtagttactcggtataccttaagttactcgtacgtaacacgtactaccgttacgaacccgttaccgtaccgttacttacgttcgggaccggtaacgggtactaagggtactaagtaccgtaaacgtaacggtggtcggactaccgtactacgtacctagtcgtccttcgtacccg

SEQ ID NO: 290810 - DNA, 764 bp, Homo sapiens
  misc_feature: GYAE6OF01A7I5G.48.22.B11.1.454.CMB.1.raw
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttgacccagtctccatcttccctgtctgcatctgtaggagacagagtctcatcacgttggccggcagtcgaggctattagaagttattagccgttggttcagtcaacgtaaaccgaagggaaaccgcccttaaactccgtagtactcgtacgctgctactcctactttcgacctacgtacgggtcggggttacccgtcgttaggttccgacggccgggacgtaggcggacgttcggtacggggactacggtaacttttcccgaccttcctactaacctacgtccgaacggacctaacgtcccgttcggaccgtaaccgggtccctaagggtaaacgtacgtttacggttacggtaaaccctttaaacgttttaaccgttacgttacgttaacctaaaccgttacgggttaaccttttaaccggtttaaacccgttaaccccgtttaacccggttaacccgtttaacggtttttacccgggaacccgggtaaccggggttaaacccggtaaggttacgggaacgttaaacccgtaaacggtaaaccggtaacgttcgggtacgggtaccttaccggacctaaccgttacgttaccgttcgtttccgttaccgttaccccg

SEQ ID NO: 290811 - DNA, 617 bp, Homo sapiens
  misc_feature: GYAE6OF01BNBK0.48.22.B11.1.454.CMB.1.raw
  modified_base (418)..(418): a, c, t, g, unknown or other
  misc_feature (418)..(418): n is a, c, g, or t
  modified_base (433)..(433): a, c, t, g, unknown or other
  misc_feature (433)..(433): n is a, c, g, or t
tcagagtatacatacacgaccggtgctcgatttagacgacagctcaggggagtcccagtcaggacacagcatggacatgagggtccccgctcagctcctggggctcctgctgctctggctcccaggtgccagatgtgccatccgagttcgacccagtctccatccttccctgtctgcatctgtaggagacagagtctccatcaccgttgccggccagtcgagggctattagaagttattacgccttggttcagacaagaaaccgagggaaacctacccctaaactcctagtactacctacgctcgcctactccctatttcgacctacgtacgggttccggggttccccgttgttaacggttccgacggccgggcacggacggacgttcgagggactagtactttccgactctacaccntcgacgcaggtcccngacctacgccgtaagaagtcttcgtacgacttaattcttacagtaccaacgtgttaccttaacgtaacctacccttagtactttaccgttgggaccgtaacgggaccgtaggaggtaacgtactaaacgtaacgtgtacgggtgacctaggaaccctacgtattaccgtcgttctaccttcccg

SEQ ID NO: 290812 - DNA, 774 bp, Homo sapiens
  misc_feature: GYAE6OF01AKJEL.48.22.B11.1.454.CMB.1.raw
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttgacccagtctccatccttccctgtctgctatcgtgtaggagacgagtagtcctaccactccacgttcggacccgggccagtcgacgggtctattaggtaagtttagtttacggccttagggtttccagtaccgaaggtaaaacccgaaggggtaaaccacccccttaaaacgtccctaggtacctacgtaccgcttcgacctacttccctacgttttacgacctaaccggtacgggttccgggggtttacccctcgtttacgggttccgacgggtccggacgacggtccgggtaacgttcccgtagggggtaactaacggtacttttaccgaccgttcctcccaaacgtcctacgaccgccgagtaccctcgaccgaccgtaccgtaaggtaaggtacgtttcgttacgtaacccgtttaaactttacgttaccgttaacggtactaaacggtgtttaaccgttaacgtttaacccgtaaccccgttacccgttacgtttaccggttttccgggaaccggtacgggttaaccgaacgggttggaaaccgtacgtaacccgtaaacgaccggtttggtaccgacgttacgaccctaccttactacggttctttaccgtccttaacccg

SEQ ID NO: 290813 - DNA, 723 bp, Homo sapiens
  misc_feature: GYAE6OF01EGVR5.48.22.B11.1.454.CMB.1.raw
tcagagtatacatacacgaccggtgctcgatttagacgacagctcaggggcagtcccagtcaggacacagcatggacatgagggtccccgctcagctcctggggctcctgctgctctggctcccgaggtcgccagatgtgcctatccagttcgaccctagtcctacctattccttccctgtctgctatctggtaggagacaggtactctccgtatcctacgttcggaccggctaggtcgagggctaagttacgtaagtttattacgtcgttggttacagtacaacggaaaccggaggaaaccgtaccccttaaacgtcgtacgtacgtacctacgctacgtacctagttacccgtacttacgacgtacggtacgggttaccggggttccttacggtacggttaccgacggaccggtcgtagggaccgtgttcggaaggtaaccgtacgttacgtttaccaccgtctaaccctaactacgtacgaccggtactacccggtcgtcgaccgtataacccgtaaggtacgtcgtttgtaaccggttactttaaccgtttacgtacccggtaactaacgtaccgtacggttaccgttaacgtaccccttaacccgttccgttaacgttaccggttaggaccggttaacggacgttaggaggtactaacggtaacgtacggtacgtggacgtccgtacggccctaagttcctacgttgtcccttacccg

SEQ ID NO: 290814 - DNA, 813 bp, Homo sapiens
  misc_feature: GYAE6OF01DP4SM.48.22.B11.1.454.CMB.1.raw
tcagagtatacatacacgaccggtgctcgatttagacgacagctcaggggcagtcccagtcaggacacagcatggacatgacgggtccccgctcagctcctggggctcctgctgctctggctcccaggtgccagatggtgccatccagtttcgaccctagtcctccatccttccctgtctgctatcgtggtaggacgacaggtacgtcctccatcctacgttcggcccggggtaccacggtcgaggggtactaagtttaagtaaggtttatttacggtcctttggtttcgaagaccgtaacggaaaaccgaacggggaaaacctaccccctaaacgttccgtacgtaacgttcctaccggtcgtaccgtactaccgttaccttaccgtttcgaccgtaacgtacgggtccgggtaccccgttcggttaaggttcccgaggtccggaccgtacgggaccggtacttacgggtacggtaacgtaacgttacctttccgtaaccgttccgttaaccaccgttaacgtcgtaacgaaccgccgaccgttcggaccgtacggtacctaaggtaaagttgttacggttactaacctttaacgtttacgtttacgtacgtaacctaacgttacggtaaccttttacgttaaacccggtttaccccgttaccttaaccggttttacggtttaccggggaccgtaaacgggggtaacccgtagggtaacggtaacgtaacccggtaaacgtaacccggttacgttcgggacgttcccggtaaaccgtcgtaaccttcggtttaccttcggtttcccttaacg

SEQ ID NO: 290815 - DNA, 687 bp, Homo sapiens
  misc_feature: GYAE6OF01C6M3J.48.22.B11.1.454.CMB.1.raw
  modified_base (678)..(678): a, c, t, g, unknown or other
  misc_feature (678)..(678): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgccatctgtaggagacagacgtcctccatcaccgttggcccgggccagtcgagggctagttagtaagttatttacgccgttggtttacagtacaacgaaaccgaaggggaaacctaccccgttaaaactcctagactcgtacgtactagaccactcctactttcgacctacgtacggtcggggtacccgttcgtacggttcgaacgtccggacgacggtacggagtcggtagggaactagttacgttccaaccttccgtacaaccgtatacgaacgaccgacgtccgtagacccgtacgtaccgtagtaacggtattacggtacgtaacgttaacgtttactttaccgtacgttaaccaactacgtacgtttaaacggttaacccgttaacccgttaccgttaaccgttacgttttccggggacgtaaccgggtaaccgtaagggtagacgtaagtaaccgtaacggtacgtacggtcgtacgtacgtacctaacgtataccgtnttcctaccg

SEQ ID NO: 290816 - DNA, 659 bp, Homo sapiens
  misc_feature: GYAE6OF01DUIMK.48.22.B11.1.454.CMB.1.raw
  modified_base (89)..(89): a, c, t, g, unknown or other
  misc_feature (89)..(89): n is a, c, g, or t
  modified_base (123)..(123): a, c, t, g, unknown or other
  misc_feature (123)..(123): n is a, c, g, or t
  modified_base (128)..(128): a, c, t, g, unknown or other
  misc_feature (128)..(128): n is a, c, g, or t
  modified_base (622)..(622): a, c, t, g, unknown or other
  misc_feature (622)..(622): n is a, c, g, or t
tcagagtatacatacacgaccggtgctcgatttagacgacagctcagggcagtcccagtcaggacacagcatggacatgacggtcccgntcagctctgggctcctgctgctctgctccaggtnccagntgtgccatccagttcgaccagtctcatcttcctgtctgcatcgtagaggacacagagtcctccattcgacgttgcccggcagtcaggcagttagaagttcttagccttggttcaggtacacgaaaaccgacggtaaacgtccctaaaatcctgactccgtaacgtctacggtacctacttaccgtacgttttacgccgtaacgtcggttaccggggtcccttagttaacggttccgtaaggccgtacgaacggtacggtaacgttcggacgggtaaactacggtaactttccgaacgttacctacgaacctacgtcaacgtacgacgtccgtagaccgagtaccgtagtaaacgtacgtgtaacgtacctaaacgtttattactagtacaacctgtaacgtttaacgtaaccttaccgtacgttaacgttacgttacggaccgttaacgggacctaagggtcgaagtaaccgtacgtaaacgcgttaggacccncgttacacccgtaactaccgtactcgttacgttaccg

SEQ ID NO: 290817 - DNA, 896 bp, Homo sapiens
  misc_feature: GYAE6OF01B06BS.48.22.B11.1.454.CMB.1.raw
tcagagtatacatacacgaccggtgctcgatttagacgacagctcaggggcagtcccagtcaggacacagcatggacatggacgggtcccccgctcagcctccgtggggcctcctgctgctctggcctcccgaggtcgccagatcgtcgcctactcccgtaggttaccgacccgtagttcctccgtacttccctttcccgtgtctgacctagttccgtaggtacggacgacgagtaccgtcctacctactaccgtaccggttacgggcccggtacgtaaggcgtaaggtactaagtttaggttaagtttagtttacgtccgttaggttaccgaacgtaaccgaaaacggaaaccggtaacggtaaaccctaaccccgttaacctcgtacgtactaccgtacgctacgtacctacccgttacgttacttcggaccgtacggtaccgggttccggttcccgtacggttacggtaccggacgggaccggtcgtacgggtacggtacgttacgtacggtacgtacgttacctttccgacttacccgtaaccacgttaccgtacgaaccggtacctaccgggtcctaagtaacctaccggtaaaccgggtactaaacggttacgttaaccgttaccgttaaaccgtacttttaaccggtacttccgtaaactaccggtttaacttacccggttaaacccggttaaccccttaacccggttaccggtttaaacccggtttaccgggttaaccggggtacccggggtaaaccgggttaaaccgtaacggggttaaacgaacccggttaaaaccggttaacggtaaacccggttagggttaccggccgtaaaccgttccggtaaaccccttcgttacctttccttcccggttaaccgttacccg

SEQ ID NO: 290818 - DNA, 945 bp, Homo sapiens
  misc_feature: GYAE6OF01CXTWX.48.22.B11.1.454.CMB.1.raw
tcagagtatacatacacgaccggtgctcgatttagacgacagctcaggggcagtcccagtcaggacacagcatggacatggacgggtccccgctcagcctccgtggggcctcctgctgctcgtcggtcctacccgaggtcgaccaggtatcgtcgacctactcccgtacggttccgaaccccgtacgttccctaccctacctttcccgtttcccttcgtccgtcgtacctagttcggttagggtaagggaacgacgtacgtaccgttcctaccttaacttccgtaccggttccgggaccccgggaccgtacgggtacggtacgggtacttaaacggtttaaggtttaacgttttacggtttaaccgttccggtttacggtttaaccgaacggaaccgtaaaaaccgggaaacccggtaaaccgggtaaacccctacccccgttaaacttccgtaacgtacgttaccgtaccgcgtacacctaccttaccttacgtcgacgtaccggtacgggttccggtccgtacggtacgtcggacggtcgacggtacgtacgtcggtacggaggttactacgttaccgttcaccgttaccgtactaccgacgtaccgtaacgtcccgtaccggtcccgtaaggtacccgaagttcccgtaaaggtaacgtttccggttacgttaacctttaaaccctttaaccgggttttactaacccgggttttaacaaaccggtttaaacctttacggggtttaaacccctttaaacccccgggtttaaccccccgttttaacccgtacgggtttaacccggtttttcccgggaaacggggacccgggttaaaccgggtaaacggttacggtacgtaaaccgtaaacgtaaacccgggttacgtgggacccgttaccggtaccctggaaccccttgttactttaccgttccttcgtaaccc

SEQ ID NO: 290819 - DNA, 770 bp, Homo sapiens
  misc_feature: GYAE6OF01BX0H3.48.22.B11.1.454.CMB.1.raw
  modified_base (193)..(193): a, c, t, g, unknown or other
  misc_feature (193)..(193): n is a, c, g, or t
tcagagtatacatacacgaccggtgctcgatttagacgacagctcaggggcagtcccagtcaggacacagcatggacagtgagggtccccgctcagcctcctggggctcctgctgctctggctcccaggtgccagatgtgccatccagttcgaccctagtcctccatccttccctgtctgcatcgtgtagganacagatctcatcacgttcgccggccaggtcagggctagttacgtaagtttatttagccgttggtttaccagcaaacggaaaccgaacggggaaacctacccctaaaacgtcctaggtactccgtaacgcgtacgtcactcctacgtttcgacctacggtacgggttcgggtaccccttacgtacggttacacggtcggacacggtacggtacgtacggtacgggaactagttactttcaccttcgtacctacctagtaccgacgtaccgtacgtccgtacgaccgtacgtaccgtaaggaacgttacgttacgttaacgtaccgttaaacttttacgttacgttaccgttaaccgtaaacgttacggttaacccgtttaaacggttaaccccgtttaaaccccgttacccggtttaaaccgtttaaccggttttacccgggaaccgggttaaccggggtaaccgtaaacggggtaaccggtaacgtaaacgttaacccggtaaacggtacgttcgggtacggtaccgtaaccggtacccgtaacctacgtttccggttacgtttaccgtttaacccg

SEQ ID NO: 290820 - DNA, 707 bp, Homo sapiens
  misc_feature: GYAE6OF01DZ461.48.22.B11.1.454.CMB.1.raw
  modified_base (494)..(494): a, c, t, g, unknown or other
  misc_feature (494)..(494): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttcgacccagtctccatccttcctgtctgcatcgtgtaggacacagacgtcctccatcctacgttcggcccggcagtcgagggtctagttagtagttagttacgtccgttggtttacagacgaacgtaaaccgagggaaacctacccctaaactcctagtactacgtacgtctagcctactcctacgtttcgactacgtacgggtccgggttcccgtacgttacggttaccgacggtccggacgacgggtacggtacgtacggtacgggtaactacgttacctttccacttccgtacccacgtactcgaacgtccgaacgtccgtgacccgtacgtcgtaacgtagtnttacgttacgtaactttacttacgttactcgtaacctaacgtagtaacctttacggttaacccgttaccctaccggtttacgttaccgtttaccggaccggtaacgggtaaccggtagggtaacggtacgaacggtaaacctaaacggtccggttcgggtacggtccgttaccgtacctaaccgttaccgttaccgttcgttcccttaacccg

SEQ ID NO: 290821 - DNA, 845 bp, Homo sapiens
  misc_feature: GYAE6OF01DJ9AD.48.22.B11.1.454.CMB.1.raw
tcagagtatacatacacgaccggtgctcgatttagacgacagctcaggggcagtcccagtcaggacacagcatggacatgagggtccccgctcagctccgtggggctcctgctgctctggcctcccgaggtgccagatgtgccatccagttcgacccagtcctccacttccttcccttgtcctgcacttcgtaggtaggacgacgagacgtcctaccacttcctaccgttcggcccgggaccacggtcgaaggggtactagtttaaggtaagtttattacgtccttggtttacagacaaacggaaaccgaacggaaaccgtaccccctaaactcctacggtaactccgtacggctcgacctacctacccttacgttgacctaacggttacgggtccggggtacccgttacggttacggtcgaacggccggtacgacgggtccggtacgttcgggtaacggtaccgtaagtttaccgtttccgaccgttccctaaccgtaacccgtacgtaccgtaacgaccctaccggtaccgttacgaccggtacgtaccgtaacggtaacgttacgtacgtttaaccgtaaccgtttaaacttttaaccgttacgttaacccgttaaccgtaaacccggtttacgtttaacccggtttaaaccggttaacccgttaacccccgttaccggtttaaccgtttacccgggtttaacccgggaccgggtaaccgggttaacccggtaggggttaaccggacggtaaaccctaaacggtaaccggttacggtacgggtccgttaccgtaacccgtaccgtaaacgttaccgtttcccgttgtttcccgtttaacccg

SEQ ID NO: 290822 - DNA, 641 bp, Homo sapiens
  misc_feature: GYAE6OF01AWHA4.48.22.B11.1.454.CMB.1.raw
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttcgacccagtctccatcttccctgtctgctatctgtaggagacagtagtctccatcacttgccggccagtcgaggcattagaagttatttagccttggtttcgagtacgagaaaccgaagggaaacgaccccctaaactcctagactacgtacgctgctactacctacgttttgcctacgtacggtcggggttacccgtacgttaggttccgaggtccggcgtacggcgggtactcgtacgggactaagtaccgttttacactccttacaaccgtatccagaccacggcctggacacgtcgtagaagtagttcgttacgacttaactttacgttactcgtaacgtaactacggtaactttaacggtaacccgttaaccctaccgttaaccgttacgtttacggaccggtacgggaaccgtaggtacggacttaacggtaacgtaaaccggtagttcggacggttacgcgacctaactgttacttgtcccttacg

SEQ ID NO: 290823 - DNA, 790 bp, Homo sapiens
  misc_feature: GYAE6OF01E10Y0.48.22.B11.1.454.CMB.1.raw
  modified_base (91)..(91): a, c, t, g, unknown or other
  misc_feature (91)..(91): n is a, c, g, or t
  modified_base (178)..(178): a, c, t, g, unknown or other
  misc_feature (178)..(178): n is a, c, g, or t
tcagagtatacatacacgaccggtgctcgatttagacgacagctcaggggagtcccagtcaggacacagcatggacatgacgggtccccgntcagctccgtggggctcctgctgtctctggctccgagtcgcagtatgtcgcagtctagttcgacctgtcctcattccttcctgtacngctacttcgtaggacgagacacggtcgtctacctatcctacggtccggcccgggtactacggtacgaggtactaagtttaggtaactttagttcgtccgttggtcacgacgaacgaaacggtacggaacctacctaactcgtagacttccgtagctcgactacttaccgtctagactaacggttcgggtccggtttacctggttacggtcgacgggtaccggacgtacgggcgttacggtaccgtagggtaactaccgttacttaccgcctttcccgaactacccggttataccggtaccgtcgttacccgtcgtaccggacttacggacgttaaagggtaccgttagggtttacctaaccgttaacgtttaacccgtttaaactaccggttaacgtaaaccgtttaccggttaacctttacggttaacccgtttaaccccgtacccgttacccgttaagtttacccgggggtaccctaaggggtaacccgggtaacgttaggaccggttaaaccaccgggttaaacggttccgaagtttcccgggagttacccgttcccgaagtttacccggttctttaccggtactttcccccgtgttaacccccccggg

SEQ ID NO: 290824 - DNA, 756 bp, Homo sapiens
  misc_feature: GYAE6OF01AJ929.48.22.B11.1.454.CMB.1.raw
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttcgacccagtcctccattccttccctgtctgcatctggtaggagacagagtcctcatcacgttcggcccggcagtcgaggtcagttagtaagtttattagtccgttggtttcagcgaaaggaaaccgaagggaaaccgaccccgtaaactccgtagactctacgtcgtcgctacctcctacgtttccgacgtaacgtcgggtccgggttcccgttacgtacggttccgacggtcggacgtacgggcggtaacgtcggtagggacctacggttacttaccaccgtctaccccacgtactcgaacgcgtacgccgtacgccgtaacgtccgttaaggaacgtagttacgttacgtaaccttactttaacgttacgtacgtaactaacgttacgttaacgttttaaccgttaaccccgggttaaaccccgtttacccggttaaccgttttaacccggtttaccgggaaacccgggtaccggggttaaaccggtaacggggttaggaaccgtaaaccgttaaacccggaaacggtacggtacgggtaccggttccgtaacgtacccgttaacccttacgtttaccgtttaccggttcctttcccgttaaccccg

SEQ ID NO: 290825 - DNA, 774 bp, Homo sapiens
  misc_feature: GYAE6OF01BI6S8.48.22.B11.1.454.CMB.1.raw
  modified_base (173)..(173): a, c, t, g, unknown or other
  misc_feature (173)..(173): n is a, c, g, or t
  modified_base (463)..(463): a, c, t, g, unknown or other
  misc_feature (463)..(463): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtcgccagatgtcgccatccagttcgacccagtctccattcttcccngtctgctatctgtaggagacagctctccatctacgttgccggacagtcgaggtctagttagtagtttattacgcgttggtttacgagaccgtaacgaaaccggaacgggaaaccgtacccccttaaactccgtacggtacttacctaacggccttacgtaccgtacttacccttaactttcgacctacggtacgggttacccggggttcccttaccgttacggttcccgacggtccggtaccgaggtaccggtaacgtcgggttacggggaactaacggtcttttacccncttaccgtacccaaaccgtactccgtacggtaccctcggtacccgttaccgacgtacccggtacccgttagtaacgttacgtttacgggttactaaaccgtttaacgtttaccttaaaccggttcgttaaccgtaaacgtacgtttaaccgttaaccggttacccgttaaccccgtttaccgttaccttacccgggttttacgggaaccggttaaccggggtaaccgtagggttaccggaacgtaccggtaaaccttaacgggcgttacggtcgtaacgtaccaccgtaactacgttcttgtcccttaacg

SEQ ID NO: 290826 - DNA, 883 bp, Homo sapiens
  misc_feature: GYAE6OF01BYXZX.48.22.B11.1.454.CMB.1.raw
tcagagtatacatacacgaccggtgctcgatttagacgacagctcagggggagtcccagtcaggacacagcatggacatgagggtccccgctcagctcctggggctcctgctgcctctggcctcccgaggtcgccagatgtcgccatccgtagttcgaccctagtctcctattccttccctgtctggactatccgtaggtaggacgacgaggtacgtcctaccacttccgtacggttcgggaccccgggactaggtccgagggtctagttaaggttaagtttacgtttacggaccgttcgggtttacaacggtaccgaaacgtaaaaccgggaacgggtaaacccgtaccccttaaacgtccgtaacgtacttacccggtacgtccgtacgtaccgtaccttccggttacttcgaaccgtaccgggttacggggttcccggggttacccttcggttacgggttacgaaccgggcgggtaccggacgggtaccgggttacggttaccgggtacggggtaaaccgttaggttaaccttttacccgggtaccctttaccggttaaacccctaccgttaaacggtaccgtaaccgtaccggtaacccggtccgttaaccgtaccgtaccggtacggttaagtaacggtagtttacggtctaaaccgtttaacttacgtttaccggtaacgttcccgaagttacgttaaccgtttaacgtacccgttaacccgtttcgttaaccggtacgtttaccggggacgttaaccgggtaccggtaaggtaacggttaccaacggttaaaccggacggttaggtacccgtgggttaccccgtaataccccgttagttacggttctttaaccccgtcggtttaacctacccccgg

SEQ ID NO: 290827 - DNA, 846 bp, Homo sapiens
  misc_feature: GYAE6OF01DTFTT.48.22.B11.1.454.CMB.1.raw
  modified_base (830)..(830): a, c, t, g, unknown or other
  misc_feature (830)..(830): n is a, c, g, or t
tcagagtatacatacacgaccggtgctcgatttagacgacagctcaggggcagtcccagtcaggacacagcatggacatgacgggtccccgctcagcctccgtggggctcctgctgctcgtcggcctcccgaggtcgccagatgtcgcctactccagttacgacccgtagttcctcctacgttcctttcccgtgtctcgctacgtcgtaggtacggacgacgtagtacgtcctaccgtacttacgtaccggttccgggccccgggaccgtacggtaccggaagggtacttaaagttaacggtttaaacgtttacgttttaccggtaccgtttacgggtttaccgaacggaaccgtaaaaaccggtaaaacccgggaaaccggtaaaccccgttaacccccttaaaacgtccgtaagttactaccgtacgtctaccggtaacttaccgttcccttacgttcggaccgtaaccgggtccggggttccgggttaccgtacggttacggtccggacggccggtaggacggttaccgcgttacgggtaacggaaccttcgttacttacccgtaccgtacctacctaacgtacgtaccggaacgtacccgtcgtaccgtacggactacccgggtagtaaggttagtttacggtccttaacgttaacctttaacgtttaacggtcaacgtaacgtaacgttaccgtttaacttaacccggtaaacccttccgttaccgttacggtttaccggtacggacgggtaaccgtagttagggacttaaacgtaccggtaacgtacgttagtcgggctaaccctcgtacccttagcccgtttntccggttcctaacccg

SEQ ID NO: 290828 - DNA, 779 bp, Homo sapiens
  misc_feature: GYAE6OF01C8WM4.48.22.B11.1.454.CMB.1.raw
  modified_base (631)..(631): a, c, t, g, unknown or other
  misc_feature (631)..(631): n is a, c, g, or t
tcagagtatacatacacgaccggtgctcgatttagacgacagctcgaggggagtcccagtcaggaccacgagcatggacagtgacgggtccccgctcagctccgtggggctcctgctgctctggctccgaggtcgccagtatggtcgcctactccgagttcgaccctagtcctcctattccttcctgtcgtagctagttccgtaggtaacggacgtaaccgaggtacttcctaccgacttacgtaccgttcgggacccgggacctaaacgggtcgaacgggtccttaagttaggtaacgttttacttacggtccgttcggttacgaacgtaaccgtaaacggtaaaaccggaaacgggtaaacctaccccgtaaacgttaccgtacgaacgttccgtaacgtccgtacgaccttacttaccgtacgttcgacgtacggtacgggttccgggtaccttacggtacggtcgacggtacggcgtaaggtccggtaatccggtaggtaactagtccttacacgttacctacgactaacgcgtacgccgtacgaccgtacgacgtaaccgtacgtacgtaaacgttacgttacggtaactaacgttaacttaacgtaccgtacgttaacgaacgtnttaacggtttaactaccggttaacccgtacgttacgttaccgtacgggaaccggtaggaacggttaaacgggtcgaacgtaaacgtaacgaaacgtacgtggtacgtaccacgtaaccgtactaacttgtaacctccttacggtaccc

SEQ ID NO: 290829 - DNA, 825 bp, Homo sapiens
  misc_feature: GYAE6OF01BSFTD.48.22.B11.1.454.CMB.1.raw
  modified_base (814)..(814): a, c, t, g, unknown or other
  misc_feature (814)..(814): n is a, c, g, or t
tcagagtatacatacacgaccggtgctcgatttagacgacagctcagggggcagtcccagtcaggacacagcatggacatggacgggtccccgctcagcctccgtggggccttcctgctgcctcgtgcctcccgaggtcgccagattgtcgacctacttccgtaggttacgacccctagttcctccgtacttccctttcccgttggttcctcgacctaattccgtaggaacggacgaactacggtacccgtacccctaattccgtaacccgttcgggcccgggacctagggtaccgacgggtactttaagttaacggttaacgttttacgtttaccgtccggtttaggttaccgaacgtaaccgaaaacggtaaacccgggaacgggtaaaaccctacccccttaacgttcgtacgttaactaccgtacgccgttacgtacctaccttaccgttacgtttcgaccggtacggttacgggtttcccgggttaccttacgtaccgggtcgtaccggcgggtacacgggtccgtagtacgggtcggtaactaacggtttactcctaacgtccctaaccgacgtacgtcgaaccgtccgacgtaccgcgtacgtacgtacgtaagtacgtattacggtacttaacgttaacttacgtacgtactacgtacgttacgtaacggttaccttaaccggtccttaggttaccttcgggttaccggacggtacggtacggtagtaaccggacgtaaaccacggtacgttaagggtccgtcggacctccggtaaacctccggttataccgttttacttcccgtnttaacccccgg

SEQ ID NO: 290830 - DNA, 953 bp, Homo sapiens
  misc_feature: GYAE6OF01CVL3G.48.22.B11.1.454.CMB.1.raw
tcagagtatacatacacgaccggtgctcgatttagacgacagctcaggggcagtcccagtcaggacacagcatggacatggacgggtccccgctcagctccgtggggctcctgctgctcgtcggcctcccgagggtacgccaggtatcggtcgcctaacgtcccgtaacggtttaccgaccccgtagttccctacccgttactttccccgtttcccttcgttccgtcgtaccttacgttccggtaagggtaagggaacgaacggtacggtaccgtttcctaacctaaccgttaccgttaccgggttcccggggaccccgggacccgtacgggtaaccgggtaacggtaaccgttaaaggttttaaggtttaaaccgtttttaaggtttaccggttccggttttacggttaccgaacggtaaacccgtaaaaacgggaaaaccccgggaaacgggtaaaccccgttaacccccgttaaccgttacgtaccgtaaccgtttaccgtacgtaccgttctaaccttacccgtttaccttacgtttaccgacggtacgggtttaccggggtcgggtttacccgtaggttaccgtacggcggacggtacgtacgggtacggtacggtacggtaacggtacttaacgtccttactacccgtacctaccgtaaccagttacccgcggtaccaccgtccgtacgtaccgaccggttacgtaagtacggtagtttaccgttaaactaaccgtttactttaaccgtcgtttaaccgtacgttaaccgttacgtttaacccgttaaccggttcccgttaaaccccgttaccgttaaccggttacggtttaacccgggacgggtaaaccgggtaggtaaccgggtaggtaaaccgtgttaaacggttaacggtccggttacggccgttacgacgtaccgtaacttccggtttctcttacgttaccg

SEQ ID NO: 290831 - DNA, 705 bp, Homo sapiens
  misc_feature: GYAE6OF01DQKKB.48.22.B11.1.454.CMB.1.raw
  modified_base (504)..(504): a, c, t, g, unknown or other
  misc_feature (504)..(504): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtcgccagtatgtcgccatccagttcgaccctagtcctcctattccttccctgtacctgactattcctaggtaggacgtacaggtactctaccattcctacgttcggccgggccagtcagggctaagttagtaacgtttattacgtccgttggttacacggacaacgaaaccggaagggaaaccaccccctaaatccctaggtactacctaccgctacgtcctacctccttacctttcggaccgtaccgtacgggttccggggttccccgttacggttacggttcgaacggtcccgggactacgggtacggtacgtcgtacggggtactacggttactactacccgtctacctacctagtaccagtacccacgtaccncgaacgccgtaccgtaggtaacgtacgttacgtacgtaccttaaactttacttactaggttacccaagtacgttaacgttaccgttaaccgttaccccgttagttaccgtttcggttaccggacggtacgggtaacctagggacctaagtaacgtaacgacggtagtcggtcgactacacctacttagtcctgtcttaccg

SEQ ID NO: 290832 - DNA, 702 bp, Homo sapiens
  misc_feature: GYAE6OF01COIGH.48.22.B11.1.454.CMB.1.raw
  modified_base (217)..(217): a, c, t, g, unknown or other
  misc_feature (217)..(217): n is a, c, g, or t
  modified_base (286)..(286): a, c, t, g, unknown or other
  misc_feature (286)..(286): n is a, c, g, or t
  modified_base (315)..(315): a, c, t, g, unknown or other
  misc_feature (315)..(315): n is a, c, g, or t
  modified_base (317)..(317): a, c, t, g, unknown or other
  misc_feature (317)..(317): n is a, c, g, or t
  modified_base (322)..(322): a, c, t, g, unknown or other
  misc_feature (322)..(322): n is a, c, g, or t
  modified_base (373)..(373): a, c, t, g, unknown or other
  misc_feature (373)..(373): n is a, c, g, or t
  modified_base (383)..(383): a, c, t, g, unknown or other
  misc_feature (383)..(383): n is a, c, g, or t
  modified_base (402)..(402): a, c, t, g, unknown or other
  misc_feature (402)..(402): n is a, c, g, or t
tcagagtatacatacacgaccggtgctcgatttagacgacagctcaggggagtcccagtcaggacacagcatggacatggacgggtcccccgctcagcctccgtggggccttcctgctgcctcgtcggcctcccgaggtcgaccagtatgtcgcctatccctagttcgaccctagtcctccacttccgttcccctgtctcgtctatcgtggaagganacagatccacatactcgtcggccggacagtcgaggactagttaagtagtttacgttagccgttagtacngacaaagaacgaacgaactccctaagctnancagcngtacctctctctacgacacggtcggttcgggtcctgtacggtcgaggccgngaggacggtntacgaggtactgtacctanccctataaccacgtactagacctcgacgcctgtaccgacgtataacgatacgttagacctaaccttattacgtactacgtaccttaagtaccgtaccttaacgttacccccgtaacgtttaacccgtacgtttaaccggttaccgggtaaccgggttacgggaaccggttaaacgggaggtaaaaccggtaaaccgtaaacgggtaaaaccccgttacgggtaccggttacgggtaacccgtacgtaacccttaaccggttaccttacccgttaacggtttcctaaacccggtttccccg

SEQ ID NO: 290833 - DNA, 710 bp, Homo sapiens
  misc_feature: GYAE6OF01ECK9R.48.22.B11.1.454.CMB.1.raw
  modified_base (675)..(675): a, c, t, g, unknown or other
  misc_feature (675)..(675): n is a, c, g, or t
  modified_base (694)..(694): a, c, t, g, unknown or other
  misc_feature (694)..(694): n is a, c, g, or t
tcagagtatacatacacgaccggtgctcgatttagacgacagctcaggggagtccccagtcaggacacagcatggacatgagggtccccgctcagctcctggggctcctgctgctctggctcccgaggtgccagatgtgccatccagttcgacccacgtcctcctacttccttccctgtcttcgctatctggtaggagacagacgtcctcatctacgttcggcccggcaggtccgagggtactagtttacggtaagtttattacggtccgttggtttaccagaccgaacgaaaaccggtaacggaaacctaccccgtaacttccgtagtaccttaccgtacgctcgacctacttcccttacgtttcgaccgtacggtcgggttccgggttccgttacgttacggttccgacggccggtacgacggtacggtacgtcggtacgggtacgtacgttacgttacgtaccgtcctaccaacttacgtaccgacgaccgttacgcccgtacggccgtagtacccgtaggaaacgttgttacggttagtaaccctttaatttacttactacgttactaacgtacgttacgttaaccgttaaccgtttaaccctaccgttaacgtttccgtaacgggacggtaacggtacgtaggaacgtacgtaactacgtaacgttacgnggtcacgtcactctacttntacgtcttcgtacccg

SEQ ID NO: 290834 - DNA, 485 bp, Homo sapiens
  misc_feature: GYAE6OF02IKSK4.48.22.B11.1.454.CMB.1.raw
  modified_base (313)..(313): a, c, t, g, unknown or other
  misc_feature (313)..(313): n is a, c, g, or t
  modified_base (377)..(377): a, c, t, g, unknown or other
  misc_feature (377)..(377): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttatttagcctggtttcagcagaaaccagggaaagcccctaaatcctgatctacgctgcatccactttgcacagtgggtccctntaggttcagcgcagcggatctgggacagatttcactctcaccatcagcagctgcagcctgaagntgttgactaacttattactgtacaacagtcttagtacgtaaccctcgtactacttttcggaccagggaccaaggtgagatacaaacgatgtgctgcaccatctgtctc

SEQ ID NO: 290835 - DNA, 491 bp, Homo sapiens
  misc_feature: GYAE6OF02GEZEW.48.22.B11.1.454.CMB.1.raw
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttatttagcctggtttcagcagaaaccagggaaagcccctaaactcctgatctacgctgcatccactttgcacagtgggtcccgtctaggttcagcggcagcggatctgggacagatttcactctcaccatcagcagcctgcagcctgaagatgttgactaacttattactgtacaacagcttagtacgtaaccctcgtactacttttggccgagggaccaaggtggagatacaaacgaactgtgctgcaccatctgtcttc

SEQ ID NO: 290836 - DNA, 507 bp, Homo sapiens
  misc_feature: GYAE6OF02JWJJR.48.22.B11.1.454.CMB.1.raw
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttatttagcctggtttcagcagaaaccagggaaagcccctaaatcctgatctacgctgcatccactttgcacagtgggtccgtctaggttcagcggcagcggatcgtgggacagatttcactctcaccatcagcagcctgcagcctagaagatgttgctaacttattacctgtacaactagcttagtacgtaaccctcgtactacttttcggacctaggggaccaaggtggagtaacgtcaaacgaactggtaggcgtacgcaccatctcgttcttac

SEQ ID NO: 290837 - DNA, 609 bp, Homo sapiens
  misc_feature: GYAE6OF02JFJJY.48.22.B11.1.454.CMB.1.raw
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttatttagcctggtttcagcagaaccagggaaagcccctaaaactcctgatctacgctgcatccactttgcacagtgggtcccgtctaggttcagcggcagcggatctgggacagatttcactctcacatcagcagcctgcagcctgaagatgttgcaacttattactgtcaaactactttaaacaactttaccctactaacttaaacgtcccgttttacgggaccctaaaacgggggtaccccctaaggggttaccgggaaaaacccgtaaacggtacccgggtaaaacccgttcggggttaaccgggtacccgtttagggaccccgtaaccccgtaacgtttacccctttacgggtttacccttttacccgtaacccg

SEQ ID NO: 290838 - DNA, 489 bp, Homo sapiens
  misc_feature: GYAE6OF02HVAZ7.48.22.B11.1.454.CMB.1.raw
  modified_base (344)..(344): a, c, t, g, unknown or other
  misc_feature (344)..(344): n is a, c, g, or t
  modified_base (384)..(384): a, c, t, g, unknown or other
  misc_feature (384)..(384): n is a, c, g, or t
  modified_base (483)..(483): a, c, t, g, unknown or other
  misc_feature (483)..(483): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagatgacccagtctccatcctccctgtctgcatctgtaggagacagagtcaccttcacttgccgggcaagtcaggacattaaaagtgatttagcctggtatcagcagaaaccagggagagcccctaagctcctcatctatgctgcttccattttacaaagtggagtctcatcaaggttcagcggcggtggatctggcacngatttcactctcaccatcagcagcctgcagcctgaaagtnttttgactaacttattactgtctgctacgtattaacacttaccctcgtacgttcgccgaagggacaagggtcggaagtacaaacgactgcgctgccacntctacg

SEQ ID NO: 290839 - DNA, 486 bp, Homo sapiens
  misc_feature: GYAE6OF02HT1A8.48.22.B11.1.454.CMB.1.raw
  modified_base (263)..(263): a, c, t, g, unknown or other
  misc_feature (263)..(263): n is a, c, g, or t
  modified_base (312)..(312): a, c, t, g, unknown or other
  misc_feature (312)..(312): n is a, c, g, or t
tcagagtatacatacacgaccggtgctcgatttagacgacagctcaggggcagtcccagtcaggacacagcatggacatgaggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttatttagcctggtttcagcagaaaccagggaaancccctaaatcctgatctacgctgcatccactttgcacagtgggtccctntaggttcagcggcagcggatctgggacagatttcactctcaccatcagcagcctgcagcctgaagatgttgcaacttattactgtcaacagcttagtacgtaaccctccgtactacttttggcctagggaccaaggtggagagtcaaacgactagtgctgcaccatctgtcttc

SEQ ID NO: 290840 - DNA, 511 bp, Homo sapiens
  misc_feature: GYAE6OF02IVZYU.48.22.B11.1.454.CMB.1.raw
  modified_base (314)..(314): a, c, t, g, unknown or other
  misc_feature (314)..(314): n is a, c, g, or t
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttattagcctggtttcagcagaaaccagggaaacgcccctaaatcctgatctacgctgcatccactttgcacagtcggggtccctntaggttcagcggcagcggatcgtgggacagatttcactctcaccatcagcagcctgcagcctgaagatgttgctaacttattactgtacaacagtcttagtacgttaaccctcgtactacgttttcggaccgtaggggaaccaagggtggagagtacgaaacggtaactggtggctgaccacgtatctgtcttctac

SEQ ID NO: 290841 - DNA, 634 bp, Homo sapiens
  misc_feature: GYAE6OF02HHKWY.48.22.B11.1.454.CMB.1.raw
  modified_base (496)..(496): a, c, t, g, unknown or other
  misc_feature (496)..(496): n is a, c, g, or t
tcagagtatacatacacgaccggtgctcgatttagacgacagctcagggggtaggtcccagtctaggacacagcatcggacatgagggtccccgactcagctcctggggctcctgcctgctctggctcccaggtcgccagatgtgcccatccagttcgaccccagtctccattccgttccctgtctgcatcctgtaggacacacgagtctccatcactttcgcccggcagtccagggcattagaagttatttagccttaggtttcagtcgaacgaaaccagggaaaccgaccccgtaaaacgtcctaggacttcgtaacggcgtcgctaactccctacttttggcctaccgtacggttcggggttaccccgtcgttacggttccaggaccggcgacgcggtatcgtgggacagtactttcactctacacctatcagcagcctagcacgtcctaggaacgtgtgttacgacttaactttattactagtaacaaagtntactacttaccgacccctagtacctacccgttaccgaccgaaacggaccaccggtacgtacggtaacgtaacgtttaaaccgaccttggtaccgacctacggtacccaccgtacgttaccgtcttaccgttctacccg

SEQ ID NO: 290842 - DNA, 504 bp, Homo sapiens
  misc_feature: GYAE6OF02F9UYZ.48.22.B11.1.454.CMB.1.raw
  modified_base (315)..(315): a, c, t, g, unknown or other
  misc_feature (315)..(315): n is a, c, g, or t
  modified_base (381)..(381): a, c, t, g, unknown or other
  misc_feature (381)..(381): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttatttagcctggtttcagcagaaaccagggaaagcccctaaactcctgatctacgctgcatccactttgcacagtgggtcccgtntaggttcagcggcagcggatctgggacagatttcactctcaccatcagcagcctgcagcctgaagntgttgactaacttattactgtacaacagtacttagtacgtaacccttccgtacctacgttttcgaccgtaggggaccaaggtggagtagtacaaacgactgtgctgcacctatctgtcttacc

SEQ ID NO: 290843 - DNA, 485 bp, Homo sapiens
  misc_feature: GYAE6OF02GC4QY.48.22.B11.1.454.CMB.1.raw
  modified_base (314)..(314): a, c, t, g, unknown or other
  misc_feature (314)..(314): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttatttagcctggtttcagcagaaaccagggaaagcccctaaatcctgatctacgctgcatccactttgcacagtggggtccctntaggttcagcggcagcggatctgggacagatttcactctcaccatcagcagcctgcagcctgaagatgttgcaacttattactgtcaacagcttagtacgtaaccctcgtactacttttggccagggaccaaggtgagagtcaaacgactgtgctgcaccatctgtcttac

SEQ ID NO: 290844 - DNA, 564 bp, Homo sapiens
  misc_feature: GYAE6OF02FR9FG.48.22.B11.1.454.CMB.1.raw
  modified_base (338)..(338): a, c, t, g, unknown or other
  misc_feature (338)..(338): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttattagctgttcagcagaaacagggaaagcccctaaactcctgatctacgctgcatccactttgcacgaggtcggggtccctgtaggttcaggcggcaggcggatcgngggacaggtatttcacttctcaccatcagcagcctgcacgcctagaagtagttgttacgactaactttattactgtacaacagtcttaagtacgtaacccttccgtaacttacgttttacgggaccgtaacggggaccctaagggttacgggaacgtaacgttaaccgaaaacgtacgttaggtacggtactacggacctaaccgtattcgttacgtcctttaccg

SEQ ID NO: 290845 - DNA, 513 bp, Homo sapiens
  misc_feature: GYAE6OF02HGCYM.48.22.B11.1.454.CMB.1.raw
  modified_base (507)..(507): a, c, t, g, unknown or other
  misc_feature (507)..(507): n is a, c, g, or t
tcagagtatacatacacgaccggtgctcgatttagacgacagctcagggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttattagcctggtttcagcagaaaccagggaaacgcccctaaactcctgatctacgctgcatccactttgcacgagtcggggtcccgtcgtaggttcaggcggcaggcggatcgtgggacagtatttcactctcaccatcagcagcctgcagcctagaagatgttcgtactaacttattactgtacaactagtcttagtacgtaaccctcgtactacgtttcggccgtacgggaccgaggtgagacgtacgaaacgacgtgtagcgtcgcacatctntcttac

SEQ ID NO: 290846 - DNA, 526 bp, Homo sapiens
  misc_feature: GYAE6OF02GU3C8.48.22.B11.1.454.CMB.1.raw
  modified_base (316)..(316): a, c, t, g, unknown or other
  misc_feature (316)..(316): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccggccagtcagggcattagaagttatttagcctggtttcagcagaaaccagggaaacgcccctaaactcctgatctacgctgcatccactttgcacagtcggggtccctntaggttcaggcggcagcggatcgtgggacagtatttcactctcaccatcagcacgcctgcagcctagaagatgttgactaacttattactgtacaactagtacttagtacgttaaccctccgtacttacgttttcggaccgtaagggaccgaagggtacggagacgtacgaaacgtaacgtgtcggtctacgacacctatcttgtcttcg

SEQ ID NO: 290847 - DNA, 584 bp, Homo sapiens
  misc_feature: GYAE6OF02I624T.48.22.B11.1.454.CMB.1.raw
  modified_base (229)..(229): a, c, t, g, unknown or other
  misc_feature (229)..(229): n is a, c, g, or t
  modified_base (314)..(314): a, c, t, g, unknown or other
  misc_feature (314)..(314): n is a, c, g, or t
  modified_base (415)..(415): a, c, t, g, unknown or other
  misc_feature (415)..(415): n is a, c, g, or t
tcagagtatacatacacgaccggtgctcgatttagacgacagctcaggggagtcccagtcaggacacagcatggacatgagggtccccgctcagctcctggggctccttctgctctggctcccaggtgccagatgtgccatccagttgacccagtctccatcttccctgtctgcatctgtaggagacagagtctccatcacttgccggcagtcagggcattagaagttnttagcctggtttcagcagaaaccgagggaaacgcccctaaatcctgatctacgctaagcatccacttgcacaggtcgggtccctntaggttcaggcgcaggcggtatcgtgggactagtactttcgactcgtacaccgatcacgcacgcctgccagcctgaagtatgttacgacttaaaccgtttntaacgtgtaccaacgtagtacgtttaagtaacgttaacccctccggtaactttaccggtttcggacccgtaaggggtacctaaacgggtggaacgtctaaccgtaaaccgacgttcggtacggtccgtacgaccaccgtagttaccttcggtacttctacgttaccccg

SEQ ID NO: 290848 - DNA, 574 bp, Homo sapiens
  misc_feature: GYAE6OF02JQBCH.48.22.B11.1.454.CMB.1.raw
  modified_base (314)..(314): a, c, t, g, unknown or other
  misc_feature (314)..(314): n is a, c, g, or t
  modified_base (362)..(362): a, c, t, g, unknown or other
  misc_feature (362)..(362): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccggcagtcagggcattagaagttattagcctggtttcagcagaaaaccagggaaacgcccctaaaactcctgatctacgctgcatccactttgcacagtcgggtcctntaggtcagcgcagcggtatcgtgggacagtatttcgactcgtacaccntacgagcacgcctgcagccgtagacgtatgtgactaaactttattactgtacaacgtacgtacttagtactaacccgtccgtaacttacgttttacggaccgtaacgggggtaaccctaagggtcgtaacgtaacgttaaccgaaaaggttaaccgttaggtacggtaccgttagtacccgaaccaagtttcccgttggttaccctttaacg

SEQ ID NO: 290849 - DNA, 584 bp, Homo sapiens
  misc_feature: GYAE6OF02HRTW7.48.22.B11.1.454.CMB.1.raw
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttatttagcctggtttcagcaagaaaccagggaaacgcccctaaactcctgatctacgctgcatccactttgcacaggtgggtccctgtaggttcaggcggcagcggatcgtgggacagtatttcacttctcaccatcagcacgcctgcacgcctagaagagtgttgactaactttattacttagtaccaactagtacttaacgttaccgtaacccttacccgttacgttacgttttacgggaccgtaacggggtaaccgtaagggtacggaaggtaacgtaacgtaaaccggtaacgttacggttacggtaccgttacgaccgtaacccgtacttaccgttacgttccttaccg

SEQ ID NO: 290850 - DNA, 510 bp, Homo sapiens
  misc_feature: GYAE6OF02F1PBD.48.22.B11.1.454.CMB.1.raw
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttatttagcctggtttcagcaagaaaccagggaaagcccctaaactcctgatctacgctgcatccactttgcacagtcgggtcccgtctaggttcagcggcagcggatcgtgggacagatttcactctacaccatcagcacgcctgcagcctagaagatgttcgactaacttattactgtacaacagtcttagtacgtaaccctccgtactacgttttcggaccgtacgggacctaagggtgagagtacgaaacgtactgtaggctgcactatctgtctac

SEQ ID NO: 290851 - DNA, 489 bp, Homo sapiens
  misc_feature: GYAE6OF02HAXJS.48.22.B11.1.454.CMB.1.raw
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttatttagcctggtttcagcagaaaccagggaaagcccctaaactcctgatctacgctgcatccactttgcacagtgggtcccgtctaggttcagcggcagcggatctgggacagatttcactctcaccatcagcagcctgcagcctgaagatgttgctaacttattactgtacaacagtcttagtacgtaaccctcgtactactttggccagggaccaggtgagagtacaacgaactgtgcgtgcaccatctgtcttac

SEQ ID NO: 290852 - DNA, 489 bp, Homo sapiens
  misc_feature: GYAE6OF02GN6P6.48.22.B11.1.454.CMB.1.raw
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttatttagcctggtttcagcagaaaccagggaaagcccctaaactcctgatctacgctgcatccactttgcacagtggggtcccgtctaggttcagcggcagcggatctgggacagatttcactctcaccatcagcagcctgcagcctagaagatgttgcaacttattactgtcaacagcttagtacgtaaccctccgtactacttttgccagggaccaaggtgagatcaaacgaactgtggctgcaccatctgtcttac

SEQ ID NO: 290853 - DNA, 510 bp, Homo sapiens
  misc_feature: GYAE6OF02GJDH3.48.22.B11.1.454.CMB.1.raw
  modified_base (507)..(507): a, c, t, g, unknown or other
  misc_feature (507)..(507): n is a, c, g, or t
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttatttagcctggtttcagcagaaaccagggaaagcccctaaactcctgatctacgctgcatccactttgcacagtcggggtcccgtctaggttcagcggcagcggatctgggacagtattcactctcacatcagcagcctgcagcctagaagatgttgactaactttattactgtacaacagtacttagtacgtaaccctcgtactacgttttcggaccgtagggaccaaggtggagtatacgaaacgtactggtggtctgaccactatctcgttctntac

SEQ ID NO: 290854 - DNA, 583 bp, Homo sapiens
  misc_feature: GYAE6OF02IRDOM.48.22.B11.1.454.CMB.1.raw
  modified_base (318)..(318): a, c, t, g, unknown or other
  misc_feature (318)..(318): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttcctgtctgcatctgtaggagacagagtctccatcacttgccggcagtcagggcattagaagttattagccttggttcagacaagaaaccgagggaaacgacccctaaactcctagactctacgctgcatccacttgcacgaggtcgggtcctntaggtcagcggcagcgatcgtgggacagtactttcactctacaccatcagcacgcctgcacgtctagaagtagtgttgactaactttattactagtaccaactacgtacttaagttaacgtaacccttaccgttaaccttaccgttttacggacccgtaacggggtaccgtaagggtacggtaacgtacgtaaccgtaaaccggtaacgttacggtacggtaccgttacggtaccaacccgtagttaccgttacgttccttaccg

SEQ ID NO: 290855 - DNA, 577 bp, Homo sapiens
  misc_feature: GYAE6OF02JFGTT.48.22.B11.1.454.CMB.1.raw
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttatttagcctggtttcagcagaaaccagggaaagcccctaaactcctgatctacgctgcatccactttgcacaggtcggggtcccgtctaggttcagcggcagcggatcgtgggacagatttcactctcaccatcagcagcctgcagcctagaagatgttgactaaactttattactgtacaactagtactttaagtaacgttaacccctccgttaacctacgtttttcggacccgtaacggggtaaccctaaggggtacggtacgtacgtaaccgtaaaacggtaaccgttgggtacggaccgttacggacctaaccgtacgttccgttacggttccttacctaccg

SEQ ID NO: 290856 - DNA, 543 bp, Homo sapiens
  misc_feature: GYAE6OF02FYK24.48.22.B11.1.454.CMB.1.raw
  modified_base (258)..(258): a, c, t, g, unknown or other
  misc_feature (258)..(258): n is a, c, g, or t
  modified_base (318)..(318): a, c, t, g, unknown or other
  misc_feature (318)..(318): n is a, c, g, or t
tcagagtatacatacacgaccggtgctcgatttagacgacagctcagggggcagtcccagtcaggaccacagcatggacatgagggtccccgctcagctcctggggctcctgctgctctggctcccaggtgccagatgtgccatccagttgacccagtctccatcttccctgtctgcatctgtaggagacagagtctccatcacttgccggccagtcagggcattagaagttatttagcctggtttcagcagaaaccngggaaagccccctaaatcctagatctacgctgcatccactttgcacagtcggggtccctntaggttcagcggcagcggatctgggacagatttcactctcacccagtcagcacgcctgcagcctagaacgtatgttgactaacttattactgtacaacagtacttagtacgttaacccctacgtacctacgttttcggaccctaggggtaccaagggtggaacgtaacgtacgaaaaccgtacgttacggtagtccgtagccgtaacctatccttagtcttaccg

SEQ ID NO: 290857 - DNA, 699 bp, Homo sapiens
  misc_feature: GYAE6OF02H3GJE.48.22.B11.1.454.CMB.1.raw
  modified_base (141)..(141): a, c, t, g, unknown or other
  misc_feature (141)..(141): n is a, c, g, or t
  modified_base (265)..(265): a, c, t, g, unknown or other
  misc_feature (265)..(265): n is a, c, g, or t
tcagagtatacatacacgaccggtgctcgatttagacgacagctcaggggtcgagtcccagtccaggacacgagcatggacagtgagggtccccgcgtccagctcctggggctccgtgcctgctctcggctcccgaggtcnccgagatgtgccatccagttcgacccagtcctccactccttccctcgtctgcatctgtaggagacagagtctccatctacttcgccggcgagtcagggcatagagttattacgccttggttacncgcgagaaccgaggaaaccacccgtaaacgtccgagactccgtacgcgtacgcctaagtccctagtttcgacctacgtacgggtcgggttccgtacgtacggttacgacgggtccggactacggtcggtattccggtagggtaccgtaggttacgtttccaaccgttcgtaaccgaacccgaattaccgacgtaccgtacgtcccttagaccgtagtacccgtaaggaacgtacgttacggttacgaccttaacgtttaccttaagttcgtaactaaaccgttgtttaaccgtttacggttaaccttaaccccgttaccgttaacgtttacccgtttcggaaccgtacgggtaaccgtaaggttcggaacgtacgaaccgtaaacggtacgtaggtaccgacgtacaccgtacgttacgcttacgtaccttacg

SEQ ID NO: 290858 - DNA, 501 bp, Homo sapiens
  misc_feature: GYAE6OF02FPSXH.48.22.B11.1.454.CMB.1.raw
  modified_base (311)..(311): a, c, t, g, unknown or other
  misc_feature (311)..(311): n is a, c, g, or t
  modified_base (498)..(498): a, c, t, g, unknown or other
  misc_feature (498)..(498): n is a, c, g, or t
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttattagcctggtttcagcagaaaccagggaaagcccctaaatcctgatctacgctgcatccatttgcacagtggggtccctntaggttcagcggcagcggatcgtgggacagatttcactctcaccatcagcagcctgcagccctgaacgatgttgctaacttattactgtcaacagtcttagtacgttaaccctccgttacctacttttcggcctagggaccgaaggtggagagtacgaaacgaactggtagctgcaccatctgtctntac

SEQ ID NO: 290859 - DNA, 518 bp, Homo sapiens
  misc_feature: GYAE6OF02F3FEV.48.22.B11.1.454.CMB.1.raw
  modified_base (313)..(313): a, c, t, g, unknown or other
  misc_feature (313)..(313): n is a, c, g, or t
  modified_base (377)..(377): a, c, t, g, unknown or other
  misc_feature (377)..(377): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttatttagcctggtttcagcagaaaccagggaaagcccctaaatcctgatctacgctgcatccactttgcacagtgggtccctntaggttcagcgcagcgatctgggacagatttcactctcaccatcagcagcctgcagcctgaagntgttgctaactttattactgtacaacagtacttagtacgttaacccctcgttaacctacttttggacccgtaaggggacctaagggtcggaagacgttaacgaaacgtaactgtacggctgaccacctatcctgttcttac

SEQ ID NO: 290860 - DNA, 719 bp, Homo sapiens
  misc_feature: GYAE6OF02I6G1S.48.22.B11.1.454.CMB.1.raw
tcagagtatacatacacgaccggtgctcgatttagacgacagctcaggggagtcccagtcaggacacagcatggacatgagggtccccgctcagctcctggggctcctgctgctctggctcccgaggtgccagatgtgccatccagttcgacccagtcctccatccttccctgtctgctatctgtaggagacagagtctccatcacttgccggcagtcaggcaattagaagttattacgccttggtttcagacaaggaaaccgagggaaactaccccgtaaactccgtagactctacgctgactactcctactttgacctacgtaggtcggggtcccgtcgttacggttcaggtccgacgtaagcggtaactcgtacgggactaggtactttaccgacttccgtaccaacccgtagtaccacggtcctaaccggtcccgttaggacccgtacgacccgttaaggaaacggtacgtttacggtttacgaacccttaaacgttttaacgtttaacccttagttacccaaacgttacgttaccgtttaaacgttaacccgttaaccccgttaccgtttaaacgttacggtttttaccgggaacccggtaaacggggtaaacctaaggggtaggaacgttacgtaaaccggaaaacgttaacgttcggtacggttacctaccggtaccgtaactaacgtttcctcggttaccttccgtaaccc

SEQ ID NO: 290861 - DNA, 576 bp, Homo sapiens
  misc_feature: GYAE6OF02FX398.48.22.B11.1.454.CMB.1.raw
tcagagtatacatacacgaccggtgctcgatttagacgacagctcaggggagtcccagtcgaggacacagcatcggacactgagggtccccgtctcagtctcctggggctcctgctgctctggctcccaggtgccagatgtggccatccagttgacccagtctccatcttcccttagtctgcatctgtaggagacagagtctccatcgacttgccgggccagtcaggggcattagaagttatttagcctggtttcagcagaaacctagggaaacgcccctaaactcctgactctacgctgcagtccactttgcacaggtcggggtcccgtctacggttcagcggcagcggatcgtagggacagatttcgactctcaccatcagcacgccgtgcgagcctagaagatgtagactaaacttacttaactacgtactaactagtacttaagtaacgtaaccctaccgtaacgtaccttttacggaccgaacggggaaccaagggtcggacgacgtacgtaaacgtaacgttggtacggtcgtaggacaccgtaacttacctacgttaccgttcttaccg

SEQ ID NO: 290862 - DNA, 553 bp, Homo sapiens
  misc_feature: GYAE6OF02GMD88.48.22.B11.1.454.CMB.1.raw
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttattagcctggtttcagcagaaaccagggaaacgcccctaaactcctgatctacgctgcatccactttgcacagtcggggtccctgtaggttcagcggcagcggatcgtgggacagtactttcactctcaccatcagcagcctgcagcctagaagtagtgttcgacttaactttatttactgtacaactagtacttaagtacgttaacccgtccgtaccgttacgttttcggaccgtaacggggaaccgtaagggtaggagtaacgtacgaaacgtaacgttggtacggtacgtagaccacctacgttcgtcgttcttctaccg

SEQ ID NO: 290863 - DNA, 525 bp, Homo sapiens
  misc_feature: GYAE6OF02FV71O.48.22.B11.1.454.CMB.1.raw
  modified_base (412)..(412): a, c, t, g, unknown or other
  misc_feature (412)..(412): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttatttagcctggtttcagcagaaaccagggaaagcccctaaaactcctgatctacgctgcatccactttgcacagtcggggtccgtctaggttcagcggcagcggatcgtgggacagatttcactctcaccatcagacagcctgcacgcctagaagatgttagcaacttattactgtacaanagtcttagtacgtaaccctcgtactacgtttcggccgaaggggaccaagggtggagacgtacgaaacgacgtaggtacggatacggaccaacctagtccttacgtctttaccg

SEQ ID NO: 290864 - DNA, 534 bp, Homo sapiens
  misc_feature: GYAE6OF02IYY4D.48.22.B11.1.454.CMB.1.raw
  modified_base (313)..(313): a, c, t, g, unknown or other
  misc_feature (313)..(313): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttatttagcctggtttcagcagaaaccagggaaagcccctaaatcctgatctacgctgcatccactttgcacagtgggtccctntaggttcagcggcagcggatctggacagatttcactctacacctatcagcagcctgcagcctagagtatgttgctaacttattactcgtcaacacgtacttagtacgtaaccctaccgttactaccgtttttcggacctaacggggtacctaagggttacggaacgtacgtactaaacggtaactaggtcgtacgtcgacgtaccagtcgtacgtcttacc

SEQ ID NO: 290865 - DNA, 540 bp, Homo sapiens
  misc_feature: GYAE6OF02G5OBZ.48.22.B11.1.454.CMB.1.raw
  modified_base (400)..(400): a, c, t, g, unknown or other
  misc_feature (400)..(400): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttatttagcctggtttcagcagaaaccagggaaacgcccctaaactcctgatctacgctgcatccactttgcacacggtcggggtcccgtcgtacggttcacgcggcacgcggactcgtggacagatttcactctcaccatcagcacgcctgcacgcctaggaagatgttnactaactttacttactgtacaactagtacttaacgtacgttaaccccttccgttaccttacgttttcggaccgtacggggacctagggtagagtactacgaaacgtacgtgtacgcgtcgaccacctatctgtcttaccg

SEQ ID NO: 290866 - DNA, 560 bp, Homo sapiens
  misc_feature: GYAE6OF02IH3J8.48.22.B11.1.454.CMB.1.raw
tcagagtatacatacacgaccggtgctcgatttagacgacagctcagggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttatttagcctggtttcagcagaaaccagggaaagcccctaaaactcctgatctacgctgcatccactttgcacaggtgggtcccgtctaggttcagcggcagcggatctgggacagatttcactctcaccatcagcagcctgcagccgtagaagtatgttcgactaactttattacttgtacaacagtacttaagtaacgtaaccctccgttaactaccgttttacggaccgtaagggaacccgtaagggtacggaacggtagtaaccgaaaccgtaacgtacggttacggacctcggacctacctacgtacgttcgttacctttaccg

SEQ ID NO: 290867 - DNA, 538 bp, Homo sapiens
  misc_feature: GYAE6OF02G9O1Q.48.22.B11.1.454.CMB.1.raw
  modified_base (262)..(262): a, c, t, g, unknown or other
  misc_feature (262)..(262): n is a, c, g, or t
  modified_base (364)..(364): a, c, t, g, unknown or other
  misc_feature (364)..(364): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagagttattagcctggtttcagcagaaaccagggaaancccctaaatcctgatctacgctgcatccactttgcacaggtcggggtccctcgtaggttcaggcggcagcggatcgtgggacagtatttcacttctcacctntcagcacgcctgccagcctagaagtatgttgactaactttattacttgtacaacgtagtacttagtacgttaaccctccgttactaccgttttcggaccgtaaggggacctaagggtcggaagtacgtaccgaaacgtacgtgtacggcgtacgacacctagtcttcgtcttcc

SEQ ID NO: 290868 - DNA, 616 bp, Homo sapiens
  misc_feature: GYAE6OF02ITE3W.48.22.B11.1.454.CMB.1.raw
  modified_base (430)..(430): a, c, t, g, unknown or other
  misc_feature (430)..(430): n is a, c, g, or t
tcagagtatacatacacgaccggtgctcgatttagacgacagctcagggggagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggcagtcagggcattagaagttattagccttggtttcagcaagaaaccagggaaacgcccctaaatcctagatctacgctgcatccactttgcacgagttcggggtcccgtctaggttcagcggcagcggatcgtgggacagtattcactctacaccatcagcagctgcacgctagaagtattggtacgaccttaaactttattaccgttagtactaaacgngttacgtttaacggttaaccgttaaccccttaccgttaaccttacgtttttaccgggacccggtaaacgggggtaaccctaaaggggttcggaaggtaacgtaaccggtaaaacggttaaccgtagggtacggtacgttccggtacctaaccgtagttacccgttacgttaccttccgttaacccg

SEQ ID NO: 290869 - DNA, 562 bp, Homo sapiens
  misc_feature: GYAE6OF02F750D.48.22.B11.1.454.CMB.1.raw
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttatttagcctggtttcagcagaaaccagggaaagcccctaaactcctgatctacgctgcatccactttgcacagtcgggtccctctaggttcaggcggcagcggatcgtgggacagtatttcactctcaccatcagcagcctgcagcctgaagatgttgactaacttattactgtacaactacgtcttaagtacgtaaccccttcgttaccttacgttttcggaccgtacggggtaaccgtaagggttacgggaagtaacggtaaccgaaaacggtaacgtacggtacggtacgtacggacctaacccgtagttccgttacgttccttaccg

SEQ ID NO: 290870 - DNA, 494 bp, Homo sapiens
  misc_feature: GYAE6OF02FYGF0.48.22.B11.1.454.CMB.1.raw
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttattagcctggtttcagcagaaaccagggaaagcccctaaatcctgatctacgctgcatccactttgcacagtggggtccctctaggttcagcggcagcggatctgggacagtattcactctcaccatcagcagcctgcagcctgaagatgtgactaacttattactgtacaacagtacttagtacgttaaccctccgtactacttttggcctagggaccaagggtgagatacgaaacgactgtggctgcacatctcgtctctac

SEQ ID NO: 290871 - DNA, 535 bp, Homo sapiens
  misc_feature: GYAE6OF02GRFBD.48.22.B11.1.454.CMB.1.raw
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttattagcctggtttcagcagaaaccagggaaagcccctaaaatcctgatctacgctgcatccactttgcacagtggggtccctctaggttcagcggcagcggatctgggacagatttcactctcaccatcagcagcctgcagcctagaagtatgttgactaactttattactgtacaactagtactttaagtacgttaaccctccgttaactaccgtttttgggacccgtaacggggacctaagggtcggagtacgtacgaaacgtaactggtacggctagacaccgtagtctcggttcttctacc

SEQ ID NO: 290872 - DNA, 602 bp, Homo sapiens
  misc_feature: GYAE6OF02F5SZA.48.22.B11.1.454.CMB.1.raw
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttatttagcctggtttcagtcaagaaaccgagggaaacgacccctaaactcctgactcgtacgctgctactcctactttgacacgacggtcggggtcccgtcgttaggttcgacggcggcacggcggatcgtagggacaggtactttcactctcaccatcagcacgcctgcacgtccgtagaaacgtagttgttacgactaactttaacttaccgttagtacctaaacgtacgtacgttaagttaccgttaacccttccgttaaccttaccgttttacggaccgtaacggggtaacctaagggtacgaagtacgtaacgaaacggtaacgtggtacggtacgtacgaccaaccgtagtcgttacgtcttaccg

SEQ ID NO: 290873 - DNA, 531 bp, Homo sapiens
  misc_feature: GYAE6OF02GKIIB.48.22.B11.1.454.CMB.1.raw
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttatttagcctggtttcagcagaaaccagggaaagcccctaaactcctgatctacgctgcatccactttgcacagtgggtccctctaggttcagcggcagcggatctggacagatttcactctcaccatcagcagcctgcagcctagaagatgttgacaacttattactgtacaacagtacttagtacgtaaccctccgttaacctacgttttacggccgtaagggggtacccaagggtcggaaggaactacgaaaacgtaacgtaggtaggcctaggcctaccacgtctacgttcttaccg

SEQ ID NO: 290874 - DNA, 543 bp, Homo sapiens
  misc_feature: GYAE6OF02GJHTH.48.22.B11.1.454.CMB.1.raw
  modified_base (316)..(316): a, c, t, g, unknown or other
  misc_feature (316)..(316): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttattagcctggtttcagcagaaaccagggaaacgcccctaaactcctgatctacgctgccatccactttgcacaggtgggtccctntaggttcagcggcagcgatcgtgggacagtattcactctcaccatcagcacgcctgcagcctagaagtactgttgactaactttattacgtgtacaatacgtacttaagtacgttaaccctccgttaactacgttttggccgtaacgggtaccgtaagggtacgacgtacgtaacgtaaaccgtaagtcggtaggccgtagacctaccgtactacgtcgtacttacg

SEQ ID NO: 290875 - DNA, 593 bp, Homo sapiens
  misc_feature: GYAE6OF02GSQZW.48.22.B11.1.454.CMB.1.raw
  modified_base (450)..(450): a, c, t, g, unknown or other
  misc_feature (450)..(450): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgcctatccagttgacccagtctccatcttccctgtctgcatctgtaggagacaggagtctccatcacgttgccgggccagtcagggcattagaagttattagcctggtttcagcaagaaaccagggaaacgcccctaaactcctgactctacgctgcatccactttgcacaggtggggtcccgttcgtaggttcaggcggcacggcggatcgtagggacagtatttccaccttcgtcctaccactcacgccacgcctgccacgacctagaacgtatgttacgtactaacgtttattaccgtagtaccaaacgngtaccttaaggtaaccgtaacccttccgttaaccttacgttttacgggacccgtaaggggacccgtaagggtcgggaagtacgtacgaaaccgtacgtacggttcggtacttacggacctaaccgtactcgttcgtcttaccg

SEQ ID NO: 290876 - DNA, 647 bp, Homo sapiens
  misc_feature: GYAE6OF02INXZA.48.22.B11.1.454.CMB.1.raw
  modified_base (191)..(191): a, c, t, g, unknown or other
  misc_feature (191)..(191): n is a, c, g, or t
  modified_base (259)..(259): a, c, t, g, unknown or other
  misc_feature (259)..(259): n is a, c, g, or t
  modified_base (302)..(302): a, c, t, g, unknown or other
  misc_feature (302)..(302): n is a, c, g, or t
  modified_base (324)..(324): a, c, t, g, unknown or other
  misc_feature (324)..(324): n is a, c, g, or t
  modified_base (392)..(392): a, c, t, g, unknown or other
  misc_feature (392)..(392): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatccttccctgtctgcatctgaggagacagngtctcatcacttgccggcagtcaggcattagaattattagcttggttcagcaagaaaccagggaaacncccctaaatcctagatctaacgctcgcaatccactttgacagngtcgggtcctcgtagtcagcgnagcgatcgtggactagtatttcacgtctacgacatacagctacgcctgacacggtacctagaaacgtnttacggttacgaaccttaaactttagttaacctcggtaacctaaaccgtacggttaaccgtttaaacgtacccgttaaaccccgttaccggttaaccctttacggggttttacccggaaccggtaaaccgggggtaaccctaaggggttacggtaaaacggtaccgttaaacccggaaaacggtaaccggttcggtaacggtccggtaacctaccggaaaccttcggtttacccgtacggtttacccttaaccgg

SEQ ID NO: 290877 - DNA, 531 bp, Homo sapiens
  misc_feature: GYAE6OF02H0EHQ.48.22.B11.1.454.CMB.1.raw
  modified_base (316)..(316): a, c, t, g, unknown or other
  misc_feature (316)..(316): n is a, c, g, or t
  modified_base (329)..(329): a, c, t, g, unknown or other
  misc_feature (329)..(329): n is a, c, g, or t
  modified_base (391)..(391): a, c, t, g, unknown or other
  misc_feature (391)..(391): n is a, c, g, or t
  modified_base (414)..(414): a, c, t, g, unknown or other
  misc_feature (414)..(414): n is a, c, g, or t
tcagagtatacatacacgaccggtgctcgatttagacgacagctcagggggagtcccagtcaggacacagcatggacatgagggtccccgctcagctcctggggctcctgctgctctggctccaggtgccagatgtgccatccagttgacccagtctccatcttccctgtctgcatctgtaggagacagagtctccatcacttgccgggcagtcagggcattagaagttatttagctggtttcagcagaaaaccagggaaagcccctaaaactcctagatctaacgctgcatccactttgcacagtcggggtcctntaggttcagcggnagcgatcgtgggacagatttcactctcaccatcagcacgcctgcagcctagaagtatgttanactaaactttattactgtacaanagtacttaagtacgtaaccctccgttaactacgttttcggaccgagggaaccgaagggtagacgatacgaaacgtaactggtacgtactagactaccattctacgttacttctaccg

SEQ ID NO: 290878 - DNA, 625 bp, Homo sapiens
  misc_feature: GYAE6OF02JJIC6.48.22.B11.1.454.CMB.1.raw
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggcagtcagggcattagaagttattagcctggtttcagcagaaaccagggaaacgcccctaaactcctgatctacgctgcactccactttgcacgaggtcggggtccctcgtaggttcaggcggcaggcggatcgtagggacagtactttcgacttcgtaccacctatcgacgcacgcctgacacgtcctagaagtagttcgtacgacttaaactttacttaactcgtaacaacgtacgtacgttaacgtaaccgttaaccccgttaccgttaaccgttaccgttttacgggacccggtaaacggggtaacccgtaagggtacggacgtaacgtaaccggtaaaaccggtaacgttggtacggtaccgttacggaccgtacccgtaacgttccgttacggttaccttaccgtaacccg

SEQ ID NO: 290879 - DNA, 538 bp, Homo sapiens
  misc_feature: GYAE6OF02HIKG0.48.22.B11.1.454.CMB.1.raw
  modified_base (514)..(514): a, c, t, g, unknown or other
  misc_feature (514)..(514): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttcctgtctgcatctgtaggagacagagtctccatcacttgccgggccagtcagggcattagaagttatttagcctggtttcagtcagaaaccagggaaacgcccctaaactcctgatctacgctgcatccactttgcacagtgggtcccgtctaggttcagcggcagcggatcgtggacagtatttcactctcacctatcagcagcctgcagcctgaagtatgttgactaacttacttactagtacaactagtacttagtaacgtaacccttccgtaaccgttacgttttacggaccgtaacggggtaccaagggtacggaagtacgtaacgaaacgtaacgtgtacggntacgccacctagtcttgtccttac

SEQ ID NO: 290880 - DNA, 595 bp, Homo sapiens
  misc_feature: GYAE6OF02IY4A3.48.22.B11.1.454.CMB.1.raw
  modified_base (263)..(263): a, c, t, g, unknown or other
  misc_feature (263)..(263): n is a, c, g, or t
  modified_base (322)..(322): a, c, t, g, unknown or other
  misc_feature (322)..(322): n is a, c, g, or t
tcagagtatacatacacgaccggtgctcgatttagacgacagctcaggggcagtcccagtcaggacacagcatggacatgagggtccccgctcagctcctggggctcctgctgctctggctcccagggtgccagatgtgccatccagttgacccagtctccatcttccctgtctgcatctgtaggagacagagtctcatcacttgccggcagtcaggcattagaagttattagccttggttcagcaagaaaccgagggaaacncccctaaatcctgactctacgctgcatcctacgtttgactacgtaggtcgggtaccctntagggttacaggcggcaaggcggacttcgtagggactagtactttcaccttcgtacaccagtcacgcgacgcctgccacgcttaggagtatgttgacttaactttacttacgttagtaccaatacgtacttaacgttaccgtaaccctacgttacttacgtttcggaaccggtacggggtaacctagggtacgaacgtaacgtaaccgtaaacgtaacgttggtacggtaccttacggacctaacccgtagtttacgttccgttaccttaccg

SEQ ID NO: 290881 - DNA, 559 bp, Homo sapiens
  misc_feature: GYAE6OF02IORE8.48.22.B11.1.454.CMB.1.raw
tcagagtatacatacacgaccggtgctcgatttagacgacagctcagggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctcatcacttgccggcagtcagggcattagaagttatttagcctggtttcagcagaaaccagggaaacgacccctaaactcctagatctacgctgcactcctactttgcacgtaggtcggggttccccgtcgttacggttcgaggcggacgaggcgggatcggtagggacaaggtatttccacttctccactatcacgacacgcctgcagtcctagaacgtagtgttacgactaacttattactagtacaactagtacttaagttacgtaaccctcgtacttacgtttcggacgacgggacaagggtcgagtacgtaacgaaacgacgtaggtcggactcgacaccgtatcgttcgtaccttacg

SEQ ID NO: 290882 - DNA, 544 bp, Homo sapiens
  misc_feature: GYAE6OF02I750E.48.22.B11.1.454.CMB.1.raw
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcaggcattagaagttatttagctggtttcagcagaaaccagggaaacgacccctaaactcctgactctacgctgcatccactttgcacagtcgggtcctctaggttcagcgcagcggatcgtgggactagtactttcactcctacaccatcacgacacgcctcgcagccgtagaacgatgttacgactaactttattacttgtactaactacgtacttagttaccgtaaccctccgttacctacgttttcgaccgtagggacctaaggtacggacgtagtaaccgaaacgtacgtacgtcgcgtcgacaccgtatcgtcgttccttacg

SEQ ID NO: 290883 - DNA, 540 bp, Homo sapiens
  misc_feature: GYAE6OF02GKTBY.48.22.B11.1.454.CMB.1.raw
  modified_base (263)..(263): a, c, t, g, unknown or other
  misc_feature (263)..(263): n is a, c, g, or t
  modified_base (378)..(378): a, c, t, g, unknown or other
  misc_feature (378)..(378): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccggccagtcagggcattagaagttattagcctggtttcagcagaaaccagggaaacncccctaaactcctagatctacgctgcactccactttgcacgtgtgggtcccgtgtaggtcagcggcagcggatcgtgggactagtactttcacttctcaccatcgagtcagcctncagcctagaacgtagtgtacgactaactttattactcgtacaacagtcttaagtacgtaaccctcgttacttcgtttacggaccgtaaggggacctaagggtcgagtaagtacgaaacgtacgtagtcggcgtacgaccacctacgtcgttacgtcttaccg

SEQ ID NO: 290884 - DNA, 605 bp, Homo sapiens
  misc_feature: GYAE6OF02JB23U.48.22.B11.1.454.CMB.1.raw
tcagagtatacatacacgaccggtgctcgatttagacgacagctcaggggagtcccagtcaggacacagcatggacatgagggtccccgctcagctcctggggctcctgctgctctggctccaggtgccagatgtgccatccagttgacccagtcctccatcttccctgtctgcatctgtaggagacagacgtctccatcacttcggccggccagtcagggctattagaagttattagcctggttcagcagaaaccaggaacgcccctaaatcctgactctacgctgacactcctactttcgctactaggtcggggtccctcgttaggttcaggcggacaggacggatcgtgggaacagtactttcacttctacacctatcgagtcacgcctgccacgcctagaagtattcgtacgactaactttacttactcgtacaacgtagttacttagttaccgtaaaccctccgttaacgtacgttttacggaccggtaacgggtaaccgtaagggtacggtagtaacgttaaccgaaaccggtaacgttacggtgggtacctcggtaacctaccgttaccgttcgtacggtttaccttaccgttacccg

SEQ ID NO: 290885 - DNA, 558 bp, Homo sapiens
  misc_feature: GYAE6OF02F6M7C.48.22.B11.1.454.CMB.1.raw
  modified_base (313)..(313): a, c, t, g, unknown or other
  misc_feature (313)..(313): n is a, c, g, or t
  modified_base (343)..(343): a, c, t, g, unknown or other
  misc_feature (343)..(343): n is a, c, g, or t
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttattagcctggtttcagcagaaaccagggaaacgcccctaaactcctgatctacgctgcatccactttgcacagtcgggtcctntaggttcagcgcagcgatcgtgggacagtntttcactctcaccatcagcacgcctgcagcctagaagtatgttgactaaactttattaacttgtacaaactagtactttaagtaacgttaacccttaccgttaaccttacgttttacggaccgtaaggggaaccgtaagggtacggtagtacgtaacgaaacgtaacgttggtacggtctacggacctaccgtacttcgtcgttccttactaccg

SEQ ID NO: 290886 - DNA, 543 bp, Homo sapiens
  misc_feature: GYAE6OF02GLRWP.48.22.B11.1.454.CMB.1.raw
  modified_base (262)..(262): a, c, t, g, unknown or other
  misc_feature (262)..(262): n is a, c, g, or t
  modified_base (318)..(318): a, c, t, g, unknown or other
  misc_feature (318)..(318): n is a, c, g, or t
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttattagcctggttcagcagaaaccagggaaacncccctaaactcctagatctacgctgcactccactttgcacgagtcggggtcccgtntaggttcagcggcaggcggatcgtagggacagtatttcactctacaccatcagcagcctgctacgcctagaagtatgtgactaacttattactagtacaacacgtacttaagtacgttaaccctacgttacctacgttttcgaccgtacgggaaccgaagggtacggagtactaacgaaacgtaacgtggtacggtactgaccacgtatcgtgttcctactaccg

SEQ ID NO: 290887 - DNA, 572 bp, Homo sapiens
  misc_feature: GYAE6OF02HLK3F.48.22.B11.1.454.CMB.1.raw
  modified_base (320)..(320): a, c, t, g, unknown or other
  misc_feature (320)..(320): n is a, c, g, or t
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttcgccgggcagtcaggcattagagttattagcctggtttcagcaagaaaccagggaaacgtcccctaaaactcctagatctacgctgcatcctaactttgcacaggtcggggtccctntacggttcagcggcaggcggatcgtgggacagtatttcactctacacccatcacgcacgtcctgcgacgccgtagaagtagttgttcgacttaactttattacgttacgtacaactacgtacttacgtaacgttaaccctacgttaaccttacgttttcgaccgtacgggaaccgtaagggtagacgtaagtaccgtaaaacgacgttcggtacgtcgtacgacgtaccgtacttcgtacttccgttctacg

SEQ ID NO: 290888 - DNA, 514 bp, Homo sapiens
  misc_feature: GYAE6OF02GDDNZ.48.22.B11.1.454.CMB.1.raw
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccggcagtcagggcattagaagttattagcctggtttcagcagaaaccagggaaacgcccctaaactcctgatctacgctgcatccactttgcacagtcggggtccgtctaggttcagcggcagcggatcgtgggacagatttcactctcaccatcagcacgcctgcacgccgtagaagattgttgactaacttattactgtacaactagtacttaagtacgtaaccctccgtactacgttttgaccgtacgggaccgtaagggtgagactacgaaacgacgtgtggctgacactatactgttctctacc

SEQ ID NO: 290889 - DNA, 771 bp, Homo sapiens
  misc_feature: GYAE6OF02H30I4.48.22.B11.1.454.CMB.1.raw
  modified_base (191)..(191): a, c, t, g, unknown or other
  misc_feature (191)..(191): n is a, c, g, or t
  modified_base (242)..(242): a, c, t, g, unknown or other
  misc_feature (242)..(242): n is a, c, g, or t
tcagagtatacatacacgaccggtgctcgatttagacgacagctcagggagtcccagtcaggacacagcatggacatgagggtccccgctcagctcctggggctcctgctgctctggctcccaggtcgccagatgtgccatccaggttcgacccagtcctccattccttccctgtctcgcatctgtagganacaggctctaccatcacttcggccggcagtcgagggctagttagaactttntttacgccgttaggtttcacgactaacgaaaaccgacggggtaaaccgtaccccttaaaacctccgtagtaccttacgtaccgtactcgacctactccttactttcgacctacgtacggtccgggttcccttacgttacggtccacggtccggacgtacggcgggtaactcggtacggggactaacggtacctttccgaaccgttcctacctacccgaatttcccggacgtaccgtacgtcccgtagtacccgacgtaccgtacggtaacgtacgttaggttacctaaccgttaacttttaactttaccgtaccgtttaaactacccgtaacgtttacgtttaaccggtttaacccgttaacccctttaccgttaaccgtttaccgtttttaccgggaccggtaaacgggttaccggtaaacgggttggtaaaccggttacgttaaccggaaaccggttaccggtaggttacggtaccgtacgttaccgtaaccgtaccgtttaccgtccggtttaccttgttaccccg

SEQ ID NO: 290890 - DNA, 542 bp, Homo sapiens
  misc_feature: GYAE6OF02IT0M6.48.22.B11.1.454.CMB.1.raw
  modified_base (255)..(255): a, c, t, g, unknown or other
  misc_feature (255)..(255): n is a, c, g, or t
  modified_base (292)..(292): a, c, t, g, unknown or other
  misc_feature (292)..(292): n is a, c, g, or t
  modified_base (325)..(325): a, c, t, g, unknown or other
  misc_feature (325)..(325): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctcatcacttgccggcagtcaggcattagaattattagcctggttcagcagaaacaggaacnccctaaactccagatctacgctgcatccatttgcagnggtcgggtccctgtaggtcagcgcagcgatcgnggacagtattcactctcacatcagcacgccgtgcgtacgaccgtagaacgtatgttacgacttaacttaattactgtaccaacgtactacgttaagtaccgttaccgtaccgttaccttacgtttcggaccgaagggtacccgagggttacgagtacgtaaccggaaacgtacgtacggttagcctacggacctacctacgtcgtacgtctttaccg

SEQ ID NO: 290891 - DNA, 579 bp, Homo sapiens
  misc_feature: GYAE6OF02F7G2Z.48.22.B11.1.454.CMB.1.raw
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttattagccttggttcagcaagaaaccagggaacgcccctaaactcctgactctacgctgcatcctactttgcacgtaggttcggggtcccgttgtaggttcaggccggcgaggcggatcggtagggacagtactttcactctacaccatcgagcacgtcctgccagcctagaagtacgtgtacacttaactttactacgtgtactaactaggttactttaacggtaaccgttaaccccttacgttaaccgttacggttttacggaccggtaacggggaaccgtaagggtgtaacgaactaccgaaacggtacgtggtacgctacgacctactactcggttctctactccg

SEQ ID NO: 290892 - DNA, 637 bp, Homo sapiens
  misc_feature: GYAE6OF02I7BI2.48.22.B11.1.454.CMB.1.raw
  modified_base (186)..(186): a, c, t, g, unknown or other
  misc_feature (186)..(186): n is a, c, g, or t
  modified_base (228)..(228): a, c, t, g, unknown or other
  misc_feature (228)..(228): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttcgacccagtctccatcttccctgtctgcatctgtaggnacagagtctccatcacttgcccggcagtcaggcatagaattnttagcgtgttcagcagaaaccgaggaacgcccctaacgtcctagatcgtacgctgactactcctactttcgctacgtacggttcgggttcccgtacgttacggttcaggtccggcgaggcgagtcgtgggactagtactttacgacttacctccacctacgtcacgcgtacgcctggaccacgtcctaaggtacgtagtcgttacggtaaccttaaacgtttaacgttacttacgttacaaaccgttgttaaccgtttaacgttaacccggttaacccttaccgtttaacttaccggttttacggacccgggtaacgggtaacgttacgggtggaacgtaacggtaacgaaacgttacgtacggtcggtacctacggtcctaacccgattaccgttacgtaccttaccg

SEQ ID NO: 290893 - DNA, 745 bp, Homo sapiens
  misc_feature: GYAE6OF02I7CB7.48.22.B11.1.454.CMB.1.raw
  modified_base (135)..(135): a, c, t, g, unknown or other
  misc_feature (135)..(135): n is a, c, g, or t
  modified_base (198)..(198): a, c, t, g, unknown or other
  misc_feature (198)..(198): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgcccagntgtcgccatccaagttcgacccagtcctccatccttccctgtctgcatctgtaggagacaggntctcatctacgttcggccggtcagtcgagggtcaagttagtaacgttatttagcttggttacagtacaaggaaaaccgtaacgggaaaacgtaccccttaaactaccgtagtaactccgtaacgtccgtacgtaccacttaccctaagtttccgactaacgtacgggttacggggtccccttacggttacggttaccgaggtaccggaccgtacggcggtaactcggttaggggaacctagttaactttcaacccttacgtaccctaaccgtagtaacctacgaccgtacggtaccgtcgtacccgacgtaccgtagtaaggtaacgttcgtttaacggaacctttaacgtttaactttaaccgtacgtaacgtaaaccgtcgtacgtttaaaccgtaaccgttaacccgtaccgttaaccgttaccgtttaaccgggcggtaaaccggggaacgttaacggtaggtaaacgtaccgtaaaccgtaacggtaacgttacggtacgggtacctaacggtacctaccgtattaccttcgttacttaccg

SEQ ID NO: 290894 - DNA, 684 bp, Homo sapiens
  misc_feature: GYAE6OF02HW5E4.48.22.B11.1.454.CMB.1.raw
  modified_base (186)..(186): a, c, t, g, unknown or other
  misc_feature (186)..(186): n is a, c, g, or t
  modified_base (282)..(282): a, c, t, g, unknown or other
  misc_feature (282)..(282): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtagganacagagtctcatcacttgccggcagtcaggctattagaagttattagccttggtttacagacaagaaaccgagggaaacgacccctaaactcctanatctacgctcgactatcctactttcgacacgtaggtcggggtaccctcgttaggttcacggcggacaggcggtagtcgtagggactaaggtactttacgaaccttctaccaaccgtactaccgacgtaccacgtccgtacgaccgacgtccgtaaggtaacgtagttacggttacgtaaccttaaacgtttaactttaaccgtacgtaactaaacgttacgttaacgtttaacggttaaaccgttaaccccgttaccggttaactttaaccggttttacgggaccggtaaacggggtaaccgtaacgggttacggaacgtaacgtaaacgtaaaccggttaacgtacggtacggtacgtacgtaccgtaaccgttaacgttcgttacgttaccgtttacccg

SEQ ID NO: 290895 - DNA, 617 bp, Homo sapiens
  misc_feature: GYAE6OF02JBX59.48.22.B11.1.454.CMB.1.raw
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggctattagaagttatttagccttggtttcagcagaaaccgagggaaacgcccctaaactcctagactctacgctgcatccactttgcacaggtcgggtccctgtaggttcaggtcggcgaggcggagtcgtacgggactagtactttcaccttcgtacacctatcacgcgacgcctcggcacgcctaggaagtacgttgttacgactaaactttattaccgtagttaccaaactcgtactttaacggttaaccttaacccttaccggtaaccgttacgttttcgggaccggtaacggggaaccgtaagggtacgtaaggtacgtaacggaaaccgtaacggttacggtacggtaccgttacggacctaaccgttacgttccgttacgttctttaaccg

SEQ ID NO: 290896 - DNA, 688 bp, Homo sapiens
  misc_feature: GYAE6OF02I780B.48.22.B11.1.454.CMB.1.raw
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtcctccatctacgttcggccggccagtcgagggctattagtaagtttatttacgccttggtttcagacaagaaaccgaagggaaacacccctaaactccgtagactcctacgctgcctactcctactttacgccaacgtacgggttccggggttccccgttacgttacgggttccaaggtccggacgacggcggtacttccggtaggggaactagttactttccgaccttccgtaccaacctactacgacgccgtacgtcctacggaccacgtccgtaggaacgtcttcgggtactaaccttaaactttacgttaccgtcgtaacctaacgtacgttaacgtttaacgtaacccgttaacccgttaccgtttaaccgttacgttttcgggacccggtaaggggaaccgttaaggggtacgaacggtacgtaaaccggtaaacgtacggttacggtacgtcttacggacctaccgtacgtcttacgtaccgttaccg

SEQ ID NO: 290897 - DNA, 527 bp, Homo sapiens
  misc_feature: GYAE6OF02FL8UP.48.22.B11.1.454.CMB.1.raw
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttattagcctggtttcagcagaaaccagggaaacgcccctaaactcctgatctacgctgcatccactttgcacagtggggtcccgtctaggtcagcggcagcggatcgtgggacagattcactctcacatcagcagcctgcagctgaagatgtgactaacttattactcgtcaactagtctttaagtaacgttaacccctccgttaaccttacgttttacggacccgagggtaaccgaagggtggagaactacgaaaacggtaactaggtacggctagaccaccattctcgtcttctac

SEQ ID NO: 290898 - DNA, 705 bp, Homo sapiens
  misc_feature: GYAE6OF02ISH9L.48.22.B11.1.454.CMB.1.raw
  modified_base (189)..(189): a, c, t, g, unknown or other
  misc_feature (189)..(189): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttcgacccagtcctccatccttccctgtctgcatctgtagganacagactctccatctacttcggccggacagtcgagggctattagaagtttatttacgccgttggtttccagactaacgaaaccgagggaaacctcccccttaaactccgtagtacttactacgcctagacactcctacttcgacacgtaggttccgggtcccttgtaaggtcgacggcggcgtaagccggtactcggtaggactaggtacttccgaacttcctacaaccgtactacgtacgcgtacgtccgtacgtacgaccgtacgtaacggtaacgtattacggttacgaacttaaaccgtttaacgttaccgttacgtaacctaaccgtaacgttacgttaacgttaacccgttaacccttaccggtttaacttaccggttttaccggacccgggtaacgggtaccgtaaacggggtagtaacgtaacgtaaccgtaaacggtaaccggttacggtaccggcgttaaccggacccgttaccgtaccgtttccgttacggttacccttacccgg

SEQ ID NO: 290899 - DNA, 585 bp, Homo sapiens
  misc_feature: GYAE6OF02GM7BF.48.22.B11.1.454.CMB.1.raw
  modified_base (260)..(260): a, c, t, g, unknown or other
  misc_feature (260)..(260): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctcatcacttgccggcagtcaggcattagaagttattagccttggttcagcagaaaccgagggaacncccctaaactcctgatcgtacgctgcactcctactttgccacgtaggtccggggtcccgttcgtacggttcgacggcggcaggtcggatcggtgggacagtactttacactctacacctatccgagccgacgtccgtgccacgtcctaggaatagttacgttcgacgtaactttacgttactcgtacaacgtagtacgttacgtaccgttaacccgtccgttactacgttttacgaccggtaacggggacctaagggtagtacgtaacgtaacgtaaaccggtagtaggtagaccgtacgaccaccgtattcgttgtaccgttac

SEQ ID NO: 290900 - DNA, 640 bp, Homo sapiens
  misc_feature: GYAE6OF02H6Z1M.48.22.B11.1.454.CMB.1.raw
  modified_base (89)..(89): a, c, t, g, unknown or other
  misc_feature (89)..(89): n is a, c, g, or t
  modified_base (161)..(161): a, c, t, g, unknown or other
  misc_feature (161)..(161): n is a, c, g, or t
  modified_base (187)..(187): a, c, t, g, unknown or other
  misc_feature (187)..(187): n is a, c, g, or t
  modified_base (190)..(190): a, c, t, g, unknown or other
  misc_feature (190)..(190): n is a, c, g, or t
  modified_base (198)..(198): a, c, t, g, unknown or other
  misc_feature (198)..(198): n is a, c, g, or t
  modified_base (205)..(205): a, c, t, g, unknown or other
  misc_feature (205)..(205): n is a, c, g, or t
  modified_base (244)..(244): a, c, t, g, unknown or other
  misc_feature (244)..(244): n is a, c, g, or t
  modified_base (257)..(257): a, c, t, g, unknown or other
  misc_feature (257)..(257): n is a, c, g, or t
  modified_base (303)..(303): a, c, t, g, unknown or other
  misc_feature (303)..(303): n is a, c, g, or t
  modified_base (567)..(567): a, c, t, g, unknown or other
  misc_feature (567)..(567): n is a, c, g, or t
  modified_base (604)..(604): a, c, t, g, unknown or other
  misc_feature (604)..(604): n is a, c, g, or t
tcagagtatacatacacgaccggtgctcgatttagacgacagctcaggggagtcccagtcaggacacagcatggacatgagggtccccnctcagctcctggggctcctgctgctctggcctccgaggtcgaccagtatgtcgaccatccgagttcgacccngtcctaccagttcctcctgtctgacntcngtaagganacaggtntctaccatcactcggcggcagtcaggctatagaagtttnttcggctggttcngcaagaacgaggaactacccgtaaactctgactcgtaccgcgttanacctactactacgtttcgacctagtcggttcggtaccgttcgtaacggttcgacggtccgcgaacgcggtacttcgaggacctaggttaactcgtacttcaccgacgttaacgcgaagtcctacggctagacgtacgacgtaggaattacgttggtactaacgtttaactttactagtacgtaccttaagacttacggttaacggttacctaacccgttaccttagttaccggtttacgacccggtaagggaaacctagggtanaaccgtcgtaaacggaacgtaacgtttggaccgtacnggtaccacgttaggttacctcgttacctacctccgg

SEQ ID NO: 290901 - DNA, 820 bp, Homo sapiens
  misc_feature: GYAE6OF02HBWME.48.22.B11.1.454.CMB.1.raw
  modified_base (190)..(190): a, c, t, g, unknown or other
  misc_feature (190)..(190): n is a, c, g, or t
tcagagtatacatacacgaccggtgctcgatttagacgacagctcaggggcgagtcccagtcaggacacagcatgggacatgagggtccccgctcagctcctggggctcctgctgctctggctcccaggtgccagatgtgccatccagttgacccagtctccatccttccctgtctgctatctgtagganacagacgtcctaccatccacgttcggcccgggccaggtccgagggctaagttagtaagtttatttacggtccttgggtttaccagtaccgaacggaaaaccgaaggggaaaccgtacccccctaaaactcccgtagtactccgtaaccggctacggaccacttcccgtacgtttcggacgtaaccgtcgggttccggggttccccgttaggttacgggttccaacgggtccggtacgacgggtacggtaccgttacgggtacgggaacctacggttactttacccgtacccgttaaccctaccccgtaacccgtaacgtccggtaaccgtccgtacccgtacccggttcggacccggtacggttccggtaaacggttaaacgttttaccgttaccgtaaccgtttaacctttacgtttacctgtaccgtactaccgttaacgttaaccttaaacccgttaccgttaccccggtaccgggtttaaccgtccccgggaaacgggtaaccggtaaccggtaggggtaaccgggtaacgtaaccgtaacgggtccgtacgggtccggtaccgtacggtaacccgtacgttaccgttaccgttcggtttacccttaccgtacccgtttaccccgg

SEQ ID NO: 290902 - DNA, 707 bp, Homo sapiens
  misc_feature: GYAE6OF02HZMOR.48.22.B11.1.454.CMB.1.raw
tcagagtatacatacacgaccggtgctcgatttagacgacagctcaggggagtcccagtcaggacacagcatggacatgagggtccccgctcagctcctggggctcctgctgctctggcctcccaggtgccagatgtgccatccagttcgacccagtcctccatccttccctgtctgcatctggtaggagacagagtctccatcacgtcggccggcagtcgaggctagttagaagtttattagccttggtttcagctaagaaaccgagggaaacgaccctaaactcctagactctacgctcgctactcctacttgccacgtacggtcggggtcccttcgtaggtcgaggtcggacgaggcgtatcggtagggactaggtacttcacgtctacacctagtacacgcgtacgccgtagcctacgactaggaacgtattcggtacacttaaactttacgtacttacgtaactaacgtacgttaccgtttaacggtaaacccgttaccccgttaccgttaaccgtttaccgggttttaccgggaacccgggtaaacggggtaaccgttaacgggggttacggtaaccggtaccgttaaacccgggtaaaaccggttaaccggtttacggggtaccggttaccgtaccggtaaccccttaaccggtacggtttacccggtttacggtttacccttaccggtttaacccccgg

SEQ ID NO: 290903 - DNA, 581 bp, Homo sapiens
  misc_feature: GYAE6OF02F2BVN.48.22.B11.1.454.CMB.1.raw
  modified_base (263)..(263): a, c, t, g, unknown or other
  misc_feature (263)..(263): n is a, c, g, or t
  modified_base (317)..(317): a, c, t, g, unknown or other
  misc_feature (317)..(317): n is a, c, g, or t
  modified_base (389)..(389): a, c, t, g, unknown or other
  misc_feature (389)..(389): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggcagtcagggcattagaagttatttagcctggtttcagcagaaaccagggaaancccctaaaactcctgatctacgctgcatccactttgcacgagttcgggtccctntaggttcagcggcaggcgatcgtgggacagtatttcactctacaccatcagcagcctgcagcctagaacgtntcgttgtactaactttacttaccttgtaccaactacgtacttaagtacgtaaccccttccgttaacttacgttttacggaccgtaacggggtaaccgtaagggtcggtaagtaacgttaaccgaaaacggtaaccgttaggtaccggtacgtacggacctaacctacgttaccgttacggttcctttaaccg

SEQ ID NO: 290904 - DNA, 553 bp, Homo sapiens
  misc_feature: GYAE6OF02GY5HK.48.22.B11.1.454.CMB.1.raw
  modified_base (229)..(229): a, c, t, g, unknown or other
  misc_feature (229)..(229): n is a, c, g, or t
  modified_base (276)..(276): a, c, t, g, unknown or other
  misc_feature (276)..(276): n is a, c, g, or t
  modified_base (413)..(413): a, c, t, g, unknown or other
  misc_feature (413)..(413): n is a, c, g, or t
  modified_base (433)..(433): a, c, t, g, unknown or other
  misc_feature (433)..(433): n is a, c, g, or t
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggcagtcagggcattagagttnttagcctggtttcagtcaagaaaccagggaaacgcccctaaactccngatctacgctgctactcctactttcgcacgaggttccggggtccgtctaggttccaggcgacgaggcgtagtcgtaggggacaggtactttcgacttcacaccactcgacgcagcctgcacgctagaagtatcggtnactaattctactgactaacntactagttaccgtacctccgtaacgtcgtttcggacgtacgggtaccgtagggtacgagtacgtaacgaacgtacgtaggtcgtacgtcgactaccgtattacctggttccttactaccg

SEQ ID NO: 290905 - DNA, 677 bp, Homo sapiens
  misc_feature: GYAE6OF02IM706.48.22.B11.1.454.CMB.1.raw
  modified_base (221)..(221): a, c, t, g, unknown or other
  misc_feature (221)..(221): n is a, c, g, or t
  modified_base (306)..(306): a, c, t, g, unknown or other
  misc_feature (306)..(306): n is a, c, g, or t
  modified_base (670)..(670): a, c, t, g, unknown or other
  misc_feature (670)..(670): n is a, c, g, or t
tcagagtatacatacacgaccggtgctcgatttagacgacagctcagggggcagtcccagtcaggacacagcatggacatgagggtccccgctcagctcctggggctcctgctgctctggctcccaggtgccagatgtgccatccagttgacccagtcctccatcttcctgtctgcatctgtaggagacagacgtctccatcacttcggccgggcagtcgngggcagttagagttattagctgttcagcaacgaaacgagggaaacgaccctaaactcctagatactacgctgcactcctacttcnctacgtacggtcggggtcccgtacgttacggttacgacggtccggcgaacggtcggtacgtcggtacggggtacaacggttacttttaccgaccgttaccgtacctaccgaacgttacgacgtaccgtaacgtccaggaccgtaaccggtaccgtaacggaagtacgtttacggttacgaacttaaaccgtttacttaacgtacgttaccaaacgtagttacgttaacgttaccgttaaccccgtacgttacctacggttttccggaaccggtaacggggtaactaaggggtagtaacgtaacgtaacgaaaaccggtacgttggtcggtaccgtacgaccgaaccgttacttcggttaccttntaacccg

SEQ ID NO: 290906 - DNA, 712 bp, Homo sapiens
  misc_feature: GYAE6OF02F7D38.48.22.B11.1.454.CMB.1.raw
tcagagtatacatacacgaccggtgctcgatttagacgacagctcagggggcagtcccagtcaggacacagcatggacatgagggtccccgctcagctcctggggctcctgctgctctggctcccaggtcgccagatgtgccatccagttgacccagtcctccatcttccctgtctgcatctggtaggagacagagtctccatcacttgccggcagtcagggcagttagagttattagcctggttcagctaagaaaccagggaacacccctaaacgtccgtagactcgtaccgtcgtgccgtatccctaacgttttcggactacggtacggttccggggtaccccttaccgttacgggttacgacggccggtaccaacggccggtaacttacggtagggtaacctaggttaacgtttacccgacttcccgttaccaacccgtaagtaccggaacgacccgtaacggtcccttaggaccaaccggtccctaaggtaacgttaacgttttcgggaaccttaaacgtttaccgttagttccggtacgtacggtaccgtagggttaccaaccgttaccgttttaccccgaccgttaccggttttccgggacgggtaaccggtacgtacggggtccgtacgtaacgaaaccggtacgttggttacggccgttacggacctaacggcgttccgttacgtcgtttacgcctttaccccg

SEQ ID NO: 290907 - DNA, 644 bp, Homo sapiens
  misc_feature: GYAE6OF02HPR8C.48.22.B11.1.454.CMB.1.raw
  modified_base (184)..(184): a, c, t, g, unknown or other
  misc_feature (184)..(184): n is a, c, g, or t
  modified_base (264)..(264): a, c, t, g, unknown or other
  misc_feature (264)..(264): n is a, c, g, or t
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttgacccagtctccatcttcctgtctgcatctgtagganacagagtctccatcacttgccggccagtcagggcattagagtttattacgccttggtttcagtcagtaaaccagggaaanccccttaaactcctaggactcgtacgctagcatcctacttttcgacacgtaggtcgggtcccgtacgtacgggttccaggtccggcacggtacggacttcgtacggggaactaggtacgtttcaccttctaccgacctactccagccgtaacgccctgaccgaggtcctagaacgtattcggttacgacttaacgtttacttacgttacgtacctaacgtagtacgtttacggttaaaccgttaccccgtaccgttaaccttacggtttttaccggacccggtaaagggtaacccgtaaggggttcggaacgtacgtaaccgtaaacggtacgttggtacggctacggcctaacgtcttacgtaccgttcttactacccg

SEQ ID NO: 290908 - DNA, 777 bp, Homo sapiens
  misc_feature: GYAE6OF02F58CE.48.22.B11.1.454.CMB.1.raw
  modified_base (184)..(184): a, c, t, g, unknown or other
  misc_feature (184)..(184): n is a, c, g, or t
  modified_base (232)..(232): a, c, t, g, unknown or other
  misc_feature (232)..(232): n is a, c, g, or t
  modified_base (245)..(245): a, c, t, g, unknown or other
  misc_feature (245)..(245): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctcatcttcctgtctgcatctgtagganacagacgtctccatcacgttcgccggccagtcagggcagttgaagttnttagctggttcancaagaacgaggaacacccgtaaactcctgactcgtaccgctcgcactcctacttcgacctacgtaggttcgggtccctagtacggtcgagcgcgagcggtatcgtagggacctaggtactttacgaccttaccgtacctaacccgacgttaccgaacgacccgaacggtccccgttacgggcccgtaaccgtaccggttaacggtaaacggttacgttttccggttaacgttacccgttaaaacgtttttacgtttaaccgttaccggtaacttaaaccggtaacggtttaccgtttaaaccggttaacccggtttaaaccccgttaccgggtttaaacccttttaccggttttaacggggaacccggttaaaacccgggggttaacgtaaaccggggttacgggtaaaccggttaacgttaaaccccggttaaaagggttaacccgttaacgggttaccgggttaacccgttacggttaacccgtaaacccggttacctttaccggtttaccgtttcccggttaaaccccg

SEQ ID NO: 290909 - DNA, 628 bp, Homo sapiens
  misc_feature: GYAE6OF02H8AP4.48.22.B11.1.454.CMB.1.raw
  modified_base (614)..(614): a, c, t, g, unknown or other
  misc_feature (614)..(614): n is a, c, g, or t
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttgacccagtctccattccttccctgtctgcatctgtaggagacagatctccatcacttcggccggcagtcgaggcattagtagtttacttagtccgttggttacagtacaacggaaaaccgagggaaaccgtccccctaaactcctagacttcacgtctcgctactcctacttcgacctacgtacgggttcgggttcccgttagttacggtcgacggccggacgacggcgtatcggtagggactagtactttacgactcgtaccacctatccgagaccaccggtacctcgaaccgcgtacgtaggaagtacgttacgttaacgtacttaaacgtttacttacgtacgttaacgaactacgttacgttaacgttaacccgtacccttacgtaccttacgtttcggaccgtacgggaacgtaggagacgtacgtaacgaacggtactggcgtcgacgtaccactcgttcncgttctacgtaccg

SEQ ID NO: 290910 - DNA, 904 bp, Homo sapiens
  misc_feature: GYAE6OF02HDS3T.48.22.B11.1.454.CMB.1.raw
tcagagtatacatacacgaccggtgctcgatttagacgacagctcagggggctaggtccctagtccaggacaccagcatggacattcggagggtccccggctcagctccgtggggctcctcgctgcctctggctcccaggtgcctagattggtcgaccagtcccagttcgacccagttcctccgatccttcccgtgtcctgtacgtatttcgtggttacggtacgacgacggtaacggtcctacctagttaccgtaaccgtttccggacccggggtccctacggtccgtaacggggttcctaaggtttaaggttaaccgttttaacgttttaacggacccgtttagggttttaccggaacggtaccgtaaacgggtaaacccgtaacggggtaaacccgtacccccgtaaaccgtcccgttaggtaaccgttaccgtaaccggtcctacgtaccttacttaccctacgtttcgacctaacgtcggttaccgggtacccgtacggttacggttcgacggaccggtacgtaacggtacggttacgttaccggtacgggtaaccttaacggttaccgttttacaacccgttactaaccgttaacctttacgttaccgtaccgtaccgtaccggttccgtaccggaccggtacggtaccgtagtaacggtacgttagtaacggttaacgttaacgtttacgttacgtacgttaacctacgttacgttacgtttaccgttaacgttacccgtttaccgttacgtttaccgtttacccgggaccgttaacggttaaccgtacgggttacggtaacgttaacgttaacggtaaaccggttacggttacggtaccgggttacgtaccggtaccgtaaccgttaccggttacggttaccgttaccttaaccgg

SEQ ID NO: 290911 - DNA, 806 bp, Homo sapiens
  misc_feature: GYAE6OF02HV7OU.48.22.B11.1.454.CMB.1.raw
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttcgaccctagtctccatcttccctgtctgcatctgtaggagacagagtctcatctacgttcggccgggcaggtcagggctagttagtaagttatttagccttggtttacagtcaagaaaccgagggaaaccgtacccctaaactcctagacttactacgctcgactacgtacctacgtttcgacctacgtaacgggttcgggggttccccgttacgttacgggttccgaacggtccgggaccgtacgggtacgggtacgttccgggtacgggggtaaacctaagggttaaccttttaccgaaccgtttcccgttaccctaacccgtaacttacccgaacggtaccgtaaccggtccccggttacggaccgaccggtacccgtaagggtaaaccggtagttttacggttacgtaacctttaaaccgttttaacgtttaccgttaacggtacctaaaccggttacgttaaccgttttaaacggttaacccgtttaaacccccgttacccggtttaacctttaaccggtttttacccggggaccggtaaacgggggtaaccgtaaggggttaccggaaggtaccggtaaaccgaaaccggttaacgtcgggttacgccgtaccgtaccgtaacccgttagtaccgttcgttacctttacccg

SEQ ID NO: 290912 - DNA, 772 bp, Homo sapiens
  misc_feature: GYAE6OF02G29GA.48.22.B11.1.454.CMB.1.raw
  modified_base (278)..(278): a, c, t, g, unknown or other
  misc_feature (278)..(278): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatccttccctgtctgcatctgtaggagacagacgtctccatccacttggcccgggccagtcgagggcaagttagaagtttatttagccttggtttacagcaagaaaccgagggaaacnccccctaaactcctagactctacgctgcctactcctactttgactacgtacgggttcggggtccccgttcgttaacggttccacggtccggacgtacggccgggtacgttccgggtagggggcctaagggttacggtttcctaacgttttccctacccgtaaccctaacgtacccaaaccgaccgttaccctttacgaacggtccgttaaggtaaacgtttacgttttacgaaccctttaaacctttaacgtttaacgtttacgttaccgtaaggtccgggttaaagggttcgttaacccgtttacccggtttttaccccccgtacccgtttaccgggttttacccggggacggggtaaaccgggtaccccggtaaggggttaccggtaacccgtaacgtaaaccggttacggttacggtcggtaccctaggaccctaaccgttacgttccgttacggtttaccttacctaccgtttcccgttaccccgtaccg

SEQ ID NO: 290913 - DNA, 706 bp, Homo sapiens
  misc_feature: GYAE6OF02JJN48.48.22.B11.1.454.CMB.1.raw
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctcattcacgttcgccggccagtcagggcagttagaagttatttagtccttggtttcagactaacgaaaccgtacgggaaacgtacccctaaacgtcctagatctacgctgtcactcctacgtttcgactacgtacggtccggggtcccgttcgttacggtaccacggcggaccaggcggtagtcgtacgggacgtacgtactttacaccttacgtacctacctactacgacgccgacgtcctcggacgacgactcggaaagtagttcggttacgtacgttaacttaactttaccgttacgtaacctaacgtagtaccgtttaacgtttaacccggttaaccccgttacccgttaaccgttaccgtttttaccgggacccgggtaacggggtaaccgttaacggggtgggtaaccggtactaaacccggttaaaacgtacccggttaaggtacgggtaccgtaccggtaaccgtacccgttacggtttaccgttccggtttacccttaacccg

SEQ ID NO: 290914 - DNA, 717 bp, Homo sapiens
  misc_feature: GYAE6OF02F9BY6.48.22.B11.1.454.CMB.1.raw
  modified_base (274)..(274): a, c, t, g, unknown or other
  misc_feature (274)..(274): n is a, c, g, or t
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttgacccagtctccatcttccctgtctgcattctgtagagacagagtctccatcacttggccgggtcagtcagggctattaggaagtttattagccttggtttacagacaagaaaaccgaggggaaacncccctaaaactcctagaatcctacgctgactatcctatttcgactacgacggttcggggtcccgtacgttaggttccgaggccggacgacggcggtactcggtagggacagtacttcacttcctacaccgtatacgacgtcaacggtccctaggacacgtccgtaggtaaacgtcgttaggttctaaccgttaaacttttacgtttaccgttacgtaacctaaacgtgttaaccgttttaacggaaccgttttaaacccccgttgtttaaacccgtttaccgttttaaccggggaccccgtaaaggggttaaaccccttaacggggtacgggttaaccgttaaccgtaacggtaaaaacccgggttgttaccggggtacggtaaccgttcgggtaaacctaccgttaaccgttccgttcgttttacccgtcctttaaccccgg

SEQ ID NO: 290915 - DNA, 735 bp, Homo sapiens
  misc_feature: GYAE6OF02IXL7P.48.22.B11.1.454.CMB.1.raw
  modified_base (199)..(199): a, c, t, g, unknown or other
  misc_feature (199)..(199): n is a, c, g, or t
  modified_base (321)..(321): a, c, t, g, unknown or other
  misc_feature (321)..(321): n is a, c, g, or t
  modified_base (569)..(569): a, c, t, g, unknown or other
  misc_feature (569)..(569): n is a, c, g, or t
tcagagtatacatacacgaccggtgctcgatttagacgacagctcaggggagtcccagtcaggacacagcatggacagtgagggtccccgctcagctcctggggctcctgctgctctggctccgaggtgccagactgtcgccatccgagttcggacccagtctccatccttccctgtcctgcatctagtacggagacgngacgtctccatcacgttcggccggtcagtcgagggctaagttaagagtttattacgtccgttggtttcagcaagaaaccgaggaaaccgtcccctaaactcctagacttcgtacgtacgtcncgtaccttacctaccgtttcacgtacgtacgggtcgggtcccgttagtacggttacgaccggcgacgcggtaccggtacgtcgacgggactcggtaactttccacgttacctccaactacgtacgacgacgtccgaccgacgcacggtccctaaggtaaccgtgttcgttacaacgtttaaacgtttactttacgacgttaaccgaaacgtttacgttaccggttaaacttacccgttaaaccccgtntttaaccccggttacgtttacgggacccggtaaacgggtaaccaacgggggttacacggtaacctaaaccgggaacgttacccggtttagggacccgttaacgggtccctaaaccggtaaccggttccttttaccgtacggtttttacccctaaggtttaaccccc

SEQ ID NO: 290916 - DNA, 631 bp, Homo sapiens
  misc_feature: GYAE6OF02HQPM4.48.22.B11.1.454.CMB.1.raw
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttgacccagtctccatccttccctgtctgcatctgtaggagacagagtcctcatcacgttcgccggcagtcgaggctattagaagtttattagccttggttcagacaagaaaccgagggaaaccacccctaaactcctagactctacgctcgaccacctacttctcgaccgtacggtacgggtccggtaccgttacgttacgtacgacggtcgacgtcggtcgtacgtcggacgtactacgttcttacaccttcctaaccgactacgtacgacgacaccggtctacggcacgtactagtaacgtgtacgtactaacttaacttacgttacttacgaactagttcgtaacgttacgttaacccgtaacccgttcgttaaccgttcgtaccggaacggtaacggtaacgtaggtacgacgtacgtaacggaacgtgtaggtactacgttacgactaccgtcgttacgtaccgttcctaccgttacccg

SEQ ID NO: 290917 - DNA, 599 bp, Homo sapiens
  misc_feature: GYAE6OF02GSGNB.48.22.B11.1.454.CMB.1.raw
  modified_base (188)..(188): a, c, t, g, unknown or other
  misc_feature (188)..(188): n is a, c, g, or t
  modified_base (375)..(375): a, c, t, g, unknown or other
  misc_feature (375)..(375): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctcatcttccctgtctgcatcctgtagagacngagtctcatcacttgccggcagtcagggtcattacgaagttatttaggcttggtttcagctaagaaaccaggaaacgcccctaaatctgactctacgctgccatcctacgtttgcaacgtaggtcgggtccctgtaggttcacggtcggcagcggatcgtggactagtactttcgactctcacctancagccacgctcgcgacgtcctaggacgtagtcgttagacgtaacttacttacgtcgtacctaacgtactacttaacggtaccgtaacccttaccgtaaccttacgttttaccggacggtaacgggaacgtaacgggttagacgtaacgtaccgtaaaccggtaacgttacggtacggtaccgtacgtaccgtaaccgttacgtcgttaccggtactttacccgg

SEQ ID NO: 290918 - DNA, 629 bp, Homo sapiens
  misc_feature: GYAE6OF02FOQ8F.48.22.B11.1.454.CMB.1.raw
  modified_base (287)..(287): a, c, t, g, unknown or other
  misc_feature (287)..(287): n is a, c, g, or t
  modified_base (314)..(314): a, c, t, g, unknown or other
  misc_feature (314)..(314): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttcgacccagtcctccatccttccctgtctgctatctgtaggagacagagtctccatcacttcggcccgggccagtcgagggctaagttagtaagtttatttacggtccttggtttcagcaacgaaaccgaagggaaaccncccctaaactcctagactcgtacgtcngctactccacgtttcgacacgtaggtcgggttccctgtacggttcacggtcggcacggcgatcggtaggactaggtacttcacttctacacctatcgacgtacacgtcctgcacgtcctaggaacgtagtcgtacacgttaactttacttacgtcgtactaacgtacgtacttaacggttaacccttacccgttaccgttaaccttacggtttcggaccggtaacgggtaaccgagggtacggacgtaacgttaacgtaaaccgtacgttggtacgtcgtacgacctaccgtacgttcgttccgtactttacccg

SEQ ID NO: 290919 - DNA, 706 bp, Homo sapiens
  misc_feature: GYAE6OF02IVBA1.48.22.B11.1.454.CMB.1.raw
  modified_base (125)..(125): a, c, t, g, unknown or other
  misc_feature (125)..(125): n is a, c, g, or t
tcagagtatacatacacgaccggtgctcgatttagacgacagctcaggggcagtcccagtcaggacacagcatggacatgagggtccccgctcagctccgtggggctcctgctgctctggctccnggtgccagatgtcgccatccagttcgaccctagtcctccattccttccctgtctgcatcgtggtaggagacgaggtacgtcctaccattcctacgttcggcccgggccaggtcgagggtctagttaggtaagttttacgtttacgccgttacggtttcaacggacgaaacggtaaaccgaaggggtaaaccaaccccgttaaactccgtacgtacttaccgtacgtctacgactactaccctacgttcgacctacggtcggtccgggtaccgtaccgttaggtcacggcggcgtacgcgtacgtgtacgggaactagtcctttccgtaacgtctacccgtaactacgacgtaacgaccgtacgtaccccgtagaccgtaccgttaccgaaggtaacgtaaggttccgttaacgtaactttaacgtttacgtaacttcgtaactacgtactacgtttaacgtaaccttaccccgtactttaacttcggttacggtacggaacggggtaaccgtaggtacggtatacggtaacgaattaccgggtggtactcgccgactacgtacggttactcgttacttccg

SEQ ID NO: 290920 - DNA, 675 bp, Homo sapiens
  misc_feature: GYAE6OF02J1U70.48.22.B11.1.454.CMB.1.raw
  modified_base (191)..(191): a, c, t, g, unknown or other
  misc_feature (191)..(191): n is a, c, g, or t
  modified_base (644)..(644): a, c, t, g, unknown or other
  misc_feature (644)..(644): n is a, c, g, or t
tcagagtatacatacacgaccggtgctcgatttagacgacagctcaggggcagtcccagtcaggacacagcatggacatgagggtccccgctcagctcctggggctcctgctgctctgctcccaggtgccagatgtgccatccagttcgacccagtcctccattccttccctgtctgcattctggtagganacgtagtctcctaccatcctacgttcggcccggtaccaggtcgacgggtctagtttaagaagttttacgtttacgtccgttggtttcgacggacgtaacgaaaccggtaacggaaccgtaaccccgttaacctacgtacgtactaccttacgctcgtacctacctccgttaacgttcgaccgaccgtaacgggttccgggtcccgttacgttacggtacgtacggccggacgacggtaccggtacgtacgtacggtacctagtacttttcgaccttacctccgacctactaccgacgacgaccgtcgtacgaccgtcgaccgtaagtacgtagttacgtacgtaacttacgttacttacgtcgtacaccgtatcgttacgtaccgtacccttacgtacgttcgttacgaggtacggagtaggtacagttagaaccgtaacgtagtaccggtancgtacgtaccgtatacgtacttactctaccg

SEQ ID NO: 290921 - DNA, 843 bp, Homo sapiens
  misc_feature: GYAE6OF02IHL2X.48.22.B11.1.454.CMB.1.raw
  modified_base (163)..(163): a, c, t, g, unknown or other
  misc_feature (163)..(163): n is a, c, g, or t
  modified_base (192)..(192): a, c, t, g, unknown or other
  misc_feature (192)..(192): n is a, c, g, or t
  modified_base (203)..(203): a, c, t, g, unknown or other
  misc_feature (203)..(203): n is a, c, g, or t
tcagagtatacatacacgaccggtgctcgatttagacgacagctcaggggcagtcccagtcaggacacagcatggacatgagggtcccgctcagctcctggggctcctgctgctctggctcccagggtcgccagactgtgaccatccagttcgacccagttcncactcttccctgtctagcatctgtagganacagcgttccncatcctattcgggccccgggacctagtccggagggtctaagttaacggtaacgttttaactttacggtccgtttggtttacgacggctaaacggaaaaccgtaagggggaaacccgaccccggaaacgtccgttaccttaacgttttccgacgttcgttacctaccgttaggtttacgacgtacggtacggtacggtaccgttacccgtacgttaccggttcgtttacggacggtccggtacgtaacgggtaggttacgttaccggggtacggggtacgtaacggttacgtttccgttacttacccgtaccgtaccgtaacgtaccctaaacgtaccgttaccccgtttacacccgggttacgtaagtaaacggtttaccgttttacggaaccctttaacgtttaaccgttaacgttttacgtacccgtaggaccgggttaacgggtacgtacccgtttaccgtttacccccgtttccgtacgggttttacccggggaccgggtaacggggttacccgggtacggggttaaccggttaaccgtaacccggtaacgtacggttacgggtaccggttacgaccggtacccgtaacgacgtttcgtaccgttaacgttcctaacggtttccccgacccttacg

SEQ ID NO: 290922 - DNA, 724 bp, Homo sapiens
  misc_feature: GYAE6OF02HUXJ0.48.22.B11.1.454.CMB.1.raw
  modified_base (256)..(256): a, c, t, g, unknown or other
  misc_feature (256)..(256): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccattccttccctgtctgcatctgtaggagacagagtcctcatcacttggcccgggcagtcgagggctattaagtaagttattagtcctggtttacancgaagaaaccgaagggaacaccctaaactccagtatctacgtctcgcactcctacttcgacacgtacggtcgggtccgttacgtacggtcgacggcggcgaggcggatcggtaggacagtactttcacttcctacctaacctagtaccgaggcccgtaaccgccgttacgaccgtacggtaccttaacggaagttacgttacgttaggtaaccttaaacgtttaactttaaccgtacgtaccttaaacgacgttaacgtttaaccggttaacccggttaaacccgttacccgtttaaaccgtttcccggtttttaacggggacccggtaaaccggggttaaccgggaacgggtttacgggtaaacgtaacggttaaaccgaaaacgggttaccgtacgggttacggtaccgttacggtaacccggttaaccgttaccgttaccggttttacgttacccgtttaacccg

SEQ ID NO: 290923 - DNA, 751 bp, Homo sapiens
  misc_feature: GYAE6OF02FP4YY.48.22.B11.1.454.CMB.1.raw
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttgacccagtctccatccttccctgtctgcattctgtaggagacagagtcctccatcacttgccgggccagtcagggctattagaagttattagcctggttcagcaagaaaccgagggaacgcccctaaactcctagatctacgctgctatcctactttcgacacgtacgggttcggggttcccgttcgtacggttcacggccggcgaggtccggattccggtagggactaggtactttccgacgttccgtaccacctactccgacgtaccgacggtcccgtacgaccacggtaccgtaaggtaaacgttacgttacggttaccgtaaccgtttaaaccgttttacgtttaaccgttaccgttaacccgtaaacgtaaccggttacgttttaaaccgggttaaacccgtttaaacccccgttacccgtttaaacccgtttaacccggtttttaccggggaaccccgggttaaacggggtaacccgttaaaggggttacgggtacgttaaccggtaaccggtaaaaccggttaaccggttacgggttacggtaccgttacggaccctaaccgttaccgttacggttacgtttaccgttacctacccg

SEQ ID NO: 290924 - DNA, 652 bp, Homo sapiens
  misc_feature: GYAE6OF02FX6S0.48.22.B11.1.454.CMB.1.raw
  modified_base (263)..(263): a, c, t, g, unknown or other
  misc_feature (263)..(263): n is a, c, g, or t
  modified_base (308)..(308): a, c, t, g, unknown or other
  misc_feature (308)..(308): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccggccagtcgagggcattagagttattagcctggttcagcaagaaaccagggaaacncccctaaactctagatcctacgtactgacactccactttgcacgngtcgggtcctgtagttcgagcgcagcggatcgtagggactagactttcaccttctaccacctatacgagaccagtccgtcggacacgtaccgtagaaagtacgtacggttacgtacttaacgtttataaccgtacgttaactaacgttaagtaccgtttaacgtaaccgttaaccccttacccgttaacgttaccgttttacgggaaaccccggtaaggggtaacccctaaggggttaccggaacgttaacgtaaaccgtaaacggtaccgttaacggttaccggtaccggttaacgtaccccgtaaccgttaaccgtttaccgttaccgtttacttaacccgg

SEQ ID NO: 290925 - DNA, 810 bp, Homo sapiens
  misc_feature: GYAE6OF02GDIPB.48.22.B11.1.454.CMB.1.raw
  modified_base (284)..(284): a, c, t, g, unknown or other
  misc_feature (284)..(284): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatccttccctgtctgcatctgtagagacagacgtctccatcacgttcggccggccagtcgagggactaagttaagtaagtttatttacgccttggtttcaggacaacgaaaccgagggaaaccncccctaaactcctagactcgtacgctgacctactcctacgttcgacctaacgtacggggttccggggttcccctacggttacggttccgacggccgggtacgacgggtccgggtacttccgggtacgggaactacggtaactttaccgaccttccgtaccgtaaccctagtaccgaccggtaccgtaccgtccgttacggacccgtacggaccctaagggtaaacggttgttacgggttacgtaaccgttaacgttttaaccgtttaccgacgttaacctaaaccgttacgttaacccgtttaaacgggttaacccggtttaaaccccgttacccggttttaaaccgtttcccgggtttaaccgggacccggggtaaacgggggttaaccctaaggggggtttacgaaaccggtaaaccgttaaaccgggtaaaacccggttaaccggttcgggttaacggtccgttaacccggtaacccttaaccttacccggtttacgttacccggttaccctttaaccccggg

SEQ ID NO: 290926 - DNA, 769 bp, Homo sapiens
  misc_feature: GYAE6OF02HW1FS.48.22.B11.1.454.CMB.1.raw
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttcgacccagtctccattccttccctgtctgcatctgtaggagacagatctcatcacttgccggtccagtcgagggtctagttaacgtaagtttatttacggtccgttaggtttacagcgtaacggaaaccgaagggaaaccgtaccccttaaactccgtaggtaacttaccgtacgtcgttacgaccgtacttcccgtactttacgacctacggtacgggttccggggtaccttcggttaaggttccggacgtccggacgaggtcggagttcggtacggactagtactttaccacctcgtaccactacttacgacgccgtaccgtccgtcgaccgtacgtaccgtagaacgttcgttacggttaacgttaccttaacgttttaacgtaccgttaactaccgtaaaccgttacgttaaccgtttaaccgttaacccgttaacccggtttacccgtttaccggtttaacccggtttttaccgggaaccgggtaaacggggtaacccggtaagggttccggttaaacgtaaccggtaacgttaaaccggtacggttaccggtacggttccggtaccgtacccggttaacttacccgtttacggttacccgtttacgttaccccgg

SEQ ID NO: 290927 - DNA, 626 bp, Homo sapiens
  misc_feature: GYAE6OF02FVTLG.48.22.B11.1.454.CMB.1.raw
  modified_base (212)..(212): a, c, t, g, unknown or other
  misc_feature (212)..(212): n is a, c, g, or t
tcagagtatacatacacgaccggtgctcgatttagacgacagctcaggggcagtcccagtcaggacacagcatggacatgagggtccccgctcagctcctgggactcctgctgctctggctcccagataccagatgtgacatccagatgacccagtctccatccctcctgtctgcatctggtggagacagagtcaacgtcacgttggccggngagtcgaggctaattaacaatttattagccgtgtatcagcagcatcgaaggtaacttccaagtctctgatctatgctgctatcctacttgactatcgacgggtcctatccgtcgtcagtgcggtagataggtcggatagtacttacaccgttctacactagtaccacgtacgtacgtccttaggaccacgtccgtaaggaagtacggttcgtacgtaccgttaaacgtttacgttacctaacgttaacgtaaacgtttaccttaccgtttaacgttaccccggtacccttaagtccccgtttaaccgttcccggaaccgttaccggggaaccttaccggtaccggttaacgggaactttaaacggttaaaccggtacgttacccgggtaggtacttacccggtaccttaacccg

SEQ ID NO: 290928 - DNA, 628 bp, Homo sapiens
  misc_feature: GYAE6OF02G3435.48.22.B11.1.454.CMB.1.raw
  modified_base (187)..(187): a, c, t, g, unknown or other
  misc_feature (187)..(187): n is a, c, g, or t
  modified_base (569)..(569): a, c, t, g, unknown or other
  misc_feature (569)..(569): n is a, c, g, or t
  modified_base (595)..(595): a, c, t, g, unknown or other
  misc_feature (595)..(595): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgctatctgtagganacagagtcctccatcacttgccgggcagtcgaggcagttagaagttattacggccttggtttacagtcaagaaaccgaggaaacacccctaaacgtcctagactctacgctcgactactcctactttcgactacgacggtcgggtcccgtagttacggttcacggccggtacgacggtcggacgttcggtagggactaaggtactttccgacttcctacacctatcgacgactacgccgtagccgacgtaccgtgaaagttcgttaggttactaccttaaacgtttacttacgacgttaaccaaacttcggttaaccttaaggtacccttaacccgttccgttaacgttaccgtttagggacccgtaaggggacctaagggngtaagacgtaaccgaaacgtgtcggngtacgtcgactaacctcgtacttcgttctaacc

SEQ ID NO: 290929 - DNA, 903 bp, Homo sapiens
  misc_feature: GYAE6OF02IUS8E.48.22.B11.1.454.CMB.1.raw
tcagagtatacatacacgaccggtgctcgatttagacgacagctcaggggcagtcccagtcaggacacagcatggacatgaggtccccgctcagctccgtggggctcctgctgctctggctcccaggtcgccagatgtcgccatccagttcgaccctagtcctccattccttcctgtctgcatctgaggacacgagacgtcctacatctaccgttgccggcctagtccgaggtctaagtttaggtaatttagtttacggtcccgtttgggtttacacggtaccgaaacggtaaaacccggaacgggtaaaaccccgtaccccccgttaaaaccttccccgtagtaaaccttaccccgttaaccgtaccgtacggtaaccctaccgttaccccgtttaccgttttccgaaccgtaccggttaaccgggggtttcccggggttacccccgtttacggtttaacgggtttacccgaacggggtacccgtaccggtaacgggtcccggggttacgttccggggtaacgggtaaactaacgttttaaccgtttaccgaacccgtttaccgtaacccaaccttacgtacgaacccgaccgttaccgaccccggtcgtaccggtaaaccgttccggaaggttaaaacggttcgttacggtttaacccgaaactttaaaccgttttacggttaaccttaccgttaaaccgtaacgttaccggtttaaacggttttaaccgtaacccgtttaacccccgttacgttaacccggttttacgttacccgggaaaccggttaaacggggtaaccgacgggttagaaccgttaaccgtaaaaccggaccggttaacgtcgggttcgtaaccgccgttaccgtaacgttccctttacgtccgtttaccgttaacccg

SEQ ID NO: 290930 - DNA, 845 bp, Homo sapiens
  misc_feature: GYAE6OF02HZSPZ.48.22.B11.1.454.CMB.1.raw
tcagagtatacatacacgaccggtgctcgatttagacgacagctcaggggcagtcccagtcaggacacagcatggacatgagggtccccgctcagctccgtggggctcctgctgctctcggctcccgaggtcgccagatgtcgaccatccgagttcgacccagtcctccattccttccctgtcctgacatccttggtaaggagacgagacttccacatcctacgttcggcccgggactacggtaccgacgggtataagttaaggtaagttttacgttacggtacccgttggtttaccgaacgtaccgaaaacgtaaaccggaacgggtaaaccccgtaaccccttaaaaccgtccgtaacggttaactacccggtaacgtaccgttaccggaaccttaccgtacccgtttaccgttacgaccgtaacggttaccgggggttacccgggttacccgttcggttaaacgggttccgacggggtaccgaacccggtaacggtaccgggttaaccgtacggggtttaacccgggaacgtaaacggtttcgttttaaccctaacccgtttacgttaaacccaaccgttaaccgttaccgaacgacgtaaccggtaccgttcggaaccgacgtacgtaacgtaagtacgtttacgtaacgaactttaaaccgttaacgttacttacggaactaaacgtacgttacgttaaaccgacccgtttaacccgttaccggtaactttaacgttcccggaaggtaaccggaacgtaagggagtaacgtaacgaaacgttaaacgtcggtaggttacccgtagacctaaccgtacttacgtcttacggttacctaccg

SEQ ID NO: 290931 - DNA, 696 bp, Homo sapiens
  misc_feature: GYAE6OF02GL1PN.48.22.B11.1.454.CMB.1.raw
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttcgaccagtctccattccttccctgtctgcattcgtagtaggagacagacgtctaccatctacttgaccggtcaggtcacgggctaagttagaagtttagtttacgccgttaggtttaccaggtactaaaggaaacccgaagggaaaaccgtacccccttaaaacctaccgtacgtaacttacgtaacgcgttacgacctaactacccgttatttacgaccgaacgtaccggtccggggttcccgttaccgttaacggtttacgacggtccggacgtaggacggtaagtcgtagggacctaaggtactttccgtacttacgaccgtactacgtacgacgcgtacgaccctggaccagtcctaggagttagtgtacaacttaagttacttaccgtgtaacaactacgttaacgttacgtaacccgttaacccgttccgttaacgttacgtttaccggacggtaaacgggtaactaacgggaggtaagtacgtaacgtaaacgcgtttaacgggattcgaaccacgtactacgtgttacgtttctacttacc

SEQ ID NO: 290932 - DNA, 778 bp, Homo sapiens
  misc_feature: GYAE6OF02GZNMH.48.22.B11.1.454.CMB.1.raw
  modified_base (565)..(565): a, c, t, g, unknown or other
  misc_feature (565)..(565): n is a, c, g, or t
  modified_base (745)..(745): a, c, t, g, unknown or other
  misc_feature (745)..(745): n is a, c, g, or t
tcagagtatacatacacgaccggtgctcgatttagacgacagctcaggggcagtcccagtcaggacacagcatggacatgagggtccccgctcagctcctggggctcctgctgctctggctcccgaggtgccagatgtgccatccagttcgaccctagtcctccattccttccctgtcctgctactcgtggtaggagacagtacgtcctcctatccgtacgttccgggcccgggaccgtacggtacggacgggtactaagtttaaggtaagttttagtttaacggtccgtttacgggtttacaacggtaccgaaacggaaaaccggaaacggggtaaacccgtacccccgttaaaaccgtcccgtacgtaccgtacccgttaccggtaccgtacgtacctaaccttacccgttacgtttaccgaccgtaacggtaccggggttacccggggttcccggttacggttaacgggttccgacggtcggacgtacggtacggtacgtacggtacgggtacgtacgttacttaccgtaccgttcctacctaccgtacgtacgacgtaccnccgtcctcgaccgtacgtacgtagtaacggtacgtaggttacctaacgttaactttacgtacctacgtaaccacgtacttaacgttaaccgttaacccgtacccgttacgttaaccgttcggttaccggaaccggtaagggacgttaggacgtagtactaacggtaacgtacgcggttcngtaccgtaccgtagtccgtgttacgtcttaccg

SEQ ID NO: 290933 - DNA, 805 bp, Homo sapiens
  misc_feature: GYAE6OF02F4I12.48.22.B11.1.454.CMB.1.raw
  modified_base (201)..(201): a, c, t, g, unknown or other
  misc_feature (201)..(201): n is a, c, g, or t
  modified_base (250)..(250): a, c, t, g, unknown or other
  misc_feature (250)..(250): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccagtcttccctgtctgctactctggtaggagaccagacgtcnccatcacgttgccggccagtcagggctattagagttattagcctggttnagactaacgaaaccgagggtaaacacccctaaactccctagatacgtacgtctacgcactacctacgtttcgcacgtacgttcggggtcccgttacgttacggtactacggccggcgaacggtcgggtactacggttacggggtaactaaggttacgttttaccaaccctttacccggtacccaacctacgtacgacggtacctacggtacccctaggtaccgtaccggtacccgtaaggtaaacgtacggttacggtttaccggttaaccgtaaaaccgtttttaacgtttaaccggttaacgttaccgtaaaccgttacgggttaaccgtttaaaccgggttaacccgttaacccccgtttaccgttaacccgttttaccgggttttaaccggtaaccccgggttaaacggggggtaaccccgtaaggggtacgggtaacgttaaacccgggttaaaacggtaaacccggttacgggtttaaccggtacgggttaccttacggacccggttaaccccgttaagtttcccgttacggttaccgttttaaccccg

SEQ ID NO: 290934 - DNA, 664 bp, Homo sapiens
  misc_feature: GYAE6OF02JAAG9.48.22.B11.1.454.CMB.1.raw
  modified_base (134)..(134): a, c, t, g, unknown or other
  misc_feature (134)..(134): n is a, c, g, or t
  modified_base (187)..(187): a, c, t, g, unknown or other
  misc_feature (187)..(187): n is a, c, g, or t
  modified_base (238)..(238): a, c, t, g, unknown or other
  misc_feature (238)..(238): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagntgtgccatccagttgacccagtctccatcttccctgtctgctatctgtagganacagatctcatctacgttcgccggccagtcagggctagttagtaacgtttntttaggccttggttacagacaacgtaaaccgaggaaaccgtacccctaagtcctagtactacgtacgctagctactcctactttcgaccacgtacggtcgggttacccgtgtaggttcaggccggacaggtcggtacgttcggtagggactacggtactttccacttccgacctacctaatcgaacgtcctaaccgccgttacgacgtacgtaccgtagaacgtattcgtacgttaacttaccgtttaattacctagtacctaacgtacgttaacgttacgggttaacccttacccttaaccggttaaccttaccggttttacggaccggttacgggaaccgttagggtaccgtaagtacggtaacgtaaaccgtcggtaggtcggtacgtaccgtacctaccgttacgtaccttggtacccttcg

SEQ ID NO: 290935 - DNA, 906 bp, Homo sapiens
  misc_feature: GYAE6OF02ITMSC.48.22.B11.1.454.CMB.1.raw
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttgacccagtctccatcttccctgtctgcatctgtaggagacagacgtctccatccacgttcggcccgggccaggtccgacggggcctaagttaaggaacgtttacttacggtcccttgggttttcagtaccaaacggtaaaccccgaaggggaaaaccgacccccttaaaacttccctagtactacgtaaccgcgtgactacgtccctaacgtttgacctacgtacggtccgggggttacccttcgttacggttaccgaggtccggtacaacgggcgggtaatccggtaggggacctaggttaaccttttccaccttccgtaccctaacctaccgttaccgaacgtaccggtaacccgtcccgttacgggtacccgaaccgggtaccccgttaagggtaaaacggttacgtttaccggtttaaccggttaacctttaaaaccgttttttaaccgttttaccgtttaacggttaacccgttaaaaccggttaacgggtttaaccttttaaaaccggggtttaaccccgtttaaaacccccgttttaccccgggtttaaaccgttttaccggggtttttaacccgggaaccccggggttaaaccggggggttaaaccggttaaaccggggttagggtaaccgttaacggttaaacccggtaaaacccgggttaacgtttaccggggtaccggtaacccgttacgtaaccccggtaacctttaccggtttaccgttaccgtttacccgttacccggtttaccc

SEQ ID NO: 290936 - DNA, 787 bp, Homo sapiens
  misc_feature: GYAE6OF02GS8GL.48.22.B11.1.454.CMB.1.raw
tcagagtatacatacacgaccggtgctcgatttagacgacagctcaggggagtcccagtcaggacacagcatggacatgagggtccccgctcagctcctggggctcctgctgctctggctcccaggtgccagatgtgccatccagttgacccagtcctccatccttccctgtctgctatctgtaggagacagagtcctccatctacgttcggcccgggcctaggtccgagggactagttaagtaagtttattacgtccgttggtttcagtacgaacgaaaccgagggaaaccaccccttaaactccgtagacttcctacgctcgacctactcctacgttcgacctacgtacgggtccggggtacccttgttacggttcgaggccgcgacggtcggtattcggtagggaactaggttactttccgaccttcctaccaaccgtattaccgaacgtccgtaacgtcccgttacggaccgtaccggaccgtaagggtaaacgtcgtttcggtaaccgtaaccgtttaaaacctttcgtttaacccggtaagttaaacccgtaaaccgtttacggtttaacccgtttaaaccggttaaacccggtttacccccgttaaccggtttaaccgtttaaccgggttttcccgggaacccgggtaaaccggggtaaacgttaacgggggttagaccgtaaccgttaaacggtaaaaccggttaccggttgggtacccggtacgtacccggtaacccgtacttccggttaccggttccttaccgttaccgttaccccg

SEQ ID NO: 290937 - DNA, 875 bp, Homo sapiens
  misc_feature: GYAE6OF02IIK6Q.48.22.B11.1.454.CMB.1.raw
  modified_base (92)..(92): a, c, t, g, unknown or other
  misc_feature (92)..(92): n is a, c, g, or t
tcagagtatacatacacgaccggtgctcgatttagacgacagctcaggggcagtcccagtcaggacacagcatggacatggagggtccccgntcagctccgtggggctcctgctgctcgtcggctcccgaggtcgccagatggtcgaccagtcctaaggttcgaaccctagttcctcctacttcccttccccgtgtcctcgctacgtcgtaggtacggaagaacgacggtacgtcctcctaacttccgtaccgttccgggacccggtacctacggttaccggtagggtaccttaaagttaacggttaagttttaacgtttaaccggtcccggtttacggtttaaccgaacggtaaccggaaaaccggtaaaacccgggtaaaacgggtaaaaccccgttaaccccccgttaaaaccgttccgtaacggtaacccgttaccgtaccggtacctcggtaaccttaccgttaccctacgttcgaaccgtacggtcggttaccgggtcccgttagtaccggtacgtcggaccggcgtacgggcgtacgtacggtacggacgttacggttaccttaccgtccttaccgacccgtactacgtaccgacgacgttccgccgtcgaccgtaacgtccgaaggttacgtaacgttcgtaaccgtttaaccgttaacgtttaacgttccaagttacccgaagttccgttaacggtttaccgtaacccgttacccgttacccgttaacgttccgggttaccggaaccggttaacgggaacgttaacgggtccggaagtaacccgtaacggtaaaccgttggtaacccggtcgtaaccggtaccgtaccttaaccgggttccttacggttaccgttccgttaaccgg

SEQ ID NO: 290938 - DNA, 745 bp, Homo sapiens
  misc_feature: GYAE6OF02HU200.48.22.B11.1.454.CMB.1.raw
tcagagtatacatacacgaccggtgctcgatttagacgacagctcagggggagtcccagtcaggacacagcatggacatgaggggtccccgctcagctcctggggctcctgctgctctggcctccaggtgccagactggtgccatccagttcgacccagtcctccattccttcctgtctgcactcgtaggtaggacgacaggtacgtcctaccataccgtacgtttccggcccggctaaggtcgacgggtctaagtttaagtacgtttattacgccgtttacggttcacggacaaacggtaaaccgacgggaaacctaccccgtaaacgtcctagtcttaccgtaccgtacgtcgactaccttcctactttcgactacggtacgggtccggggttccttacggtacggtggacgtccggacgtacggtacgggtactcggtacggtaacgtaacgtttcttacccgacctttccgtacccgtaacgtactacgtacgccaccggtcctaacgacgtaccgtcttaaggagttattcggttactaaccgtttaacgtttactaccgttctaacgtaagtaccggtttactaaccgggtttaaccgtacccgttacgtttaacccgtacgtttaccggggtacggaacggttaacggtagtaacggactaacgaaccgttaaagcgttaacgggtcgtaacgtcggtaccgtaactcgtttaccgtacgttacgtacttaaccccgg

SEQ ID NO: 290939 - DNA, 636 bp, Homo sapiens
  misc_feature: GYAE6OF02I4QAL.48.22.B11.1.454.CMB.1.raw
tcagagtatacatacacgaccggtgctcgatttagacgacagctcaggggcagtcccagtcaggacacagcatggacatgagggtccccgctcagctccgtggggctcctgctgctctggctcccaggtgccagatgtgccatccagttcgacccagtctccattccttcctgtctgcatcgtgtaggagacagacgtctcatcacgttcgccggcaggtcagggtctaagttacgtaagtttatttacgccgttaggtttcgagtcgaaacgaaaccgaagggtaaaccgtacccctaaaacctccgtagtactaccgtacgctagccactacctagtttacacgtacgacgggttccgggtaccttcgtcggttacacggcgacgacgtcggactcggtacgggaacgtagtactttacgaccttccgtacctaccgacgttcacgtccacgcctacggctacgacgtacgaagtcgttgtactaacttaactttaactcgttaactacgaaacgttcgttagtaacgttaccgtaccctacgtaccgtttcgtacggaccgaagtacgtaggtacgacaacgtacgaacgtcgtaggtcgacgtcgtaacacgttactcggttctcgttaccg

SEQ ID NO: 290940 - DNA, 788 bp, Homo sapiens
  misc_feature: GYAE6OF02HXTLQ.48.22.B11.1.454.CMB.1.raw
tcagagtatacatacacgaccggtgctcgatttagacgacagctcaggggagtcccagtcaggacacagcatggacatgagggtccccgctcagctcctggggctcctgctgctctggctccaggtgccagatgtgccatccagttcgacccagtcctcattccttccctgtctgcatctggtaggagacgagacgtcctcatctacgttcggcccgggcctaggtccgagggactaagttaggtaagttttacgtttacgtccgtttgggtttacgaacgtaacgtaaccggaaaacccgaacggggtaaaaccgtaccccccgttaaaaccgttcccgtagtacttaccgtaacccgtccgtacgcctaaccgttacccgttaaccttttcggacccgtaaccggtaccggggttccgggggttacccctttaccggttaacggggtttccgacgggtccggtacggacgggtaccggtacgttccggttacgggtacgtaacggttacctttaccgaaccgttcctaacccaaccgtacgtaccgacggtacgtccgtaccgttacgacgtacggtccgtagaacgtacgttcggtacgtaaccttaagtttacttaccgtacgtaacgacgttacggtacttaacggtaacccgttacccgtacgttacttaccggtttcgggaccggtaaacgggtacgtaacgggtcggtaactacgtaacgaacgttcgtacggtacgccgtaccgacgtaccgttatccgttcgttccctacgtaccccg

SEQ ID NO: 290941 - DNA, 770 bp, Homo sapiens
  misc_feature: GYAE6OF02IXNSS.48.22.B11.1.454.CMB.1.raw
tcagagtatacatacacgaccggtgctcgatttagacgacagctcaggggagtcccagtcaggacacagcatggacatgagggtccccgctcagctcctgggggctcctgctgctctggctcccaggtgccagatgtgccatccagttgacccagtctccatcttcctgtctgcatcgttgtaggagacaagacgtctccaatcacttggcccgggccagtcgagggtacaattagtaagttatttagtcctggtttacagtacaacgaaaaccgaaacgggtaaaacgaacccccttaaaacgttcctaggtacttccgttaaccgaccgtacggcctaaccgtacctaacgttttcgacctaccgtacgggttacgggggttccccgttacgttaacgggttacgaacgaccgggtcgaacgggtccggtaacgttccggtaggggtaacgaaggtactttacggtacctccgttacaaccctacgtacgagaccgacggtcccgtacgcgtaaccggaccgtaaggaacgtaagttcggtttaccggtaacttaacgtttaacgtttaaccgttcgtaacccgtaactagttaccgttaaagttaacccgttaacccttacgttaaccgttacgttttaccgggaaccggtaaaccggggtaaccgtaacggggtacgtaacggaacgttaaccggtaaaactaaccggttacgggtaacgcgttacggaacccttaacgtacttccgtacgttaccttacctaccg

SEQ ID NO: 290942 - DNA, 822 bp, Homo sapiens
  misc_feature: GYAE6OF02F57AI.48.22.B11.1.454.CMB.1.raw
tcagagtatacatacacgaccggtgctcgatttagacgacagctcaggggcagtcccagtcaggacacagcatggacatgagggtccccgctcagctcctggggctcctgctgctctggctcccaggtcgccagatgtgccatcctagttcgacccagtcctccatcttccctgtctgctagtctaggtaggagacagtacgtctccgatcctacttcggcccggtcagttcgagggtctagttagtaatttacgtttacgccgtttacggttacaggtaccgaaacgtaaaacccggaacgggggtaaaaccccacccccgttaaaattcccgttaagtaaccttacccgtaacggttcgtacgtaccgtacccttacccgtaccgttttggacccgtaacgggttaccgggttaccgggggttaccccgtttaacggtacgggttaccgaacggtccggtacgacggtaccggtacgtaccgggttaggtaacgtaagttcctttacctaaccgtcctaaccgacctatcccgtaacgacctacgtccgtacgacgtaccggtacgtaggtaaaccgttcgttacggtaacttaaaccgttaacttttacgttaaccttaaccggtaactttaaaccctttaacgtttaaacctaacccgtttaccgttaaacgtaccgttaaccggttcccggttaacccggaaaccggttaacgggcccgttaaacgggaccgtaaaccgaccggtaaccggttaagttcggtacgacgttaacccaccgttaccttaacgtccgtttcgttaccttacggttacccc

SEQ ID NO: 290943 - DNA, 756 bp, Homo sapiens
  misc_feature: GYAE6OF02G1KHJ.48.22.B11.1.454.CMB.1.raw
  modified_base (128)..(128): a, c, t, g, unknown or other
  misc_feature (128)..(128): n is a, c, g, or t
  modified_base (513)..(513): a, c, t, g, unknown or other
  misc_feature (513)..(513): n is a, c, g, or t
  modified_base (577)..(577): a, c, t, g, unknown or other
  misc_feature (577)..(577): n is a, c, g, or t
tcagagtatacatacacgaccggtgctcgatttagacgacagctcaggggcagtcccagtcaggacacagcatggacatgagggtccccgctcagctcctggggctcctgctgctctgctcccaggtnccagatgtgccactccagttcgaccctagtcctccgattccgttccctgtcctgcctatcgttagtacggagacacggtacgtctccaacttccgtacgttcggcccgggtacctaacgtcggaacgggtcctaaagtttaacggtaagttttacgttaaccgtccggtttggtttaaccaggaccgtaaacggaaacccggtaagggaaaccctacccctaaacgtcgtacgacttacctacgtctcgactaccgtcctattacgccgtaagtcggggttccggtaccccgttagtacggttcacggtccggacgaacgggtccgtaagttcgggaggtaaaccttcgtacctttaccaccgttactccaaccgtatcccgaanccgtacgtccgtgaccgtctaccggagttaaacgtgttccgtacttacttacgttaacttaccncgttaacactcgtttaaaccgtacgttaacccgtaccgttaccgttacgttacggtttaccgggaaccgtaaacggggtaccgtaagggttacccaacggttcggtaaaaaccgaccgttacgggttacgtacgtccgtaacggtaccctaccggtactttcgtaccttcggttaaccc

SEQ ID NO: 290944 - DNA, 735 bp, Homo sapiens
  misc_feature: GYAE6OF02FVHU0.48.22.B11.1.454.CMB.1.raw
  modified_base (119)..(119): a, c, t, g, unknown or other
  misc_feature (119)..(119): n is a, c, g, or t
  modified_base (180)..(180): a, c, t, g, unknown or other
  misc_feature (180)..(180): n is a, c, g, or t
  modified_base (203)..(203): a, c, t, g, unknown or other
  misc_feature (203)..(203): n is a, c, g, or t
  modified_base (599)..(599): a, c, t, g, unknown or other
  misc_feature (599)..(599): n is a, c, g, or t
tcagagtatacatacacgaccggtgctcgatttagacgacagctcaggggcagtcccagtcaggacacagcgatggacatcgagggtccccgctcgagctcctggggcctcctgctgcnctcggctcccaggtcgccgtagatgtgcctagtccagttgacccagtctccactcttcccngtctgctagtcgtgacgcgacgngtacgtcctccgaatcgtaccgttcggcccgggtacaggtccgaagggtcctaaagttaaggtaacgtttacgtttacggtccgtacggtttacacggacgacggaaaaccggagggtaaaccaccccgtaacgtcccgtagacttcgtaacgtcgtctactactaccctaacgttccaacgtccaaggttccgggtcccgttaacggttcggttacggaaccggtccggtacggaacgcgggtaaccgttcgggtaacccggggtataacgttaaccgttacgtaccggttcctaacccgttacaccggttacaacggtacctacggtccgtacggaccctaggtaccctagggtaacgttcggtaagttcgttaacctactttaataccgttanaccgtaaccgtcgttacgttaacttacccggtaaccgttacccgtgttaccgttacggacggtaccggtacgtacggtacgacgtcgaaacttacggagttggtccgacgtcgacttaccgtctacgtcgtagttc

SEQ ID NO: 290945 - DNA, 770 bp, Homo sapiens
  misc_feature: GYAE6OF02GSD22.48.22.B11.1.454.CMB.1.raw
  modified_base (187)..(187): a, c, t, g, unknown or other
  misc_feature (187)..(187): n is a, c, g, or t
  modified_base (744)..(744): a, c, t, g, unknown or other
  misc_feature (744)..(744): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatccttccctgtctgcatctgtagganacagagtctccatcacttcggcccgggccaggtcgagggactaagttaaggtaagtttagttttacgtccgttaggtttccagtacaacgggaaaacccgtaacgggggaaaaccgtaccccccgttaaaacttcccgtaacggtaacttacccgttaaccggtcgttacggacctacttcccgtaaccgtttcgactaacgtacggggttccgggttaccccgttacggtacgggttccgacggtcggacgacggtcggtacttacggtacgggactaggttacctttaccaccgttcctaaccaccgttactacgtacggtaccctacgggtccccttacggaccgaccgttaccggtaaaggaaccggtacgtttacgggtacttaaccttaacggttttacttaccgttacgtaaacctacggtacgttaaccgttaacggggttacccttaacccgttacccggttaacctttaccgggtttcggaccgggttaacggtaaccggtagggtacggtacaaccggtacgaaaccgttcggtaaggtccgtacncgtaccaacgtgtacttcgttactcg

SEQ ID NO: 290946 - DNA, 770 bp, Homo sapiens
  misc_feature: GYAE6OF02FVG1Y.48.22.B11.1.454.CMB.1.raw
  modified_base (186)..(186): a, c, t, g, unknown or other
  misc_feature (186)..(186): n is a, c, g, or t
tcagagtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatccttcctgtctgcatctgtagganacagacgtctaccatcacttcggccggcagtcagggctagttagtagttattagtccttagttcagcgaacgaaacgaggaaccgaccctaaactccgtagactctacgcgtgactactcctactttcgactacgtacggttccggggtcccgttacggttacggttcgacggtccggacgtaccgggtacggtaacgttaccgggtacgggaaccgtacggttactttaccgacccgttccgtacccgtaacccgtaactaccgttaccgaaccgtaccggtacccgtacgaccgtaccggttaccgtaacggtaacggttagtttaccggttacgtaaccctttaacgttttaacgtttaccgttaccgtaaccgtaaccgttaacggtttaaacctttaaccggttaaacccgtttaacccccgttaaccggtttaaccgtttaaccgggttttaccgggaaacccgggttaaccggggttaacccgttagggtaccgggtaaccgtaacgtaaaccggtaaccggtaaccggttggtaccgtacgtacgacctaccgttactacgttcttccttaacccg

SEQ ID NO: 290947 - DNA, 777 bp, Homo sapiens
  misc_feature: GYAE6OF02GEWAH.48.22.B11.1.454.CMB.1.raw
  modified_base (93)..(93): a, c, t, g, unknown or other
  misc_feature (93)..(93): n is a, c, g, or t
tcagagtatacatacacgaccggtgctcgatttagacgacagctcgagggggagtcccagtcaggacaccagcatggacatgagggtccccgntcagctcctggggctcctgctgctctggctcccaggtgccagatgtgaccatccagttcgacccagtcctccattccttcccgtgtctagcatcgtaggtacggagacagacgtcctacagtcacgttcggcccggcagtcgaggctagttagaagttttattacgccgttggtttacagtaccgaacggtaaaaccgacgggaaaacctacccccttaaactcctaggacttacctacggtcctacgtacctacgttacccttacgtttacgaccgtaacggtcggggtttacccggggtttacccgtacgtttacggggttacacgggtaccgggtaaccgagggtaaccgggtacgttacggtaggggtaaacctaaggttacctttaccacgtttaccctaccgtaacctacgttaccgacgaccgaaccggtcctacggaccgtacgtaccgttagaaacggttgttacggtaccgtaacttaactttacgttaccaggttaacacggtacgtaaccgtttaacggttaacccttacccgtttaccgtaacgtttaccggttaaccggaaccgggtaacgggacgtaacggggttagaacgtacgttaaacccggaaaggttcccgtagggtcgaccgtcgtacccacgtttccgactttcgttacgtccgttaccccg

SEQ ID NO: 290948 - DNA, 838 bp, Homo sapiens
  misc_feature: GYAE6OF02JZ5FJ.48.22.B11.1.454.CMB.1.raw
tcagagtatacatacacgaccggtgctcgatttagacgacagctcaggggaggtcccagtcaggacacagcatggacatgagggtccccgctcagctcctggggctcctgctgctctggcctcccaggtgccagatgtgccatccagttcgacccagtctcctattccttccctgtctgctatcgtggtagagacagacgtctccataccacgttcggcccgggacctaggtcgagggtctagttaacggtaagttttatttacggcccgtttaggtttaccacgtaccgaaacggaaaaccggtaacggggaaaccgtaccccccttaaaacgtcccgtagtaccttaccgtaccgcgtacgtacctaccttacccgttaacgtttcgacctaaccggtacggggttcccggggttacccgttacggttaacggttccgacggtcggacgtacgggacggtagtccggtacgggactaacggttactttacccgtaccttaccctaccgtaacccgttacgtacccggagtacccgtaaccgcccggttacggaaccctaccggtaacgtacggtaaacgttacgttacggttaaccgtaacgtttaaacctttacgtttaacgaccgttaaccgtaaacggtaccgttaaccggttaaaccgttaaacccgttaccccgtttaacccggtttaccgttaccgtttaccgggaaccgggtaaaccgggtaacgttaagggtaccgtaaggtaacctaacgggtaacgtaccggtacggtaaccgtaccgtaccgttacctaaccggttcttacggtcctttaaccgttccttacccg

SEQ ID NO: 290949 - DNA, 825 bp, Homo sapiens
  misc_feature: GYAE6OF02FO4WE.48.22.B11.1.454.CMB.1.raw
  modified_base (90)..(90): a, c, t, g, unknown or other
  misc_feature (90)..(90): n is a, c, g, or t
tcagagtatacatacacgaccggtgctcgatttagacgacagctcaggggagtcccagtcaggacacagcatggacatgagggtccccgntcagctcctggggctcctgctgcctcgtggcttcccaggtgccagatgtcgccatccagttcgaccagtctcctatcttccctgtctgacctagtcttaggtacggagaccgaggtactcctaccaagttccgtaacgttcgggaccccgggtacacggttagaccggggtactaagtttaaaggtaagtttttaacgtttagttccgtttcggtttaccgaggtaacgtaaacgggaaaacccggaagggaaaaccgtaccccctaaaaccgttaccgtaggtaacttccggtacgtcgtcggtactacctaccgttactttccggacgtacgtaggggttccggggttacccttaggttaccggtttacggacggtacccggaggagtacccggggtacgtaccgggttagggaaccgttagttaacctttacctacgttacccgtaccgaactacgttacgacgtaccggtccgtacctaggtaccaccgtacttaacgggacgttagttacgtacgtaactttacctagtttaacgtcttaaccgaatacctacgttacggtaccttaacccgtaacgttacgtttacgtaaccggggtaccggtaacggtaacgtaggtaacggtacgtaaacgtacccggtaaacggttaacgtcggtttaaacgacccggggttctaacgggtaaccttaccggtttacgttactttaacccggttccttaacccggg

SEQ ID NO: 290950 - DNA, 988 bp, Homo sapiens
  misc_feature: GYAE6OF02IP82D.48.22.B11.1.454.CMB.1.raw
tcagagtatacatacacgaccggtgctcgatttagacgacagctcagggggcagtcccagtcaggacacagcatggacatggagggtccccgctcagctccgtggggctcctgctgctctggctcccaggtgccagatgtgccatccgagttcgaccctagtcctaccattccttccctgtctgctatcgtaggtaggacgactaggacgttcctaccgtaatccgtaaccgtttccgggacccgggggtaccctaacgggttaccggtaacgggggtaccttaaaggttttaacgggttaaaggtttttaacggtttttaaaccggtccccggtttttaaggggtttacccaaacggtaaccgtaaaaaccggaaaacccgggtaaacgggggtaaaacccgtaacccccccgttaaaaccgttcccggttaacgtaccttacccggttaaccgtcgtaccgtacctaccgttacccgttacgtttaccgtaaccggaccggtaacggggtttccgggggttacccccgttaggttaacgggttccggaacgggtaccggtacgaaccgggtacgggttacggttaccgggtaagggacgttaacggttaccttacccgtaactcccgtacctaccgtaacgtacggaacgtaccgtaccgtaccgggtaccggtaaacctcgggtaccgttaaaacgacggttacgttaccggttacgtaaccttttaaacgttttacgtaccgtaacgttaactaaacggttccgtttaaaccgtttaacggttaaaacccccgtccccgttaaaccgtttaaccgggttttacccgtttaaccgggggaaacccggttaaaccggggtaaccggttaacgggtacggggaaacgttaacccgaaacgggttaaaccgtttacgggtaacggttcgtaaaccggtcccgaaaccgtttaaccgtacgtccgttttaccgttacctttaccccggg

SEQ ID NO: 290951 - DNA, 813 bp, Homo sapiens
  misc_feature: GYAE6OF02IPHAK.48.22.B11.1.454.CMB.1.raw
  modified_base (802)..(802): a, c, t, g, unknown or other
  misc_feature (802)..(802): n is a, c, g, or t
tcagagtatacatacacgaccggtgctcgatttagacgacagctcagggggagtcccagtcaggacacagcatggacatgagggtccccgctcagctcctggggctcctgctgctctggcctccaggtgccagagtgtgccatccagttcgaccagtcctccattccttccctgtctgctatcgtggtaggacgacgagacgttctacgaatcctacgttcggcccgggtacaggtaccgacgggtactagttaaggtaacgtttacgttacgtccgtttaggtttacgaacgaccgtaaaggaaaccgaacggggtaaaaccccaccccgttaaactccgtaagtacgttccgtacgccgttacgacctacgtacctacgttcgaccgtacggtaccggtcggggttacccttacgtaggtcgacggtccggactaacgggcgtacggacgttacgggacttactaacgttcctacccgtaccgtaccaccgtacgtacgacgtacccgactcccgtacgaaccgtcgtaaccgttaaggtacgtacgttacgtaccttaacggttaaaccttttacggtaaccgtacgtaacctaccggtacgtttaaccgtaacgttaaccccggttaacccttccgttaaccggttttacgacccgggtaaacccgggttacgggtaaaaccgttcggggtaaccgaccggtttaacgaacccggtaaacgttaccgggtcgggttaaccgttccgttaaccggtacccgtaacccctttaggtttcccgtaacccgttttacccgtntaaccccccgg

SEQ ID NO: 290952 - DNA, 795 bp, Homo sapiens
  misc_feature: GYAE6OF02F4BPL.48.22.B11.1.454.CMB.1.raw
  modified_base (190)..(190): a, c, t, g, unknown or other
  misc_feature (190)..(190): n is a, c, g, or t
  modified_base (195)..(195): a, c, t, g, unknown or other
  misc_feature (195)..(195): n is a, c, g, or t
  modified_base (243)..(243): a, c, t, g, unknown or other
  misc_feature (243)..(243): n is a, c, g, or t
tcagagtatacatacacgaccggtgctcgatttagacgacagctcaggggcagtcccagtcaggacacagcatggacatgaggtccccgctcagctcctggggctcctgctgctctggctcccaggtgccagatgtgccatccagttcgacccagtcctccatccttccctgtctgcatctggtacgganacagngtcctccatctacgttcgccgggcagtcgaggctaagttagtaagttntttagccgttggttacagcgaaagaaaccgaacgggaaaccgtaccccctaaactccgtagtactactacggctacgtactactacctacgttacgactacgtacggtccgggttcccgtacgttacggttaccgacggtaccggtacgacgggtccggtaacggttccgtacgggtaacttacgttaactttacccgtaccttaccgtacctaccgtactccgtacgacggtaccgtccgtagggacccttacggtacgttaacggaacgttaaccgttcgggttaacctaaaccgtttaccgtttaagtttacccgttaacgtaaccgtaaaccgttacgttaaccgtttaaacccgggttaacccttaccccggttaacccgtttaaccgtttaaccggtttacccgggtaaacccgggtaaccggggttaacccggaagggttacggtaacggtaaccggtaaaacggtaacccggttacggtaccggttaccgtaaccggtacctacggttaccccgtagttcccgtttacgtaccgttttaacccg

SEQ ID NO: 290953 - DNA, 890 bp, Homo sapiens
  misc_feature: GYAE6OF02I7V9F.48.22.B11.1.454.CMB.1.raw
  modified_base (197)..(197): a, c, t, g, unknown or other
  misc_feature (197)..(197): n is a, c, g, or t
tcagagtatacatacacgaccggtgctcgatttagacgacagctcaggggagtcccagtcaggacacagcatggacatgagggtccccgctcagctcctggggctcctgctgctctggctccaggtgccagatgtgccatccagttgacccagtctccatcttccctgtctgctatcgtgtacggagacagacgtcnccatccacttcgaccggccagtcgaggcaattagaagttattacgactggtttacagacaagtaaaccaggtaaacgacccctaaactccgtacgaacttcgtaaccgtctcggactaacgtcctaacttttcgaccaacgtacgggttccggggtaccccgttacgttaacggtttaccgaacggtccgggtaacctaacgggacggggtacctttaccgggtacgggggtaacctaaacggggtaatttttaccccgaaacccgtttacccgtaacccgttaaaccccgtacgttacccgtaaacggtaccccgtaaacggtccccgttaaccggaaccctaacgggtaccccgttaacggtaaaaccggtaacggttacgggttttaaccgaaccgttaaaaacgtttttaccgtttaaaaccgttcggttaaacccgttaaaaccgtaccggttaacgttttaaaaccgggttaaccgttaaaaccccgttacccggtttaaacgtttaacccgtttttacggggaacccggttaaaccgggggtaaaccgtaaacggggttaccgggtaacgttaaccgtaaaccggtaaaaacggtaaaccggtttacgggtacggttaccggttaaccgtacccggttaaacccgtacgtttacccggttacgtttacccgttacgttaaccccgg

SEQ ID NO: 290954 - DNA, 701 bp, Homo sapiens
  misc_feature: GYAE6OF02IT26I.48.22.B11.1.454.CMB.1.raw
  modified_base (188)..(188): a, c, t, g, unknown or other
  misc_feature (188)..(188): n is a, c, g, or t
  modified_base (200)..(200): a, c, t, g, unknown or other
  misc_feature (200)..(200): n is a, c, g, or t
  modified_base (479)..(479): a, c, t, g, unknown or other
  misc_feature (479)..(479): n is a, c, g, or t
  modified_base (497)..(497): a, c, t, g, unknown or other
  misc_feature (497)..(497): n is a, c, g, or t
  modified_base (661)..(661): a, c, t, g, unknown or other
  misc_feature (661)..(661): n is a, c, g, or t
tcagagtatacatacacgaccggtgctcgatttagacgacagctcaggggcagtcccagtcaggacacagcatggacatgagggtccccgctcagctccgtggggctcctgctgctctggctcccaggtcgccagatgtcgccatccgtagttcgaccctagtcctccattccttccctgtctagctntcgtggtagganacgacgtacgtcctccatctacgttcggccgggactagtccgagggtactagttaggtaacgtttacgttacgtccgttggtttacagtacgaagaaaaccggacgggtaaacctcccttaaacgttccgagtactactacgtccgactaacctcttaccgtacgttcgaacgtaccggtacgggttccgggttccccttagtacgttcggacggcgtacgtacgggtacgtcgtaccggtggtacacggttactttccgaacgtcctaacaccgttcncgagtccgacgttaccgntaccgacgtcgaacgtaagtgttacgtacgtacttaacttacgtacgtcgactagtaacgtcgttaaccgtaccgttaacccgtcgttaacgtcggttaccgaacggtaacgggaacgtacggtacgtaagtaacccgtaacgtaaccggtcgtacggttacgngtaaccgccgtacctaacggttcgttaaccttcgttaacc

SEQ ID NO: 290955 - DNA, 130 bp, Homo sapiens
  misc_feature: GYAE6OF01BVT2M.43.53.E09.1.454.CMB.1.raw
  modified_base (130)..(130): a, c, t, g, unknown or other
  misc_feature (130)..(130): n is a, c, g, or t
tcagtgtgagtagtcacgaccggtgctcgatttagagagagtgtgttgggtttgggcacagcggccctgggctgcctggtcaaggactacttccactactcacactgagcgggctggcaaggcgcatagn

SEQ ID NO: 290956 - DNA, 131 bp, Homo sapiens
  misc_feature: GYAE6OF02G2VD2.43.53.E09.1.454.CMB.1.raw
  modified_base (130)..(131): a, c, t, g, unknown or other
  misc_feature (130)..(131): n is a, c, g, or t
tcagtgtgagtagtcacgaccggtgctcgatttagagagagtgtgttgggtttgggcacagcggccctgggctgcctggtcaaggactacttccactactcacactgagcgggctggcaaggcgcatagnn

SEQ ID NO: 290957 - DNA, 304 bp, Homo sapiens
  misc_feature: GYAE6OF02IF6BM.43.53.E09.1.454.CMB.1.raw
  modified_base (295)..(295): a, c, t, g, unknown or other
  misc_feature (295)..(295): n is a, c, g, or t
  modified_base (301)..(304): a, c, t, g, unknown or other
  misc_feature (301)..(304): n is a, c, g, or t
tcagtgtgagtagtcacgaccggtgctcgatttagagagagtgtgttgggtttgggtcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaaaccccactgtcactctgttccccaccctcctcactactcacactgagcgggctggcaaggccncatagnnnn

SEQ ID NO: 290958 - DNA, 734 bp, Homo sapiens
  misc_feature: GYAE6OF01DLLYO.37.18.B07.1.454.CMB.1.raw
  modified_base (205)..(205): a, c, t, g, unknown or other
  misc_feature (205)..(205): n is a, c, g, or t
  modified_base (268)..(268): a, c, t, g, unknown or other
  misc_feature (268)..(268): n is a, c, g, or t
  modified_base (341)..(341): a, c, t, g, unknown or other
  misc_feature (341)..(341): n is a, c, g, or t
  modified_base (392)..(392): a, c, t, g, unknown or other
  misc_feature (392)..(392): n is a, c, g, or t
tcagtagtgtagatcacgaccggtgctcgatttagtcgctgcgtaaactgggttttccttgttgctattttggaaggtgtccagtgtgaggtgcaattggtggagtcgtgggggaggcctcgtccagccgtggggggtccctgagactctcctgtgtagcctctgaactttccccctttacggcttattggatgagctgggtccnccaggcctccgaggggagggctgggagtgggtctcgaggtattactggtagtggtaataccgnatactacgcagactccgtgaccgggtccgttcacccgtctccgagacgacaattccaaagaataccggtctancgtaggaaatgaacagcctgagacgccgaagacaccggcctctaattacgngtgcgagagactcgaaggacggagtaagtacgacagcacgcctcgtcgtaaccgtacggtcggggacccgaaccgggtaacccgttcggtacccgtacccgttccgtccctaccgtaccgtcccctacccgaacccgaaccgggcccctaaccggttcccggttcccccgtttccccccgtaccggtcccctacccccttccccgtaacccgaaaccggaccgtacccgtacccggttaccgggtccgggggtaccaacccggaccgggccccgggtaccccggttcggggtcccgtaccggacccggtttaccggggtaaccgtaaaccgggttaaccccg

SEQ ID NO: 290959 - DNA, 814 bp, Homo sapiens
  misc_feature: GYAE6OF01D2CHV.37.18.B07.1.454.CMB.1.raw
  modified_base (162)..(162): a, c, t, g, unknown or other
  misc_feature (162)..(162): n is a, c, g, or t
  modified_base (205)..(205): a, c, t, g, unknown or other
  misc_feature (205)..(205): n is a, c, g, or t
  modified_base (232)..(232): a, c, t, g, unknown or other
  misc_feature (232)..(232): n is a, c, g, or t
  modified_base (239)..(239): a, c, t, g, unknown or other
  misc_feature (239)..(239): n is a, c, g, or t
  modified_base (449)..(449): a, c, t, g, unknown or other
  misc_feature (449)..(449): n is a, c, g, or t
tcagtagtgtagatcacgaccggtgctcgatttagtcgctgcgtaaactgggttttccttgttgctattttggaaggtgtccagtgtgaggtgcaattggtggagtctgggggaggcctcgtccagccgtggggggtccctgagactctcctgtgtagcctntgtaactttcccctttacggctttattggatgagctgggtccncaggctcgagggagggctggagtgggngccaaanataaagcaaagatagggaagtaaagaaggagtagtggtggacttcgtgtaggaacgggtccgttttcaccgtatcctaccgaagacgaacaaaccgaccgtaaacgtaaccgttccggtcgactactcgttagaaccaaaagttcgaaaccgagttcgtaggaaggaccggacccggaagaccgtacggtactttaattttacgttacgnggacgacggaaggaggtaacgggtacggtacggggttccggttttaacgaccggttaaccgggtacgggggaccccgtaaacgggggttacccccgtagggttaccccgtaacccggttcccttacccgttaccgacccgttaccccgttaacccccggaaacccggtaacccggggtaccctaacccgtttccccgggtttaccccttcccccccggtcggggccccgttccccgtccgtccgttacccggaacggtacgcccgtaacccgtccggaacggccacgacccggacggtcccggcccgggtgggccgtcgcccgggttacggaaccgtaacggtaccctttacccgttccgtaacc

SEQ ID NO: 290960 - DNA, 672 bp, Homo sapiens
  misc_feature: GYAE6OF02FJPG7.37.18.B07.1.454.CMB.1.raw
  modified_base (261)..(261): a, c, t, g, unknown or other
  misc_feature (261)..(261): n is a, c, g, or t
  modified_base (275)..(275): a, c, t, g, unknown or other
  misc_feature (275)..(275): n is a, c, g, or t
  modified_base (330)..(330): a, c, t, g, unknown or other
  misc_feature (330)..(330): n is a, c, g, or t
  modified_base (354)..(354): a, c, t, g, unknown or other
  misc_feature (354)..(354): n is a, c, g, or t
  modified_base (412)..(412): a, c, t, g, unknown or other
  misc_feature (412)..(412): n is a, c, g, or t
tcagtagtgtagatcacgaccggtgctcgatttagtcgctgcgtaaactgggttttccttgttgctattttggaaggtgtccagtgtgaggtgcaattggtggagtctgggggaggcctcgtccagcctgggggggtccctgagactctcctgtgcagcctctggttcatcttagcaactacgccatgagctgggtccgccaggctccgagggaaggggctggagtgggtctcagggtattactggtagtggtaataccgnaatactacgcagcnccgtgacgggccggttcaccgtctaccagagaacattccaagaatacggctatcnggaaaatgaacagcctagagtacncgaggaccacggccctctatttacgtggtgacgagagtaactcgaagacggtagtaanagtcagctagctacgtgtacgtacgtcggggaccaaccggaacccgttcggacccgtaccgttacctcccgtacctacgccctaacccgacccgaaccggggtacccacggttcccggttcccttcccccgtccggcccgttacccccgttccctacccgaacgtaaccgacccgtaccggttccggtccgggggacccaaccggtaccgggacccggccccgggttcgggacccggttccggtaccccgttaaccgggg

SEQ ID NO: 290961 - DNA, 365 bp, Homo sapiens
  misc_feature: GYAE6OF01BA3AL.13.6.A06.1.454.CMB.1.raw
  modified_base (358)..(365): a, c, t, g, unknown or other
  misc_feature (358)..(365): n is a, c, g, or t
tcagtcacgtactacacgaccggtgctcgatttagatctactgacaggggttccagggcagactcacgattaccgcggacagatccacgagcacagtgtacatggagctgagccgcctgacatctgaagacacggccgtgtattactgtgcgagagatggggcccacgaacgttactacgctatggacgtctggggccaagggaccacggtcaccgtctcctcagcctccaccaagggcccatcggtcttcccctggcgccctgctccaggagcacctccgagagcacagcggccctgggctgcctggtcaaggctacttcctagtacgtgactgagcgggctggcaaggcgcatagnnnnnnnn

SEQ ID NO: 290962 - DNA, 388 bp, Homo sapiens
  misc_feature: GYAE6OF01BGK8Q.13.6.A06.1.454.CMB.1.raw
  modified_base (383)..(388): a, c, t, g, unknown or other
  misc_feature (383)..(388): n is a, c, g, or t
tcagtcacgtactacacgaccggtgctcgatttagatctactgacaggggttccagggcagactcacgattaccgcggacagatccacgagcacagtgtacatggagctgagccgcctgacatctgaagacacggccgtgtattactgtgcgagagatcggggactataccggggcgatattcgcgacctggacttctacttctacatggacgtctggggcaaagggaccacggtcaccgtctcctcagcctccaccaagggcccatcggtcttcccctggcgccctgctccaggagcacctccgagagcacagcggccctgggctgcctggtcaaggactacttcctagtacgtgactgagcgggctggcaaggcgcatagnnnnnn

SEQ ID NO: 290963 - DNA, 556 bp, Homo sapiens
  misc_feature: GYAE6OF01DPLH3.13.6.A06.1.454.CMB.1.raw
  modified_base (302)..(302): a, c, t, g, unknown or other
  misc_feature (302)..(302): n is a, c, g, or t
  modified_base (307)..(307): a, c, t, g, unknown or other
  misc_feature (307)..(307): n is a, c, g, or t
  modified_base (550)..(550): a, c, t, g, unknown or other
  misc_feature (550)..(550): n is a, c, g, or t
tcagtcacgtactacacgaccggtgctcgatttagatctactgacaacacgacaagggggaggaactgctcagttaggacccagacggaacctatggaagccccagcgcagcttctcttcctcctgctactctggctcccagatactactggagaaatagtgtctgacgcagtctccagtcaccctgtctgtgtctccaggggaatagcaaccctcgtcctgcagggccagtcgagagtgtagcagcagcttagcctggtaccagcagtaagcctggccaggctcccaggctcctcatttanggtcncatccgacgtagggcccacgtgggtcgtcccaggtctagggttcaagggccggactaggtgggtctggggacacggtacttcgactcgtcacctactcacgcacgccctgactagtctagaagtctttgctagttctattactgtacagactagtattagttactggagtaacccgtcgaccgaacggtacacggtacgtaggaagtaagttaaacggactaggtcggactacggactaccgngtaccg

SEQ ID NO: 290964 - DNA, 551 bp, Homo sapiens
  misc_feature: GYAE6OF01DFHZV.13.6.A06.1.454.CMB.1.raw
  modified_base (298)..(298): a, c, t, g, unknown or other
  misc_feature (298)..(298): n is a, c, g, or t
  modified_base (369)..(369): a, c, t, g, unknown or other
  misc_feature (369)..(369): n is a, c, g, or t
tcagtcacgtactacacgaccggtgctcgatttagatctactgacaggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtgttataactatgtctctggtaccaacaacaccaggacaaacgcccccaaaatcatagatttangatgtacagtaagcggccctcgacggggtcctgactcgcttctctgcctcagtctggcaacacggcctccngaccatctcgtcggctccgaggctagagatgagtctagtattattctgtctgctactatagtgcgagcacgtctaacctacgtcgttactacggttccgggacgggtaaccgggaaccgtaacggtaccgttaccggtaacccggttaccgtacgggtaaccaccgggacccgtaaaccggg

SEQ ID NO: 290965 - DNA, 513 bp, Homo sapiens
  misc_feature: GYAE6OF01DEJSQ.13.6.A06.1.454.CMB.1.raw
  modified_base (195)..(195): a, c, t, g, unknown or other
  misc_feature (195)..(195): n is a, c, g, or t
  modified_base (237)..(237): a, c, t, g, unknown or other
  misc_feature (237)..(237): n is a, c, g, or t
  modified_base (270)..(270): a, c, t, g, unknown or other
  misc_feature (270)..(270): n is a, c, g, or t
tcagtcacgtactacacgaccggtgctcgatttagatctactgacagggcagactgagcccaggatcctgggctctgctcctcctcagcctcctcactcagggcacaggatcctgggctcagtctgccctgactcagcctcgctcagtgtccgggtctcctggacagtcagtcaccatctcctgcactggaaccngcagtgatgttggtggttataactatgtctcctggtaccaanaacaccaggcaaagccccaaaatcatgatttangatgtcagtaagccggcctcgacggggtccctgatcgtcttctctcgcctcaagtctggcaacacggcctcctgacctatctcgtgggcctccgaggctaggagatgagtctgtattattactgctgctcatatgcaggcagtctacactgtactgttcgggcgggaaggaccaagcctacggacccgttcgtaggtcacggacccgaaggcctccgaccccctggtcctcttccgttcccgg

SEQ ID NO: 290966 - DNA, 759 bp, Homo sapiens
  misc_feature: GYAE6OF01DFJDL.13.6.A06.1.454.CMB.1.raw
  modified_base (295)..(295): a, c, t, g, unknown or other
  misc_feature (295)..(295): n is a, c, g, or t
tcagtcacgtactacacgaccggtgctcgatttagatctactgacagggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtgttaataactatgtctctagtaccaacaacaccaggcaaacgccccaaaatcatgtattangatgtacaagtaacgccggccctgacggggtccctggactcgtcttcgtctcgtcctccaaggttcctacgggacctaaacccgaccggtcccttacccgtacgaaccctacgttcccgttacgttcgggggaccctacccggtaacgggtcccgtagggaacggggaaccggtacgggtcccgttacgggtacccccgtttaaatttacccggtcggttaccgttccgtacccgtttacgtaaacgttacgttacgggtaccgtttaacggggtttttccttttacccggttgggtttccggggtttccgtttacccgggggtacgggtaaaccgggggttaaccccgtaaaacggggttcccggtaaaccccggtttcccgggttaacgggttacccgaacccgggtacccccgtaaacgggttccccgtaccccggtccccccggttccggggttaccccc

SEQ ID NO: 290967 - DNA, 387 bp, Homo sapiens
  misc_feature: GYAE6OF01B02QX.13.6.A06.1.454.CMB.1.raw
  modified_base (382)..(387): a, c, t, g, unknown or other
  misc_feature (382)..(387): n is a, c, g, or t
tcagtcacgtactacacgaccggtgctcgatttagatctactgacaggggttccagggcagactcacgattaccgcggacagatccacgagcacagtgtacatggagctgagccgcctgacatctgaagacacggccgtgtattactgtgcgagagatcggggactagtaccggggcgatattcgcgacctggacttctacttctacatggacgtctggggcaaagggccacggtcaccgtctcctcagcctccaccaagggcccatcggtcttcccctggccgccctgctccaggacgcacctccgagagcacagcggcctgggctgcctggtcaaggctacttcctagtacgtgactgagcgggctggcaggcgcatagnnnnnn

SEQ ID NO: 290968 - DNA, 1098 bp, Homo sapiens
  misc_feature: GYAE6OF01D9RQ6.13.6.A06.1.454.CMB.1.raw
  modified_base (103)..(103): a, c, t, g, unknown or other
  misc_feature (103)..(103): n is a, c, g, or t
  modified_base (120)..(120): a, c, t, g, unknown or other
  misc_feature (120)..(120): n is a, c, g, or t
  modified_base (124)..(124): a, c, t, g, unknown or other
  misc_feature (124)..(124): n is a, c, g, or t
tcagtcacgtactacacgaccggtgctcgatttagatctactgacagggggggtctcaggaggcagcactctcgggacgtctccaccatggcctgggctcttncctcctctagctcctcnctcnggcgacagagtctcggcgtctacgtcgtcgtcccgtccgtacgtacctacgccgtcgtcctccctactgttcgtcggttcgtcctccggacgacgtcgtactacaccacttcttccctcgcactaggtaaagtaagcgagtgtagttaggttgggtaacgttatagtacccgtttgttccgtcccgtagggttaacccggaaccaaaaccaacccccgaacgggaaccgaaaaacccgaaccccccccctaaaaaccttacgtaacgttttaaacggttttttaaccggggggtaaccaaaatttaaaaaccgggcccgggtccccccgttaccgttaaaggggggttccttttttccgtttacggaaacgttcccggttcccgtttttcctttacccggttcgggggttacccgttaaccccttaaaaaccggtttcggtttaccggggtaaccccaaaaacccggtaaccccgggggttcccccccgttttcccccccttttaaaggggaaaacccgtttaaaaaaccccttttcccgtttccccggtttaccgggggtaaaccctttacccccccgggtaaacgggggccccgggttaaacccgggggtaaaccggggtaaccggggttacctttttacgggtttaaaactttttttttttaacccggttgggtttttaccggtttttaccaacgttaaaggtttcgggtaacccggtaaacggggggtaaaggggtaggttttaacggtttaactttttaaacggtttcgggtttttaaccgtttttacgggggaaaaggggttaccggggttaacccgtaaaaccggttcccgtaacccccgggtttcccgtttttagggtacccggacccgaacccccggtaaaccgggtacccccctaaaaccccccttaacggttgttaccccgtaaacttttcccgttcccggtttaaccccccctaaccccccg

SEQ ID NO: 290969 - DNA, 643 bp, Homo sapiens
  misc_feature: GYAE6OF01D1LG1.13.6.A06.1.454.CMB.1.raw
  modified_base (195)..(195): a, c, t, g, unknown or other
  misc_feature (195)..(195): n is a, c, g, or t
tcagtcacgtactacacgaccggtgctcgatttagatctactgacagggcagactgagcccaggatcctgggctctgctcctcctcagcctcctcactcagggcacaggatcctgggctcagtctgccctgactcagcctcgctcagtgtccgggtctcctggacagtcagtcaccatctcctgcactggaaccngcagtgatgttggtgttataactatgtctcctggtaccaacaacacccaggaccaaacgaccccaaaatcatgtatttatgatgtacagtaacgcggccctcgacgggtcctgactcgtcttctctcgccctacgaacgtcgtacggacaaccgacccggtccctcccgtacgaccctattccgtcgtcgggcctccgaggccgtaggacggtatgtagttctagttaatttacgttacgtcgcgttcgtcctactattacgtgaccgaggcctaagtacccttaacgtacgttagttaaccgttaggttccgggacgggtaaccggtaacccaaggtcccgtaccggtaccccggttaccggttaggtacccgaaccggtaccccgtaacggtccctaccccggtcccccgttacggttacccctacccgttcccgtttccccccgg

SEQ ID NO: 290970 - DNA, 668 bp, Homo sapiens
  misc_feature: GYAE6OF01EBHZD.13.6.A06.1.454.CMB.1.raw
  modified_base (206)..(206): a, c, t, g, unknown or other
  misc_feature (206)..(206): n is a, c, g, or t
  modified_base (293)..(293): a, c, t, g, unknown or other
  misc_feature (293)..(293): n is a, c, g, or t
  modified_base (466)..(466): a, c, t, g, unknown or other
  misc_feature (466)..(466): n is a, c, g, or t
  modified_base (475)..(475): a, c, t, g, unknown or other
  misc_feature (475)..(475): n is a, c, g, or t
  modified_base (507)..(507): a, c, t, g, unknown or other
  misc_feature (507)..(507): n is a, c, g, or t
  modified_base (604)..(604): a, c, t, g, unknown or other
  misc_feature (604)..(604): n is a, c, g, or t
tcagtcacgtactacacgaccggtgctcgatttagatctactgacagggcagactgagcccaggatcctgggctctgctcctcctcagcctcctcactcgagggcacaggatcctgggctcagtctgccctgactcacgcctcgctcgagtcggtccgggtctccgtggacagtcagtccaccatcctcctgcacgtacggaaccngcagtgagttggttggttagttaatactatcgtcctcgtacgtaaccaacaaccaccgagaccaaaccgacccaaatcatgtattangatacgagaaggtacgccggtaccgtcggacgggtcctgacttcgtccttcgtctccgaccgtactacgtcgacgacgaaccgccgtaccctcgtacgactacgtccgtacggtcggtctaccgacggtcgtacggtaggctcggacgtttacgatttaagttacgttaccgngttaccgtntacgtactaagtccgtacgggtacgaacccgnttaaccggaccttaaccgtcgggttaaacgttacgtccggggtaaccggggacgtaaccggaccgtagtccggtacgtacccggttcagggtacccncccggtaccggtacccggtcgtacccccggtacccgtaggtacccctgtttcccccggtaaccc

SEQ ID NO: 290971 - DNA, 606 bp, Homo sapiens
  misc_feature: GYAE6OF01CEQLZ.13.6.A06.1.454.CMB.1.raw
  modified_base (230)..(230): a, c, t, g, unknown or other
  misc_feature (230)..(230): n is a, c, g, or t
  modified_base (315)..(315): a, c, t, g, unknown or other
  misc_feature (315)..(315): n is a, c, g, or t
  modified_base (323)..(323): a, c, t, g, unknown or other
  misc_feature (323)..(323): n is a, c, g, or t
  modified_base (358)..(358): a, c, t, g, unknown or other
  misc_feature (358)..(358): n is a, c, g, or t
tcagtcacgtactacacgaccggtgctcgatttagatctactgacagggggggggtctcaggaggcagcactctcgggacgtctccaccatggcctgggctctgctcctcctcagcctcctcactcagggcacaggatcctgggctcagtctgccctgactcagcctcgctcagttcggtccgggtctccgtggacagtcagtccaccatcctcctgctacgtggaaccngcgaagtgattggttggtagttaataactatgtctccgtacggtaaccaacacaccaggacaacgaccccaaatcatgtatttangatcgtanagtagccgcctggacgggtcctgactcgtctctcnctcctcgagtctcgaccaacgccgtcctccacgtacctagtccgtcgtcggtcctaccgaggtcgtcggacgggacgtacggtcgtacgtaccttagtccgtgtcctcgtctactagtatcggtacgttacggtttccttggttgggttcggttccgttaccgggtcgggtaacggtaccgtaaacggtcggtaccggttcgtacgtaccgacgacccggtagtccccgtaccgtccccgtcggtacc

SEQ ID NO: 290972 - DNA, 409 bp, Homo sapiens
  misc_feature: GYAE6OF01BUOED.13.6.A06.1.454.CMB.1.raw
  modified_base (364)..(364): a, c, t, g, unknown or other
  misc_feature (364)..(364): n is a, c, g, or t
  modified_base (398)..(409): a, c, t, g, unknown or other
  misc_feature (398)..(409): n is a, c, g, or t
tcagtcacgtactacacgaccggtgctcgatttagatctactgacaggggttccagggcagactcacgattaccgcggacagatccacgagcacagtgtacatggagctgagccgcctgacatctgaagacacggccgtgtattactgtgcgagagatcggggactagtaccggggcatattcgcgacctggacttctacttctacatggacgtctggggacaaagggccacggtcaccgtctcctcacgcctccaccaagggcccatcggtcctcccctggccgccctgcctccgaggacgcaccgtccgagacgccacaggccggccctgggctgccgtgtcaaggactactcctagtacgngactggaggcgggctggacaacggcgacgatagnnnnnnnnnnnn

SEQ ID NO: 290973 - DNA, 722 bp, Homo sapiens
  misc_feature: GYAE6OF01CYTE0.13.6.A06.1.454.CMB.1.raw
  modified_base (196)..(196): a, c, t, g, unknown or other
  misc_feature (196)..(196): n is a, c, g, or t
  modified_base (285)..(285): a, c, t, g, unknown or other
  misc_feature (285)..(285): n is a, c, g, or t
tcagtcacgtactacacgaccggtgctcgatttagatctactgacagggcagactgagcccaggatcctgggctctgctcctcctcagcctcctcactcagggcacaggatcctgggctcagtctgccctgactcagcctcgctcagtcgtccggtctcctggacagtcagtcaccatctcctgcactcggaaccngcagtgatggttggtgttataactatcgtctccgtggtaaccaaacaaccacccgaggaccaaacgacccccaaaatcaatgtatttangtatgtacgtaagtacgccggtaccctcgacgggtccctgactcgtacttctcgtcgtccctacgaagttcgtacggtaccaacgacccggtccttaccccgtacggaaccctaacgttcccgtacggttccggggtaccgttacccgaggtccgtaagggacggtagtacggtacgttcgtaaggttacttaacgttaacgtgtccttggtacctagtattacgtagaccgtaggtccgaacgtaccttaacgtaaccgttacggttaccgttaaggttcccggggacgggtaaaccggaacccgtaaacggtccgttaaccggtacccgttaaccgttacgggtaacccgtaaacccggccccgggtaaacggtccgttacccccggtaccccccggttacgggtaccccttcccggttccccgttaacccccgg

SEQ ID NO: 290974 - DNA, 747 bp, Homo sapiens
  misc_feature: GYAE6OF01DJB6E.13.6.A06.1.454.CMB.1.raw
  modified_base (323)..(323): a, c, t, g, unknown or other
  misc_feature (323)..(323): n is a, c, g, or t
  modified_base (471)..(471): a, c, t, g, unknown or other
  misc_feature (471)..(471): n is a, c, g, or t
  modified_base (701)..(701): a, c, t, g, unknown or other
  misc_feature (701)..(701): n is a, c, g, or t
tcagtcacgtactacacgaccggtgctcgatttagatctactgacagggcagactgagcccaggatcctgggctctgcctcctcctcacgcctcctcactcgagggcacaggactccgtggctcagtctcgccctgactcacgcctcgctcagtcggtccggtctcgtggacaggtcagtaccacctatcctccgcgacacgtacggaaccagcaagtgtagttggttaggtagttaaacacgtagtcgttcctacgttacggaaaccaactaaccgaccgaaggaccaaaaaccacccctaaaatcaagttagtaatttagngtattcgtaacgaaaggtaccggtccggtccgtacggtacgggtccctagtacgttccgtacttccgtaccgtactacccttacggacgttcgtacggaacctaacccgggtacccgtccctacccgtagtaaccctacggtttcccncgggttacggacctaccggtaacgggtctaagggtaacggttgacgggttacttacgttagtttaaacgtttaactacggtacgtcgttaccgtaacttacgttaaattcgggaccaacggttagaccgtataacctaaccgtactttacggttaactacgggttaaccgggacggtaaccggaactaacggccgttaacgtaacgtccgtaaggacctacggaacccgnggttccctacccggtcctaacggtcccttacggtcccttaccccgg

SEQ ID NO: 290975 - DNA, 577 bp, Homo sapiens
  misc_feature: GYAE6OF01D1FTJ.13.6.A06.1.454.CMB.1.raw
  modified_base (219)..(219): a, c, t, g, unknown or other
  misc_feature (219)..(219): n is a, c, g, or t
tcagtcacgtactacacgaccggtgctcgatttagatctactgacaggggggggtctcaggaggcagcactctcgggacgtctccaccatggcctgggctctgctcctcctcaacctcctcactcagggcacaggatcctggctcagtctgccctgactcagcctcgctcagtgtccgggtctccgtggacagtcagtcacatctcctgcactgaaccngcagtgatgttggtgttataactatgtctcctgtaccaacaacaccagacaaacgccccaaaatcatgtatttatgatgtactagtaacgccgtccctcggtacgggtccctgacgtcgtcttctcgtcgccctacacgtctaggactaaccgcgtccctcctgaccctattccgtccgtacgggcctacgacggtctaggaagtgtcgtacgttcgttagtaatttactacgtgtactgtactagacttgcgtacgacgctacgtactactcgttagtaccgttggtaccgggacgggtaacgaccgtacgtccgtacgtacccgtacgtacgacctaacggcccgtaaggtccccg

SEQ ID NO: 290976 - DNA, 830 bp, Homo sapiens
  misc_feature: GYAE6OF01BNUSL.13.6.A06.1.454.CMB.1.raw
  modified_base (194)..(194): a, c, t, g, unknown or other
  misc_feature (194)..(194): n is a, c, g, or t
  modified_base (205)..(205): a, c, t, g, unknown or other
  misc_feature (205)..(205): n is a, c, g, or t
tcagtcacgtactacacgaccggtgctcgatttagatctactgacgaggggggggtctcaggaggcagcactctcgggacgtctccaccatggcctgggctctgctgctcctcactctcctcactcaggacacgagggtcctgggcccagtctgccctgactcagcctgcctccatgtctgggtctcctggacngtcgatcaccntccgtcctgactacgtaggaaactagcgtagtgtagttcggttagggtacttagtctaccgtttgtccgttccgtacggtaacccgaacctaaaccgacccgaacggacctaaacccgacccccctaaacttacttaaacggttttacggtttaaccgggggtaactaaacgttaaccgggcccggtacccgttacgtaccggggtttaccttttacggtacgttaccgttccggttccttccgttcgtaccggtacctacgtaacgtcgtcgaacgtaacccgccgtccctaccgtactaacgtactttccgttccggtacgtacccgtcccggaccgggacccggtagggtaacccgtacgggtttccgtttaaggttttaccgttttaccgtggtttttaccgtactggttacgtaacgtacgggaaagggtacggttaggttacgtttaacgtttacggttagggttttccggttaaaggggtacgggttaacgggtaaccgttaaccggggttccctaaacccgggtttccgttgggtaacccgaccgtacccggtaaccgtaccctaacccgtcgttaccgtacccttacccgttccttcccggttacccctaccccgg

SEQ ID NO: 290977 - DNA, 580 bp, Homo sapiens
  misc_feature: GYAE6OF01CH5BE.13.6.A06.1.454.CMB.1.raw
  modified_base (365)..(365): a, c, t, g, unknown or other
  misc_feature (365)..(365): n is a, c, g, or t
  modified_base (387)..(387): a, c, t, g, unknown or other
  misc_feature (387)..(387): n is a, c, g, or t
  modified_base (414)..(414): a, c, t, g, unknown or other
  misc_feature (414)..(414): n is a, c, g, or t
tcagtcacgtactacacgaccggtgctcgatttagatctactgacagggcagactgagcccaggatcctgggctctgctcctcctcagcctcctcactcagggcacaggatcctgggctcagtctgccctgactcagcctcgctcagtgtccgggtctcctggacagtcagtcaccatctcctgcactggaaccagcagtgattgttggtgttaataactatgtcctctgtaaccaacaacaccaggaccaaacgaccccaaaatcatgtattatgatgtacaagtaacgccggtcctacggacgggtccctagactcgtcttcgtctcgcctacacgtcgagaccaacgcgcctcctagacctntctcgtcggctcgagctagagntgatctagtacttactacgtcgtcgtntctctagtcgtcgacgacgctacgaccttacgacgttacgtactcgggttacggaccgggaaggacccgaacgtccgtaccgtacccgtcggtaacggccgtaaccggacccgtaacggtcccgtccccggtccccgttacgccctaaccgttccgttacccccgg

SEQ ID NO: 290978 - DNA, 654 bp, Homo sapiens
  misc_feature: GYAE6OF01DC1UE.13.6.A06.1.454.CMB.1.raw
  modified_base (446)..(446): a, c, t, g, unknown or other
  misc_feature (446)..(446): n is a, c, g, or t
tcagtcacgtactacacgaccggtgctcgatttagatctactgacagggcagactgagcccaggatcctgggctctgctcctcctcagcctcctcactcagggcacaggatcctggctcagtctgccctgactcagcctcgctcagtgtccgggtctcctggacagtcagtcacatctcctgcactggaccagcagtgatggttggtgttataacgtatcgtctcctagtaccaaacaacaccaaggaccaaaacgacccccaaaaatccaatacgtaatttatagattgtacgtaagtaacgccgtacccgtcgacgggtccctgactcgtacttctcgtacgtcctaccgaagtcgtacgacaaccgacggccctaccgtcgacctactcgtcgcggtcctccgaggtctaggagtatagactacgttagtatttaacttacgngtcgtgaccttacgagttagtacgaccgtagacgaacgtccttaacgtacgtacgttaacgttcgttacccggggacggtaaccgggtaacccgtaaggccgtaccggtaacccggtaccggtaacggtacccgaaccggaaccccgtacggtacccccttcccggtaaccccccgtggtaaccccgtccgtttcccgttaacccccg

SEQ ID NO: 290979 - DNA, 861 bp, Homo sapiens
  misc_feature: GYAE6OF01DB3W8.13.6.A06.1.454.CMB.1.raw
tcagtcacgtactacacgaccggtgctcgatttagatctactgacagggcagactgagcccaggatcctgggctctgctcctcctcagcctcctcactcagggcacaggatcctggctcagtctgccctgactcagcctcgctcagtcgtccggtctccgtggacagtcagtccaccgattcctcctgactacgtcgggaaccagctagtcgtaatttcgggttaggttaggtttaactaaccgttatcggttcctccgttaacggtaacccaaactaaccgaacccgaacggaaccgaaaaccgtaacccccaaaaatttccaagttacggttaactttaagtacggtacttacggtacgtaacggtaacggtcccgggtccccgttacggtaccggggtaccctgggtaacttccgtccgtttccgtccgttaccgtaccgtacccgtaaacggtttccgtacgggtaacccaaaccggtaccccgggtacccctttacccggtaacggtaaccccttacgttcccggttccggtttaccgggaacccgtttcccggaagggttacccggttagggaaaccggttacgtttaacggaccgttttacggttaacggtttaaacttttaaccggtttaccgttacggtaccgttcgttacgttaccgtaactttacggacgttaacgccgtaagtaacctaccgttaaccgtacgttacggtttaaccggtcgttaaccggggacgggacccggtaaaccaccggttcgtaccggttacccgttaccggtaggtaccccgaacggtacccgacggtcccgtcccgtacccgttacggtaacctcccgttccggttaccccg

SEQ ID NO: 290980 - DNA, 864 bp, Homo sapiens
  misc_feature: GYAE6OF01B1MCK.13.6.A06.1.454.CMB.1.raw
tcagtcacgtactacacgaccggtgctcgatttagatctactgacaacacacgaaggggggaggaactgctcagttaggacccagacggaaccatggaacgccccagcgcagcttctcttcctctgctactgtcggctcccagactactacgtaggaagaaatagtgacgtaggacgacgtagtcctccacgtccacctgttctgtactccgtacggaaggggtaaatacgtacctaacccttcgtccctggaccgacgggacctagtaccgtaagtaggttacgttacgacgacgtacgaacggttcttacggtaccgtacggtaaccgaacgaccggtaacgaccggtaccggtaccggtaccgaaccgggttacccctaccccggacgggttaccccgtacctttaacgtttacgtttacgtaccgggtactaaccgttaaccgttaccggtaccggtaaccgggtacccgtaacgggttccggttacccggtaccgttacggttaccggtacggtttacgggacgggtcggtacggtacgggttcgggtaccggtacgggactaacggttttacctacgtaacccgtttacgtacaaccgttgtaaccgacgtacgacgttcccgtagtactacggtacgtacggtacgttacgttacgacttagtacgtttacgtaacgttcgtaacgtacgttacgttaagttacggtaagttaccgtacgggtaaccgtaaccggtacggtaaacgggtaacccgtaacggtacgtacggttaaagggtaaacggttttaaacgggaaaaccgtttaggtacggtccgggtaacgttaaccgaaccggttaacttaccgggttaacg

SEQ ID NO: 290981 - DNA, 720 bp, Homo sapiens
  misc_feature: GYAE6OF01BSN9P.13.6.A06.1.454.CMB.1.raw
  modified_base (216)..(216): a, c, t, g, unknown or other
  misc_feature (216)..(216): n is a, c, g, or t
  modified_base (266)..(266): a, c, t, g, unknown or other
  misc_feature (266)..(266): n is a, c, g, or t
  modified_base (367)..(367): a, c, t, g, unknown or other
  misc_feature (367)..(367): n is a, c, g, or t
  modified_base (570)..(570): a, c, t, g, unknown or other
  misc_feature (570)..(570): n is a, c, g, or t
  modified_base (678)..(678): a, c, t, g, unknown or other
  misc_feature (678)..(678): n is a, c, g, or t
tcagtcacgtactacacgaccggtgctcgatttagatctactgacagggggggggtctcagggaggcagcactctcgggacgtctccaccatggcctgggctctgctcctcctcacgccctcctcactcagggcacaggtactccgtgggctcagtctcgccctgactcagcctcgctcagtcgtccgggtctccgtggactcgtcacgtccaccnttctcctgactacgtaggaaatcgcgtagtgtagttcggttcggaacttntcgtacttcgtctccgtagtacccgactaaccacccgaggtacccaaccgacccctaatctacgtttacgttacgggtacaacggtaccgtccgtcccgtntacgggtctttgtacgtactcgtacttctcgtaccggtcctacgtaactcgtacgacctaccgccgtcctacctacggtacacttcgacgttcggaccctaccggagggtaccggtaggacccggtaggtccttagtttacttttcgtggtttcgaacctagttacggtaggacctaaggggtacgtattacgttaacgtttntccggtttacggttaacggtaagggtaccggttaacccgacgggttacccgttaccgttcggttaccggaccgtaaccggaccccggtaaaccgaccccctaaaccgngttaaccgacccttacgttaccccggttcgtaccccccgttc

SEQ ID NO: 290982 - DNA, 681 bp, Homo sapiens
  misc_feature: GYAE6OF01BONQB.13.6.A06.1.454.CMB.1.raw
  modified_base (205)..(205): a, c, t, g, unknown or other
  misc_feature (205)..(205): n is a, c, g, or t
  modified_base (536)..(536): a, c, t, g, unknown or other
  misc_feature (536)..(536): n is a, c, g, or t
  modified_base (572)..(572): a, c, t, g, unknown or other
  misc_feature (572)..(572): n is a, c, g, or t
  modified_base (581)..(581): a, c, t, g, unknown or other
  misc_feature (581)..(581): n is a, c, g, or t
  modified_base (587)..(587): a, c, t, g, unknown or other
  misc_feature (587)..(587): n is a, c, g, or t
  modified_base (611)..(611): a, c, t, g, unknown or other
  misc_feature (611)..(611): n is a, c, g, or t
  modified_base (613)..(613): a, c, t, g, unknown or other
  misc_feature (613)..(613): n is a, c, g, or t
  modified_base (622)..(622): a, c, t, g, unknown or other
  misc_feature (622)..(622): n is a, c, g, or t
tcagtcacgtactacacgaccggtgctcgatttagatctactgacgaggggggggtctcgaggaggcagcactctcgggacgtctccaccatggcctggctctgctcctcctcagcctctcactcaggcacgaggatccgtggtctacgagtctcgcccgtgactcacgtcctcgctacgaggtcgtccggtcctcgtacggacngtacagtccactactcctctgacctacgtacgaaccgcgacgtaacgtgtacttggttacggttagttaactaacgtactcggttccgttaccgtaccgtaaccaaaccgtaaccgtaccgaacggaaccgtaaaccgtaaccccctaaaatacctaagtttacgtaagtttactagtacgtacgttaacgaacggtacgacccgtccgtacggtaccggtacccgtcgtaccgtccgttaccgttctaccgtcgccgtacgtacgtacgtcggaacccgtaccgtaccgtcctccgtaacgtctacttccgtccggacggtctacccggngtaaccgtgaggtacgtcgtagtcgttagtacttgngtcggtctntacgtnacgtgccgagtcgatactaccgtntntacgttcgnggccgtagacgtcgtaccgtacgtaccgtaccggttacgccgaaacgtcgcgtacccgg

SEQ ID NO: 290983 - DNA, 904 bp, Homo sapiens
  misc_feature: GYAE6OF01AXXYU.13.6.A06.1.454.CMB.1.raw
  modified_base (121)..(121): a, c, t, g, unknown or other
  misc_feature (121)..(121): n is a, c, g, or t
tcagtcacgtactacacgaccggtgctcgatttagatctactgacgaggggggggtctcaggaggcagcactctcgggacgtctccaccatggcctgggctctgctcctctcacgccctcncactcgagggccacgaggacgtccgtgggtctcagtcctcgtcccgtgacctcgacgtcctcgcgtacgtacggtcggttcccggtcgtccgtacggaccgtagtccgaacgtacgaaccgtccttccgtccgtacgtccgtaacggtaccggaaccgtacgtacccgtaggtacggttaccggttggtttagggttacggtttaaacttacgttacggttaccggtttccgtaccggttaaccggttaaaacccaaacccgaaacccggtaccccgtaaaggggaaaccccaaaccccggttaaacccctaaacgtccggtaaccgtttaagggttaacttttaacgacggttactaaccggtacgtaaacgggtcccgggtccccttaccgggtaccgggttacggttacccggcgttaccgtaccgtccgtttccgcggttaacccgtctaaccgggtaaccgtccgtaaaccggaccgttacccggtaaccggttccctacccgggttaaccgtccgttacgttacccggtccgtttacccggggtaccgtacgggttacccggtacggttacggtaacgtcgtaacgggttgttaccgttacgtactttaccgtcgtacgccgttcgtaccgtactacgtacgtacgcggttaactcgtaccgttaatcccgtaacggttacggtaccggtaccggggttaccgggaccgaacggttccgttaaccgggcccttaaccgggtccggttaccggccgtaaccggtcggtacccggtacc

SEQ ID NO: 290984 - DNA, 482 bp, Homo sapiens
  misc_feature: GYAE6OF02G09AM.13.6.A06.1.454.CMB.1.raw
  modified_base (343)..(343): a, c, t, g, unknown or other
  misc_feature (343)..(343): n is a, c, g, or t
tcagtcacgtactacacgaccggtgctcgatttagatctactgacagggcagactgagcccaggatcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacaacacccaggcaaagcccccaaaatcatgatttatgatgtcagtaagcggccctcaggggtccctgatcgcttctctgcctccaagtctggcaacacggcctcccngaccatctctggctccaggctgagatgagtctgattattactgctgctcatatgcaggcagctacactgtactgttcggcggaggaccaagctgaccgtcgtaggcagcccaaggctcgcccctcggtcacgtctcccg

SEQ ID NO: 290985 - DNA, 485 bp, Homo sapiens
  misc_feature: GYAE6OF02FHZ9B.13.6.A06.1.454.CMB.1.raw
tcagtcacgtactacacgaccggtgctcgatttagatctactgacagggcagactgagcccaggatcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacaacacccaggcaaagccccaaaatcatgatttatgatgtcagtaagcggccctcagggtccctgatcgcttctctgcctccaagtctggcaacacggcctccctgaccatctctgggctccaggctgaggatgagtctgattattactgctgctcatatgcaggcagctacactgtactagttcggcggaggaccaagctgaccgtctaggtccagcccaaggcctcggccccctggtccactctccg

SEQ ID NO: 290986 - DNA, 486 bp, Homo sapiens
  misc_feature: GYAE6OF02IZH8V.13.6.A06.1.454.CMB.1.raw
  modified_base (296)..(296): a, c, t, g, unknown or other
  misc_feature (296)..(296): n is a, c, g, or t
tcagtcacgtactacacgaccggtgctcgatttagatctactgacagggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtgttataactatgtctcctggtaccaacaacacccaggcaaagcccccaaaatcatgatttangatgtcagtaagcgcctcaggggtccctgatcgcttctctgcctccaagtctggcaacacggcctccctgaccatcctctgggctccgaggctgaggtatgagtctgattattactgctgctcatatgcagcagctacactgtactagtcggacggaggaccagcctgacccgtcaggtcacgcccaagg

SEQ ID NO: 290987 - DNA, 486 bp, Homo sapiens
  misc_feature: GYAE6OF02F8ZX0.13.6.A06.1.454.CMB.1.raw
  modified_base (434)..(434): a, c, t, g, unknown or other
  misc_feature (434)..(434): n is a, c, g, or t
tcagtcacgtactacacgaccggtgctcgatttagatctactgacaggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacaacacccaggcaaagcccccaaaatcatgatttatgatgtcagtaagcggccctcaggggtccctgatcgcttctctgcctcaagtctggcaacacggcctccctgaccatctctgggctccaggctgaggatgagtctgattattactgctgctcatatgcaggcagctacnctgtactagttcggcggaggaccaagctgaccgtcctaggtcagcccaacgg

SEQ ID NO: 290988 - DNA, 513 bp, Homo sapiens
  misc_feature: GYAE6OF02H31X8.13.6.A06.1.454.CMB.1.raw
  modified_base (220)..(220): a, c, t, g, unknown or other
  misc_feature (220)..(220): n is a, c, g, or t
  modified_base (363)..(363): a, c, t, g, unknown or other
  misc_feature (363)..(363): n is a, c, g, or t
  modified_base (378)..(378): a, c, t, g, unknown or other
  misc_feature (378)..(378): n is a, c, g, or t
  modified_base (389)..(389): a, c, t, g, unknown or other
  misc_feature (389)..(389): n is a, c, g, or t
  modified_base (409)..(409): a, c, t, g, unknown or other
  misc_feature (409)..(409): n is a, c, g, or t
tcagtcacgtactacacgaccggtgctcgatttagatctactgacaggggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcgatcaccatctcctgcactggaaacngcagtgatctggacttatagacttgtctcctggtaccaacaccacccaggcaacggcccccagacgtcatctatttagtggggacaagtaggcgccgtgaggtattccactcgcttctctgctcaagtctgcacacgcctccngacatctctgtctcngctgacgacgngctcgctatactgctgcctnatatcgtcgtacgtttcttcgttggtcgttcgttcggcgggtacggtactaggtcgaccgttcgtacgtcacgccgacggcctccggtcccgtcggtcctaccg

SEQ ID NO: 290989 - DNA, 571 bp, Homo sapiens
  misc_feature: GYAE6OF02HT6DG.13.6.A06.1.454.CMB.1.raw
  modified_base (286)..(286): a, c, t, g, unknown or other
  misc_feature (286)..(286): n is a, c, g, or t
  modified_base (324)..(324): a, c, t, g, unknown or other
  misc_feature (324)..(324): n is a, c, g, or t
  modified_base (367)..(367): a, c, t, g, unknown or other
  misc_feature (367)..(367): n is a, c, g, or t
tcagtcacgtactacacgaccggtgctcgatttagatctactgacagggtctccgaaggcttcaccagtcctgtcccaggtgcagctgcgggagtcgggcccaggactggtgaagccttcggagaccctgtccctcacctgcactgtctctggtggctccatcagtagttactactggagctggatccggcacgcccccagggaagggactggagtggattgggcatatctttacagtgggagcaccaactacaacccctcctacaagacgtcgagtcaaccatancaagtggacacgtacaaagaaccagttcctcccagaanctagacgctctgtgaccgctggcggacacggccgtgtattacngtgcgagctggggttcagggttcttgactacgtgggccagggaaccctggtcacgtctctcagtcctcaaccgtaggccacgtcggtcctttccccgcggccacccctcctccaacgacgcctaccgtcgtggggaccacgacgtccggccgtcgggctcgccgtacggcgaacggtctaccttaccgtaaggtccgtgtaacg

SEQ ID NO: 290990 - DNA, 513 bp, Homo sapiens
  misc_feature: GYAE6OF02FXGAM.13.6.A06.1.454.CMB.1.raw
tcagtcacgtactacacgaccggtgctcgatttagatctactgacagggcagactgagcccaggatcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacaacaccaggcaaacgccccaaaatcatgatttatgatgtcagtaagcgcctcgagggtccctgatcgcttctctgcctcaagtctgcaacacggcctccctgaccatctctcgggctccgagctgagtatgagtctgtattattactgcttgctcatatgcaggcagacctacacttgttacttagttcgggacggagggaccaagctacgacccggttccgtaggtccgaacgcccgaaggcctccgcccccgtcggtcctaccgtccgttcccg

SEQ ID NO: 290991 - DNA, 518 bp, Homo sapiens
  misc_feature: GYAE6OF02JHKS1.13.6.A06.1.454.CMB.1.raw
  modified_base (273)..(273): a, c, t, g, unknown or other
  misc_feature (273)..(273): n is a, c, g, or t
  modified_base (339)..(339): a, c, t, g, unknown or other
  misc_feature (339)..(339): n is a, c, g, or t
  modified_base (407)..(407): a, c, t, g, unknown or other
  misc_feature (407)..(407): n is a, c, g, or t
tcagtcacgtactacacgaccggtgctcgatttagatctactgacagggcagactgagcccaggatcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacaacacccaggcaaagcccccaaaatccatgatttangatgtcaagtaagcggccctcgacggggtccctgactcgcttctctcgcctccaagtctggcaacncggcctccctgaccatctcgtgggctccgaggctgaggatgagtctgattattactgctgctcattangtacaggcagcctactactgtacttagttcggcggaacgggaccagctacggaccggtcctaggtccacgcccgaaggcctccgcccccgtcggtacctacctccttcccg

SEQ ID NO: 290992 - DNA, 522 bp, Homo sapiens
  misc_feature: GYAE6OF02G4FV3.13.6.A06.1.454.CMB.1.raw
  modified_base (299)..(299): a, c, t, g, unknown or other
  misc_feature (299)..(299): n is a, c, g, or t
  modified_base (377)..(377): a, c, t, g, unknown or other
  misc_feature (377)..(377): n is a, c, g, or t
tcagtcacgtactacacgaccggtgctcgatttagatctactgacaggggggggtctcaggaagcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacaacacccaggcaaacgcccccaaaatcatgatttangatgtcagtaagcggccctcgacggggtccctggatcgtcttctctcgcctcaagtctggcacacgcctccctgaccntctcgtcgggcctccgaggctggaggactggagttctgtactttattactgtcttcgctcatatgcgagccagcctacacttgtactacggttcgggacggaggaaccaagccgtagtacccgtcgtacggtcacgacccaacgg

SEQ ID NO: 290993 - DNA, 593 bp, Homo sapiens
  misc_feature: GYAE6OF02I9NEW.13.6.A06.1.454.CMB.1.raw
  modified_base (221)..(221): a, c, t, g, unknown or other
  misc_feature (221)..(221): n is a, c, g, or t
  modified_base (289)..(289): a, c, t, g, unknown or other
  misc_feature (289)..(289): n is a, c, g, or t
tcagtcacgtactacacgaccggtgctcgatttagatctactgacaggggggggtctcaggaggcagcactctcgggacgtctccaccatggcctgggctctgctcctcctcagcctcctcactcagggcacaggatcctgggctcagtctgccctgactcagcctcgctcagtgtcccgggtctcctggacagtcagtcaccatctctgcactggaaccngcagtgatgtgtgttatactatgtctcctggtaccacaacaccaggcaacgccccaaatcatgattangatgtacagtaacgcggccctcgtacggggtccctgactcgcttctctcgcctacagtctcggcaacgccggtccctcccgtcgacctactccgtacgtcgggcctccgaggtctacggaggatcggtagttcgtggtatttacgttacgtgtcctagtcctactagttacgtcgacgagggcctacggtcctaacgtaccgttgttaccgttacggttcccgggacgggaccgggtaaccgtaacgtcccggttaccggtacccggttacccgtacggtacctaccggtaccccgtaaccggg

SEQ ID NO: 290994 - DNA, 578 bp, Homo sapiens
  misc_feature: GYAE6OF02IX9K4.13.6.A06.1.454.CMB.1.raw
  modified_base (294)..(294): a, c, t, g, unknown or other
  misc_feature (294)..(294): n is a, c, g, or t
  modified_base (372)..(372): a, c, t, g, unknown or other
  misc_feature (372)..(372): n is a, c, g, or t
tcagtcacgtactacacgaccggtgctcgatttagatctactgacaggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctctgcactggaaccagcagtgatgttggtgttataactatgtctctggtaccaacaacacccagcaaacgccccaaaatcatgatttangatgtcagtaacgccggaccctcgacggggtccctgactcgtcttctctcgcctacagtctaggacaacgcgcctccncgaccatcgtcgtgggcctccgagctggaggatggagttctagtatttactacgtgctgcttacatagtgacgacgtacacgtacctaacgtacttagttaacctacgggtttccggggaaccgggaacgggtaaaccctaagggtccgttaccggtaccccggtttaccggttaacgggtacccgtaccggaccccgtaaccggg

SEQ ID NO: 290995 - DNA, 614 bp, Homo sapiens
  misc_feature: GYAE6OF02JA8LT.13.6.A06.1.454.CMB.1.raw
  modified_base (293)..(293): a, c, t, g, unknown or other
  misc_feature (293)..(293): n is a, c, g, or t
tcagtcacgtactacacgaccggtgctcgatttagatctactgacaggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctctgcactggaaccagcagtgatgttggtgttatactatgtctctggtaccaacaacacccaggcaaacgccccaaatcatgatttangatgtacagtaagcgccctcgacggggtccctgactcgcttactctcgcccttacaacgttctacggaccaaccgaccggtccctcccgtagacccagttcctacgtcgggcctcccgagggtctggaacggtactaggtacgttcgttagtaactttacttaccgtagtccgttcgtctaccttattacgttcggaccgtaaggcacgtcctaacgtaccgttattacggttacgttccggggacggaaccgggtaaccctaaggtccgttaccggtaccgttacccggttaaggtacccgtaccggcccgtaaccgggg

SEQ ID NO: 290996 - DNA, 667 bp, Homo sapiens
  misc_feature: GYAE6OF02GDK4X.13.6.A06.1.454.CMB.1.raw
  modified_base (194)..(194): a, c, t, g, unknown or other
  misc_feature (194)..(194): n is a, c, g, or t
  modified_base (213)..(213): a, c, t, g, unknown or other
  misc_feature (213)..(213): n is a, c, g, or t
  modified_base (264)..(264): a, c, t, g, unknown or other
  misc_feature (264)..(264): n is a, c, g, or t
  modified_base (444)..(444): a, c, t, g, unknown or other
  misc_feature (444)..(444): n is a, c, g, or t
tcagtcacgtactacacgaccggtgctcgatttagatctactgacagggcagactgagcccaggatcctgggctctgctcctcctcagcctcctcactcagggcacaggatcctgggctcagtctgccctgactcagcctcgctcagtgtccggtctcctggacagtcagtcaccatctcctgcactggaaccngcagtgatgttggtgttanactatgtctcctgtaccaacacaccaggcaacgccccaaatcatgatttangatgtcagtaacgcggtcctcgacggggtccctgactccgcttctctcgccctaccgaagttcctcgggaccaaccgacccggcccttacccgtacggaccctattccgtcgtcgggccctaccgagggtccgttaggacggtagttcggacgttcgtagtaactttaacgtttaaccgngtaccgtttgacccttacgtaaacgttagcggacccgtaacgggtaccaacggttacccttaaaccaaccgttttcgtaaccgttttaacgggttccgggacgggaaccgggaaccctaacggtccgttacggtaccccgttaccgtacgggtacccaaccggtaccccgaacgtcccgtcccggacccccgttacggtaccctaccgttccgttacccccgg

SEQ ID NO: 290997 - DNA, 582 bp, Homo sapiens
  misc_feature: GYAE6OF02F5D71.13.6.A06.1.454.CMB.1.raw
  modified_base (359)..(359): a, c, t, g, unknown or other
  misc_feature (359)..(359): n is a, c, g, or t
tcagtcacgtactacacgaccggtgctcgatttagatctactgacaggggggggtctcaggaggcagcactctcgggacgtctccaccatggcctgggctctgctcctcctcagcctcctcactcagggcacaggatcctgggctcagtctgccctgactcagcctgcctccatgtctgggtctcctggacagtcgatcaccatctcctgcactggaaatgcagtgatgttgggacttatgaccttgtctcctggtaccgacaacacccaggcaaacgcccccaaaactcattatttacgggtcaataagcggccctcagggctttctgatcgcttctctggctccaagtctggcaacncgcctcctgacaatctctcgactccgaggccgaggaccgaggcttgtatttttacgttgtttgtttcattagtgcgtaagggaaggtagttgtaatttagtgttacgtttagggaaaggttgggaacctaggtacctaccggttccgtttggtacctacggccccgtaacggacccctaaccccgacgttaccgtacctaccgttccgttcgtttaccccccg

SEQ ID NO: 290998 - DNA, 707 bp, Homo sapiens
  misc_feature: GYAE6OF02IYJZJ.13.6.A06.1.454.CMB.1.raw
  modified_base (340)..(340): a, c, t, g, unknown or other
  misc_feature (340)..(340): n is a, c, g, or t
tcagtcacgtactacacgaccggtgctcgatttagatctactgacagggggggtcgtcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaatagcagtgatgttgggacttagtgacctttgtcctcctggtaccgacaacacccaggcaaacgccccaaactcaattagttacgggcaataacgcgcctcagggtcttctgatcgcttctntggctcagtctgcacacgcctcctgactactctactggacctcgagggccgagggaaccgtagggtccttaggttaacttttttaccgtaggttttgtttccaattaagtcgtaccggtaaaggggtagggtaacggtttagtaagttttaaccgttgggttaaccgtttttagggggaaaacggtttcggggaaaccccttaaagggggttccctaaccccggggttttccgttcggggttaaccctaaacccgggtacccccgtaaaacccggggtacccccctaaacccccccgtttaggttaccgggttaacccctttaacccgttacccggttttacccggttacccccccccgtaaccccc

SEQ ID NO: 290999 - DNA, 552 bp, Homo sapiens
  misc_feature: GYAE6OF02FOEFY.13.6.A06.1.454.CMB.1.raw
  modified_base (295)..(295): a, c, t, g, unknown or other
  misc_feature (295)..(295): n is a, c, g, or t
tcagtcacgtactacacgaccggtgctcgatttagatctactgacaggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtgttataactatgtctcctgtaccaacaacacccaggcaacgccccaaaatcatgatttangatgtcagtaagcgccctgacggggtccctgactcgtcttctctcgcctacaagtctgctaacgaccggcctccctgaccctatctcgtcgggcctccgaggctagacggatgagttctgtattacttacgtgtctcgctacgattatcgacgaggaccagaccgtaactcgtagttaccgtaggttccgggacggtaacgggaaccaaggcccgttacggacccgttaccgtaggtaccaccggtaccctaacggg

SEQ ID NO: 291000 - DNA, 584 bp, Homo sapiens
  misc_feature: GYAE6OF02HRCRM.13.6.A06.1.454.CMB.1.raw
  modified_base (265)..(265): a, c, t, g, unknown or other
  misc_feature (265)..(265): n is a, c, g, or t
tcagtcacgtactacacgaccggtgctcgatttagatctactgacagggcagactgagcccaggatcctgggctctgctcctcctcagcctcctcactcagggcacaggatcctgggctcagtctgccctgactcagcctcgctcagtgtccggtctcctggacagtcagtcaccatctcctgcactggaaccagcagtgatgttggtgttataactatgtctctggtaccaacacaccagacaaagccccaaaatcatgattangatgtacagtaacgcggcctacgacgggtccctgactcgcttctctcgtcctctaagtctggaccaacgaccggtcctacccgcgacctaattcctcgtacgggtcctaccgtacgttctaggacggacgtagtacgtctagtactttacttactgtctacgtactcgattacgcgtacgtaggactagacctacgaccgttagtacgttacgttcgggacggtaacgggaacctaaggccgtagtacccgtcgtaacggtctaaccgaccgtaacggcccgttaccgccccgttacggtccttaccgtccgttacccg

SEQ ID NO: 291001 - DNA, 364 bp, Homo sapiens
  misc_feature: GYAE6OF02G1M01.13.6.A06.1.454.CMB.1.raw
  modified_base (359)..(364): a, c, t, g, unknown or other
  misc_feature (359)..(364): n is a, c, g, or t
tcagtcacgtactacacgaccggtgctcgatttagatctactgacaggggttccagggcagactcacgattaccgcggacagatccacgagcacagtgtacatggagctgagccgcctgacatctgatgacacggccgtgtattactgtgcgagagatggggcccacgaacgttactacgctatggacgtctggggccaagggaccacggtcaccgtctcctcagcctccaccaagggcccatcggtcttccccctggcgccctgctccaggagcacctccgagagcacagcggccctgggctgcctggtcaaggactacttcctagtacgtgactgagcggctggcaaggcgcatagnnnnnn

SEQ ID NO: 291002 - DNA, 627 bp, Homo sapiens
  misc_feature: GYAE6OF02JA9C9.13.6.A06.1.454.CMB.1.raw
tcagtcacgtactacacgaccggtgctcgatttagatctactgacagggtctccgaaggcttcaccagtcctgtcccaggtgcagctgcgggagtcgggcccaggactggtgaagccttcggagaccctgtccctcacctgcactgtctctggtggctccatcagtagttactactggagctggatccggcagcccccagggaagggactggagtggattgggcagtatctttacagtgggagcaccactaccaacccctccctcaagagtcgagtcaccatatcagtggacacgtccaagaaccagttctccctgaagcctgacgctctgtcgaccgctgcgggaccacggcccgtagtacttactggtgacgagcgtggggttcagggttcttgactacgtgggccacgggaacccgtcggtcaccgtctccctcgacgccctccgaaccgaacgggtccccacgttccggttcccgttcccccttcggccctaccccgtcccgtacccaagccgacctacccgtccggtacgggggcccacgcggccgggcccgtcggggcctccggccgttcggtacgtaacgggtccttaaccgttcccgtaacggttaccgtagtacccgg

SEQ ID NO: 291003 - DNA, 581 bp, Homo sapiens
  misc_feature: GYAE6OF02F4519.13.6.A06.1.454.CMB.1.raw
  modified_base (235)..(235): a, c, t, g, unknown or other
  misc_feature (235)..(235): n is a, c, g, or t
  modified_base (315)..(315): a, c, t, g, unknown or other
  misc_feature (315)..(315): n is a, c, g, or t
  modified_base (365)..(365): a, c, t, g, unknown or other
  misc_feature (365)..(365): n is a, c, g, or t
tcagtcacgtactacacgaccggtgctcgatttagatctactgacaggggggggtctcaggaggcagcactctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgnggtcaagactatgtctcctggtaccaacaacaccaggcaacggcccccaaactcataattatgattcactaatcggcctnagtgtatctaatcgcttcactggctccaagtctggcaacacggcctcctnaccatctctgggcctcgaggcagaggacgagctagattattactgcttgccttacattagtcgctacgggtttcttacgttggttcggttccgtttccgggacggtacgggtacctaaaggttcgaacccgttccgttaaggtccaacggtccccgaagggtcccgtaccgtccccccggttcggtacctacccgttccgttcccgttaccccccg

SEQ ID NO: 291004 - DNA, 381 bp, Homo sapiens
  misc_feature: GYAE6OF02JEXST.13.6.A06.1.454.CMB.1.raw
  modified_base (372)..(372): a, c, t, g, unknown or other
  misc_feature (372)..(372): n is a, c, g, or t
  modified_base (377)..(381): a, c, t, g, unknown or other
  misc_feature (377)..(381): n is a, c, g, or t
tcagtcacgtactacacgaccggtgctcgatttagatctactgacaggggttccagggcagactcacgattaccgcggacagatccacgagcacagtgtacatggagctgagccgcctgacatctgaagacacggccgtgtattactgtgcgagagatcggggactataccggggcgatattcgcgacctggacttctacttctacatggacgtctggggcaaagggaccacggtcaccgtctcctcagcctccaccaagggccatcggtctcccctggcgcccctgctccaggagcacctccgagagcacagcggccctggctgcctggtcaggactactcctagacgtgactgagcgggctggcaaggcncatgnnnnn

SEQ ID NO: 291005 - DNA, 659 bp, Homo sapiens
  misc_feature: GYAE6OF02HL6VX.13.6.A06.1.454.CMB.1.raw
  modified_base (165)..(165): a, c, t, g, unknown or other
  misc_feature (165)..(165): n is a, c, g, or t
  modified_base (200)..(200): a, c, t, g, unknown or other
  misc_feature (200)..(200): n is a, c, g, or t
  modified_base (214)..(214): a, c, t, g, unknown or other
  misc_feature (214)..(214): n is a, c, g, or t
  modified_base (231)..(231): a, c, t, g, unknown or other
  misc_feature (231)..(231): n is a, c, g, or t
  modified_base (566)..(566): a, c, t, g, unknown or other
  misc_feature (566)..(566): n is a, c, g, or t
  modified_base (624)..(624): a, c, t, g, unknown or other
  misc_feature (624)..(624): n is a, c, g, or t
tcagtcacgtactacacgaccggtgctcgatttagatctactgacagggcagactgagcccaggatcctgggctctgctcctcctcacgcctcctcacctcagggcacaggatccgtgggctaccagtctgccctgaacctcagccctgactcagtgtcccggtntccgtggaacagtcagtcaccatctccgtgctacncggaaccagcagtnacgtgttaggtggtaanacgttatgtacctctaggtaccaaacgaaccacccaggacaaacgaccccgtaaaatcacgtagtaatttacagaattcgtacgaagttaacggcctccgtacgaccgggtccctaggatccgtattccgttcgtcgtaccctactaacgtcgtacgaactaaccgtccggtacccttcccgacgaaccttctcgtcgtcggtcctaccggagtcgtagacgtacgtagtacgtccttagtacgttattaccgtaggcttacggtaccttacgattaccgtagtaccgaagggcctaacgtacctaccgacgttccgttaagtacgttaccgggngtaaccgggacgtaacgcgtacggtaccgtacgtaccgtacgaccgtaccgaggtccncccggtacccgtccgttaacgcccgttgtccccgg

SEQ ID NO: 291006 - DNA, 691 bp, Homo sapiens
  misc_feature: GYAE6OF02H2JRV.13.6.A06.1.454.CMB.1.raw
  modified_base (207)..(207): a, c, t, g, unknown or other
  misc_feature (207)..(207): n is a, c, g, or t
  modified_base (233)..(233): a, c, t, g, unknown or other
  misc_feature (233)..(233): n is a, c, g, or t
  modified_base (327)..(327): a, c, t, g, unknown or other
  misc_feature (327)..(327): n is a, c, g, or t
tcagtcacgtactacacgaccggtgctcgatttagatctactgacagggcagactgagcccaggatcctgggctctgctcctcctcagcctcctcactcagggcacaggatccgtggctcagtctgccctgactcacgcctcgctcagtcgtccggtctcctggacagtcagtccaccatcctccgtgcacgtggaaccagctagtnagttggttaggtagtttaataaactntgttctcgtacgaacaacaacacccgaggaccaaacgaccccaaaatcatagtattatgatgtacgagtaacgccgtccgtacggtcggtcccngactcgtcttctctcgtcctactacgtcgacggacaaccgcgcctaccgtacgacctactcgtacgtcggtacctacgaacgggtctaggagtacgagttacgtacgtaagttaactttacgtacgcgtaccgttcgtacttacgtaagttacgttacggccgaaagggtctaccggtaaccttcggtaaccgttaacgttaaccgttacgggttcccgggaaacgggtaaccgaaaccgtacggtacccgttaaccggtcccgttaaaccggtaccggttaccggaaaccggccccgtaacggtccccgtacccggttacccccgtacgggttacccttacccggttcccgtttaacccccgg

SEQ ID NO: 291007 - DNA, 661 bp, Homo sapiens
  misc_feature: GYAE6OF02HP3UQ.13.6.A06.1.454.CMB.1.raw
  modified_base (220)..(220): a, c, t, g, unknown or other
  misc_feature (220)..(220): n is a, c, g, or t
  modified_base (357)..(357): a, c, t, g, unknown or other
  misc_feature (357)..(357): n is a, c, g, or t
  modified_base (463)..(463): a, c, t, g, unknown or other
  misc_feature (463)..(463): n is a, c, g, or t
tcagtcacgtactacacgaccggtgctcgatttagatctactgacagggcagactgagcccaggatcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtgttaataactntgtctcctggtaaccaacaacaccagcaaaacgccccaaaatcatgatttatgatgtcagtaacgccggtccctgacggggtccctgactccgctttctctcgtcctactaagtctggaccaacgccggcctacccncgacctatcctcgtcggccttccgaggtcctagggacggtaatcggtaacgttcgtagtaacttttaacgttaccgtcgttcctaggtacccttagaacgtttacncggacgtaccgggactacgtaccttaacgtacgttacgttaacgttacgggttaccgggacggtaaacgggtaccctaacggtccgttacggtacccggttaaccgttacgggtaccaaccgggtaacccggtaacggtcccgtaccccgggtaccccccgttacgggttaccctacccggtttccccgttccccggg

SEQ ID NO: 291008 - DNA, 620 bp, Homo sapiens
  misc_feature: GYAE6OF02FRO05.13.6.A06.1.454.CMB.1.raw
  modified_base (299)..(299): a, c, t, g, unknown or other
  misc_feature (299)..(299): n is a, c, g, or t
tcagtcacgtactacacgaccggtgctcgatttagatctactgacaggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatggttggtggttaataactatgtctcctaggtaccaacaacaccagcaaacgaccccaaatcatgatttangatgtcagtaacgcggccctcgacggggtccctgactcgtcttctctcgcctcaagtctcgacaacgaccggccctcccgacgacctactcctacgtcgggcctccgaggtcgtaggaggtactggtagttcgtagttaactttacgttaccgtgtccttagtccgttactattagtcgcgtaacgggctaacgtccctaaagtaccgttacgtaaccgttacggtttaccggggaccgggtaaacgggtaaccctaacggtcccgttaaccggtacccggttccggtaacgggtacccgtaccggtaccccggtaacggg

SEQ ID NO: 291009 - DNA, 577 bp, Homo sapiens
  misc_feature: GYAE6OF02IXEAE.13.6.A06.1.454.CMB.1.raw
  modified_base (220)..(220): a, c, t, g, unknown or other
  misc_feature (220)..(220): n is a, c, g, or t
  modified_base (279)..(279): a, c, t, g, unknown or other
  misc_feature (279)..(279): n is a, c, g, or t
  modified_base (362)..(362): a, c, t, g, unknown or other
  misc_feature (362)..(362): n is a, c, g, or t
tcagtcacgtactacacgaccggtgctcgatttagatctactgacagggcagactgagcccaggatcctgggctctgctcctcctcagcctcctcactcagggcacaggatcctgggctcagtctgccctgactcagcctcgctcagtgtccgggtctcctggacagtcagtcaccatctcctgcactggaaccagcagtgattgttggtgttataactntcgtctccgtaggtaaccaacaaccaccaggccaacggccccagagtcactctagttgnggggacaagtacgggcggccgtacgagggtactttccacgtcgtcttcgtctcgctaccagtcgtcgacaacgacgtcctccnactatctctgtcctcgagtctggacggacgacggtctcgtctacttagcgtctcgctctaagtcgtcgtcgttacgtttccttgtcggttcggttcgttcggacggtacggtacaaggttcgaccgttacgagtaccgtacgaccgtagtccgtacccgtcccgtcgtacctaccgttccttccgttacccctaccctccgttacgtcgtaccgg

SEQ ID NO: 291010 - DNA, 684 bp, Homo sapiens
  misc_feature: GYAE6OF02JI7RJ.13.6.A06.1.454.CMB.1.raw
  modified_base (328)..(328): a, c, t, g, unknown or other
  misc_feature (328)..(328): n is a, c, g, or t
tcagtcacgtactacacgaccggtgctcgatttagatctactgacaggggggggtcgtcgaggaggcagcactctcgggacgtctccaccatagcctgggctctgctcctcctcagccctcctcactcagggcacaggatcctgggctcagtctgccctgactcagcctcgctcaggtcgtccgggtctaccgtggacctaggtcaggtccacctatcctctgccaccgtaggaaccaacggctacgtgactggttggtagttactaactatcgtctcgtacgtaccaacacaccgagaccaaccacccaaaatccagtcgtattacngtatcgtactaagtacgccggtacctcggtacgggttccctagtactcgtacttctcgtccgtcctacgtacgtcgtacgacaacgtaccgccttccgacgtactacgtccgtcgtcggacctccggacgtcgtaaggacgttacgacggtagttcgttactaaactttagtaccgtcgtacgttacgtacgttacctaacgtttaacgccgttacgacgggttaccgtaacggtaccccttaagtacgttacccggttagtacccggggttacgggaccgggaaccggtaacccgtaaggttacccgtcggttacccgggttacctaccggggtaccacccgggtacgtacccgg

SEQ ID NO: 291011 - DNA, 414 bp, Homo sapiens
  misc_feature: GYAE6OF02IQOPS.13.6.A06.1.454.CMB.1.raw
  modified_base (216)..(216): a, c, t, g, unknown or other
  misc_feature (216)..(216): n is a, c, g, or t
  modified_base (397)..(397): a, c, t, g, unknown or other
  misc_feature (397)..(397): n is a, c, g, or t
  modified_base (403)..(414): a, c, t, g, unknown or other
  misc_feature (403)..(414): n is a, c, g, or t
tcagtcacgtactacacgaccggtgctcgatttagatctactgacaggggttccagggcagactcacgattaccgcggacagatccacgagcacagtgtacatggagctgagccgcctgacatctgaagacacggccgtgtattactgtgcgagagagtcgggactagtaccggggcgatattcgcgacctggacttctacttctacatggacgtntggggcaaaagggccacggtcaccgtctcctcagcctaccaccaacgggccccatccggtccttcccccgtggccgtcccctgccgtccaggacgccaccctccgagacgcacacgccggccctgggcctgcctggtcaaggactacttcctagtacgtgactggagcggctggcaaggcncatagnnnnnnnnnnnn

SEQ ID NO: 291012 - DNA, 814 bp, Homo sapiens
  misc_feature: GYAE6OF02ICI92.13.6.A06.1.454.CMB.1.raw
  modified_base (225)..(225): a, c, t, g, unknown or other
  misc_feature (225)..(225): n is a, c, g, or t
  modified_base (470)..(470): a, c, t, g, unknown or other
  misc_feature (470)..(470): n is a, c, g, or t
  modified_base (479)..(479): a, c, t, g, unknown or other
  misc_feature (479)..(479): n is a, c, g, or t
  modified_base (581)..(581): a, c, t, g, unknown or other
  misc_feature (581)..(581): n is a, c, g, or t
tcagtcacgtactacacgaccggtgctcgatttagatctactgacagggcagactgagcccaggatcctgggctctgctcctcctcacgcctcctcactcagggcacaggactccgtgggctctaaggtctcggccctgacctcgacgccctcgctacgaggtcggtccgggtcctccgtaggacacgtcgagtccaacctgtctcctaggccagtacggaaccngctagtgacgttggtttggtagttaacactagtgttacctcgtacggtaacaacaccgacccgaggaacctaaaacgacccctaaaatcctaagtagtacttttagacgtactaggtaactaacgggtaccgtccggtcccgtacggaccgggttccaaggtctacgtcctttacgccgtacctcgtaaccttaggccgttacgactaccgtaccgccctttacgacgacctcgtacgttccggngggtacccngtaacgggtcacgggtacgtagtacggttacgtacgtgtaaacttttcgtaactcgtcggacttcctttagaacgttacgtacggtacgaacccgggtttanaacccgttacgtacgtttaaccgtacggtttaacccggttacggggtaccggggtaaaccggtaaccgggttaacccgttaaccgggtaccgggtttaacccgggtaacccggttaaccgggtaaccggtacccggttaaacccgggaaccccgttaccgggttaccccgtaacccccgggtttcccggggtttaaccctttcccggtaccccggtttttaccccgtccccgg

SEQ ID NO: 291013 - DNA, 415 bp, Homo sapiens
  misc_feature: GYAE6OF02FF3BX.13.6.A06.1.454.CMB.1.raw
  modified_base (280)..(280): a, c, t, g, unknown or other
  misc_feature (280)..(280): n is a, c, g, or t
  modified_base (285)..(285): a, c, t, g, unknown or other
  misc_feature (285)..(285): n is a, c, g, or t
  modified_base (296)..(296): a, c, t, g, unknown or other
  misc_feature (296)..(296): n is a, c, g, or t
  modified_base (300)..(300): a, c, t, g, unknown or other
  misc_feature (300)..(300): n is a, c, g, or t
  modified_base (397)..(399): a, c, t, g, unknown or other
  misc_feature (397)..(399): n is a, c, g, or t
  modified_base (401)..(415): a, c, t, g, unknown or other
  misc_feature (401)..(415): n is a, c, g, or t
tcagtcacgtactacacgaccggtgctcgatttagatctactgacaggggttccagggcagactcacgattaccgcggacagatccacgagcacagtgtacatggagctgagccgcctgacatctgaagacacggccgtgtattactgtgcgagagatcggggactataccggggcatattcgcgacctggacttctacttctacatggacgtctggggcaaagggccacggtcaccgtctcctcacgcctccaccaagggcccatcggtccttcccccnggccncccctgctccnggancaccctcgagagcacacgccggcccgtgggttcgcctgggtacaaggtactacttccgtagtacgtgactggagcggactggacaagggcacatagnnncnnnnnnnnnnnnnnn

SEQ ID NO: 291014 - DNA, 697 bp, Homo sapiens
  misc_feature: GYAE6OF02IX28M.13.6.A06.1.454.CMB.1.raw
  modified_base (268)..(268): a, c, t, g, unknown or other
  misc_feature (268)..(268): n is a, c, g, or t
  modified_base (302)..(302): a, c, t, g, unknown or other
  misc_feature (302)..(302): n is a, c, g, or t
tcagtcacgtactacacgaccggtgctcgatttagatctactgacagggcagactgagcccaggatcctgggctctgctcctcctcagcctcctcactcagggcacaggatcctgggctcagtctgccctgactcagcctcgctcagtgtccgggtctcctggacagtcagtcaccatctctgcactggaaccagcagtgatgttggtgttataactatgtctctggtaccaacaacaccagcaaacgaccccaaatcatgtatttangattgtacaaggtagccggcctcggacgggtccngctccgtcttctcgtacgcccttacgagttccgtcggaccaaaccgtaccggtcccttacccgtaccgacctaagttcccgttacgtcgggtccctaccggtacggtccggttacggaacggtacgttacgggtaacgtttcgtacttaacgttttacttaccggttcgacgtttcgtaacttactacgttaggaccgtcgacgggtctaagtacctaacgtaccttaggttaaccgttacgggttacggggacccggttaacggaaccgtaacggttcctacggggttaccccgtttacggtaacggtcccgtaacccggtaaccgtaagggttccccctccggttaccccccggtaccgggtttaccttaacccgggttcccgttaccccggg

SEQ ID NO: 291015 - DNA, 667 bp, Homo sapiens
  misc_feature: GYAE6OF02JDEYL.13.6.A06.1.454.CMB.1.raw
  modified_base (185)..(185): a, c, t, g, unknown or other
  misc_feature (185)..(185): n is a, c, g, or t
  modified_base (209)..(209): a, c, t, g, unknown or other
  misc_feature (209)..(209): n is a, c, g, or t
  modified_base (230)..(230): a, c, t, g, unknown or other
  misc_feature (230)..(230): n is a, c, g, or t
  modified_base (237)..(237): a, c, t, g, unknown or other
  misc_feature (237)..(237): n is a, c, g, or t
  modified_base (294)..(294): a, c, t, g, unknown or other
  misc_feature (294)..(294): n is a, c, g, or t
tcagtcacgtactacacgaccggtgctcgatttagatctactgacagggggggtcgtcaggaggcagcactctcgggacgtctccaccatggcctgggctctgctcctcctcagcctcctcactcagggcacaggatcctgggctcagtctgccctgactcgagcctcgactcagtcgtccggtntacctggaccagtccagtccaccntctcctagcacgtaggaaccngccagtnattgttggtgtactactatgtctctagtacaacacacccaggacaaacaccccaaanactactacgtattatagatgcgaagtaacgccgtcctcgtacggtcctcgacttcgtccttactctcgtacccttcgaacgtcgtacggtaccaaaccgtcggtaaccctcccgttaccaccgttactccgtccgttggaccctccgacggtcgtacggagacgtgtacgttctagtacgttacttactcggtactacggtccttaccgtagtttaaccgtcgtaccgaggtcctaaccggctttaacccgtacttacgttaaccttccggttaaccggggaccgggtaaccggaaccgttaaccggtaccggttacccgtaacccggtttacccggttaacgggacccgttaccggacccggttaaccccgg

SEQ ID NO: 291016 - DNA, 676 bp, Homo sapiens
  misc_feature: GYAE6OF02J1BRS.13.6.A06.1.454.CMB.1.raw
  modified_base (538)..(538): a, c, t, g, unknown or other
  misc_feature (538)..(538): n is a, c, g, or t
  modified_base (586)..(586): a, c, t, g, unknown or other
  misc_feature (586)..(586): n is a, c, g, or t
  modified_base (619)..(619): a, c, t, g, unknown or other
  misc_feature (619)..(619): n is a, c, g, or t
  modified_base (636)..(636): a, c, t, g, unknown or other
  misc_feature (636)..(636): n is a, c, g, or t
tcagtcacgtactacacgaccggtgctcgatttagatctactgacagggcagactgagcccaggatcctgggctctgctcctcctcagcctcctcactcagggcacaggatcctgggctcagtctgcctgactcagcctcgctcagtgtccgggtctctggacagtcagtcactatctcctagcactcggaaccagcagttgattggtgtacggttaataactatcgtccttcgacgtaaccacaaccaccgacgaccaaaccgaccccgtaaaatcctaacgttagtaatttaacgagttagtacgtacgagtaaccggcgtccgtaacgggtccggtacccgtaggaccgttaccgtccgtttaccgtaccgttacgtacccttaaccgtaagtcccggtagggaacctaccggtacgtaccccgtcgtaacgaccctacgtccggttacgtcgggtaccctcggacggtacgtacggtagcttacggtaactcgtatacgttaacttcgtcgtctacggtctaccgtagttacgngacgacggtactaccgtactacgtacttcgtaacggtaggttcccggnggtaacgaaccgtcggtcacggtaccgtaaccnggtacgtaccggaaccnggtaccgtcccgaccggttcggtacccagttcctacccgg

SEQ ID NO: 291017 - DNA, 705 bp, Homo sapiens
  misc_feature: GYAE6OF02G3IV6.13.6.A06.1.454.CMB.1.raw
tcagtcacgtactacacgaccggtgctcgatttagatctactgacagggggggtctcaggaggcagcactctcgggacgtctccaccatggcctgggctctgctcctcctcagcctcctcactcaggcacaggatcctgggctcagtctgccctgactcacgcctcgctcagttcgtccggtctccgtggactagtcagtcaccactcctcctgcctacgtaggaaactgactagtgtagttggttacggtacttagtcgttaccttcgtccgtaccgtacggtaaccaaccaaccgacccgacggaccgaaccggccccgaagtacgtactacttcgtagttacggtacgggacgtaacgtacgggtccggtaccgtacgtacggttaccttcccgtaccgttcgttccttcgtccgtcgtaccgtaccgtacgtcgtaccgacctacccgtaccgtccctacgtacgtaacctacgttccgttacgttccgaccgtaccgaggtactacgggacgtacggtcgttcctaacgtttcttaacgttcggccttacgtcgtaactacgttacgtcgttacggttcgtttacggttcgttcggttcgggttccgttacgggtccggacgtaccgtacgtacggtccgtacgtcgaccgacgttacccgaccgttacggtccccgtccgtcccgtcgtacctccccgg

SEQ ID NO: 291018 - DNA, 714 bp, Homo sapiens
  misc_feature: GYAE6OF02HMEPF.13.6.A06.1.454.CMB.1.raw
tcagtcacgtactacacgaccggtgctcgatttagatctactgacaggggggggtctcaggaggcagcactctcgggacgtctccaccatggcctgggctctgctcctcctcagccctcctcactcagggcacaggatccgtgggctcagtctgccctgactcagcctcgctcagtgtccgggtctccgtggacagtcagtcaccatctctgcactggaaccagcagtgatgttggtagtatactatgtctcctgtaaccaacaaccaccaggacaaacgaccccaaaatccatgtaatttatcgatcgtacaagtaaacggccggtaccctacggaccgggggttccctagtactaccgtcttctccgtcgtacccttaccgtaaacgtccggtacgaaccgtaaacccgtacccgtccccgttaccctacggaacctacgttaccgtccggtaccggggtccctacccggtaacgggtccggtaacgggtaacggtaacgtaggttaacgttccgttaggtaacttttaacgttaccgtgtccgttacgtccgttactagtacgtacggacgtacggacctacggaccttacgtacggttacttaacggttacggttaaccggggacggttaaccgggaaacccgtaacggtcccgttaaccgtacccggttaaccgttaacgggtacccgaccggtacccgtaacccgggg

SEQ ID NO: 291019 - DNA, 717 bp, Homo sapiens
  misc_feature: GYAE6OF02JTA03.13.6.A06.1.454.CMB.1.raw
  modified_base (201)..(201): a, c, t, g, unknown or other
  misc_feature (201)..(201): n is a, c, g, or t
  modified_base (219)..(219): a, c, t, g, unknown or other
  misc_feature (219)..(219): n is a, c, g, or t
  modified_base (224)..(224): a, c, t, g, unknown or other
  misc_feature (224)..(224): n is a, c, g, or t
  modified_base (227)..(227): a, c, t, g, unknown or other
  misc_feature (227)..(227): n is a, c, g, or t
  modified_base (242)..(242): a, c, t, g, unknown or other
  misc_feature (242)..(242): n is a, c, g, or t
  modified_base (392)..(392): a, c, t, g, unknown or other
  misc_feature (392)..(392): n is a, c, g, or t
  modified_base (524)..(524): a, c, t, g, unknown or other
  misc_feature (524)..(524): n is a, c, g, or t
tcagtcacgtactacacgaccggtgctcgatttagatctactgacaggggggggtctcaggaggcagcactctcgggacgtctccaccatggcctgggctctgctccgtcctcagcctcctcactcagggcacaggactccgtgggctcgagtcgtgaccctgtacctcacgcctcgtctcaggtcggtccggtctaccgnggacctagtcacgtcacntctcngcnctacgacagctagtnattcgtaggtagtactactagtcgtctaccgtagtaaccaacctaaccaccgaggaaccctaaaccgtaaccccaaaatccgagttacgtatttacgtagtaactcgtacgtacgtaacggtccgtaccgtacggtcggttccagttacncgtacctccgtaccgtcgtacctacggtaacttccggacgtacccgtaaccaccgtcccgtacctacgtaacctacgttccgttaccggcgtcccgtacgtaccggtccgtaagggacgttacgtacgggtnttaccggtagttaacgtttaacgaccgttggtaccgtacgttacccggtattaacgtcgtacgtcggaacgtcgtacgtaacgtacgtacgttacgtaacttacggtcccggggtaagaccggttaaacgcccgggtaacctacgggttaaccgtacggttacccggaaccgttacccgggtacctacccggg

SEQ ID NO: 291020 - DNA, 801 bp, Homo sapiens
  misc_feature: GYAE6OF02HWDJB.13.6.A06.1.454.CMB.1.raw
tcagtcacgtactacacgaccggtgctcgatttagatctactgacagggcagactgagcccaggatcctgggctctgcctcctcctcacgcctcctcactcgagggcacaggatccgtggctcagtctcgcctgactcgacgcctcgctcgacgtcggtccggtctcgtggactacgtcgacgtaccaccgtacttccgtccgttagacctacggtaccggtaaccacgtcgtaacgtggtaacgttcggttacggtacgttaaactaacgttacgtcgttaaccgttcgtaacggtaaaccaaccgaacccgtaccgaacggtaaccaaaaccgaccccgtaaagtccgtagttacgttaactttacggacgttaacgtcgttaccggtaaacggtaccggtcccggtccgttaacgggtaccgggttaccaacggttcgttacccggttccttccgttacgtacccggtacccgttacggtacgttaccggtaccgggtaacctaaaccggtcccggttccttacccgtacgtaaccgttcgtccggtacggtccggttccgaacgtcggtacgtacggtaacggtacggtcgtacgttacgttaagttcgtaccggtactacgggtactcggtaagttacgtcgcgtacgttcgtttctacggttcggtaccgtcggtacgggacgtacgtacgaacggtcgtacggtccgttacgacggttacaccggtcgtcccgaccggttcccggtatacccgtcgttaccgtcccgttacccggtcgtaccgttacgtaccgg

SEQ ID NO: 291021 - DNA, 780 bp, Homo sapiens
  misc_feature: GYAE6OF02ITH9I.13.6.A06.1.454.CMB.1.raw
  modified_base (650)..(650): a, c, t, g, unknown or other
  misc_feature (650)..(650): n is a, c, g, or t
tcagtcacgtactacacgaccggtgctcgattttagatctactgacagggggggggtctcaggaggcagcactctcgggacgtctccaccatggcctgggctctgctcctcctcacgcctcctcactcaggcacaggactccgtgggctcacgtctcgccctgactcgacgcctcgtctcgacggttcggtcccgggttccttccgtacggactacgtccgacgtaccacctacttcctccgtcgtacctaccgtacggtaaccacgacgtacgtagtagttacggtttgggttacgttaactaacgttacttcgtcttccgtacgtaaccaaccaaccacccgacgaaccaaaccgaaccctaaactactagttcgtaactttagtagtactacgtacgtaacggtacggcccggtaccgtaccggtaccgggttccgtacggtaccgttccgttaccgttccgttcctaccgtacccgttaccgttaacggttccgtaccggtaacccgaacccggtacccggtaccccgttacccgtaccgtaacccgttaccttaccggttaccgggtccggggtacccctacggggaacgttcgtaagggtacgtacgtacggttacgttcgtagtttactttacgttacgtacncgttcgcctagtacgtacgtcggacacggtcacgtacttactacgttacgttacggttacgggtccgggaacggtaccggtaacacggtaccgtaccgacccggttcgacgggcctacggacccgtacgg

SEQ ID NO: 291022 - DNA, 408 bp, Homo sapiens
  misc_feature: GYAE6OF02II7TH.13.6.A06.1.454.CMB.1.raw
  modified_base (171)..(171): a, c, t, g, unknown or other
  misc_feature (171)..(171): n is a, c, g, or t
  modified_base (339)..(408): a, c, t, g, unknown or other
  misc_feature (339)..(408): n is a, c, g, or t
tcagtcacgtactacacgaccggtgctcgatttagatctactgacaaacacacaagggggaggaactgctcagttaggacccagacggaaccatggaagccccagcgcagcttcctcttcctcctgctactctggctcccagatactactggaagaaaatagtgctgacgnagtcctccgagtcctaccctgtctgtgtctccgaaaggggtaaatacgaccaaccccttcctcctgcgacgggaccagtcaaggtagttgttacacgagcagacttacgccgttaggaaccagcgaagaacgtcccgtaggccgaacgggtcccaccccgtacggtannnnnnnnnnnnnnnnnnnnnnnnnnnnnnnnnnnnnnnnnnnnnnnnnnnnnnnnnnnnnnnnnnnnnn

SEQ ID NO: 291023 - DNA, 778 bp, Homo sapiens
  misc_feature: GYAE6OF02FU63Q.13.6.A06.1.454.CMB.1.raw
  modified_base (249)..(249): a, c, t, g, unknown or other
  misc_feature (249)..(249): n is a, c, g, or t
  modified_base (294)..(294): a, c, t, g, unknown or other
  misc_feature (294)..(294): n is a, c, g, or t
  modified_base (307)..(307): a, c, t, g, unknown or other
  misc_feature (307)..(307): n is a, c, g, or t
  modified_base (312)..(312): a, c, t, g, unknown or other
  misc_feature (312)..(312): n is a, c, g, or t
tcagtcacgtactacacgaccggtgctcgatttagatctactgacaggggggggtctcaggaggcagcactctcgggacgtctccaccatggcctgggctctgctcctcctcagcctcctcactcagggcacaggatcctgggctcagtctgccctgactcagcctcgctcagtcgtccgggtctcctggcagtcagtcaccatctcctgcactacggaaccagcagtgatggttggtagttataactntcgtctccgtagaacctaacaccacccaggacaacgaccccaaanctatgtatttaangtatntacgaagtaacggccgtacccgtgacggttatactactaacgttccgtctttacctacgtcgggaccctttacctaaacggttccgtaccgggaacctaaacccgtacccgggttcccctaccccgtaccggtaacccttacgtcccgtttaccgggtccggtccggttaccccgacgggtaccgaacgggtaacgggtaaccggtaacgggtacgtaacgtttaaaccgttttaaacgttccgtacgggtacccggttccgtttacccgggtacgggttaaccggttaacgtttcccgtaacctttacccgttttaagggtccgttttacccggtaccgggggttaccttacgggtaccggttaaccgtaacggggttaccccgtaacccggttaaccgttaaccggccggttaacccaccggtaaacccgggtaaccccacccccgttacggtacgttaccccg

SEQ ID NO: 291024 - DNA, 331 bp, Homo sapiens
  misc_feature: GYAE6OF01BX2DD.39.8.A08.1.454.CMB.1.raw
  modified_base (327)..(331): a, c, t, g, unknown or other
  misc_feature (327)..(331): n is a, c, g, or t
tcagtcgcactagtcacgaccggtgctcgatttagcatactctacagggacaacgccaagaactcactgtatctgcaaatgaacagcctgagagccgaggacacggccctctattactgtgcgagagatcagacggagtatagcagcagctctgactactggggccacggaaccctggtcaccgtctcctcagcctccaccaagggcccatcggtcttccccctggcaccctcctccaagagcacctctggggcacagcggccctgggctgcctggtcaaggactacttccactagtgcgactgagcgggctggcaaggcgcatagnnnnn

SEQ ID NO: 291025 - DNA, 332 bp, Homo sapiens
  misc_feature: GYAE6OF02HUMJM.39.8.A08.1.454.CMB.1.raw
  modified_base (327)..(332): a, c, t, g, unknown or other
  misc_feature (327)..(332): n is a, c, g, or t
tcagtcgcactagtcacgaccggtgctcgatttagcatactctacagggacaacgccaagaactcactgtatctgcaaatgaacagcctgagagccgaggacacggccctctattactgtgcgagagatcagacggaatatagcagcagctctgactactggggccacggaaccctggtcaccgtctcctcagtctccaccaagggcccatcggtcttccccctggcaccctcctccaagagcacttctgggggcacagcggccctgggctgcctggtcaaggactacttccactagtgcgactgagcggctggcaaggcgcatagnnnnnn

SEQ ID NO: 291026 - DNA, 358 bp, Homo sapiens
  misc_feature: GYAE6OF02ILA1R.39.8.A08.1.454.CMB.1.raw
  modified_base (160)..(160): a, c, t, g, unknown or other
  misc_feature (160)..(160): n is a, c, g, or t
  modified_base (346)..(358): a, c, t, g, unknown or other
  misc_feature (346)..(358): n is a, c, g, or t
tcagtcgcactagtcacgaccggtgctcgatttagcatactctacagggacaacgccaagaactcactgtatctgcaaatgaacagcctgagagccgaggacacggccctctattactgtgcgagagatcagacggaatatagcagcagctctgactacnggggccacgggaaccctggtcaccgtctcctcagtctccaccaagggccccatcggtccttccccctggccacccctcctccaacgagccacttcgcgggggccacagccggtcctgggcctgcctaggtcaaggactacgttccactagtgcgactcgagtcggctggcaaggtcgactagagcnnnnnnnnnnnnn

SEQ ID NO: 291027 - DNA, 532 bp, Homo sapiens
  misc_feature: GYAE6OF01E2BY8.11.1.A01.1.454.CMB.1.raw
  modified_base (439)..(439): a, c, t, g, unknown or other
  misc_feature (439)..(439): n is a, c, g, or t
tcagcgagagataccacgaccggtgctcgatttagacgtctcatcaggggaggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggacncctcagttggaagcagccgatccagcctgccggagcccgtggtcggggcagggtccaggccccaaagggcccaaaccccactcgtccactccg

SEQ ID NO: 291028 - DNA, 955 bp, Homo sapiens
  misc_feature: GYAE6OF01BN4MI.11.1.A01.1.454.CMB.1.raw
tcagcgagagataccacgaccggtgctcgatttagacgtctcatctaggggtagggggcaggttggtaggatgcccctctcgggtaggagtactccccgagggtgacacgccagtggaccctggaaggcctgggactaggacagggaccagacgccaggtcctaggggagaggacagaggttccctaagttgggaccttagggggtttaaggttacgttcgtaaacgtaggtcccctaggtcgtcgggacggaggtaggggaccgaaggggtccgggaaccggtccttccgacgggaggccccgggtactggaaccttgccaagttcgggccaggaggtcgccccgttggaacccttcgaaacggcctaatggtaacggaaccctaaggacctaggtacctaaacggttgggggttcgtcggaaggtacccccgttggacggggaagggccgttcgggggacccgttgggtccccgtaggggcccgtaaggtccggaccctaacgggtccccgtaggaccgttcggccgtacggtaccgtttaggggtccgtcgggtcccgtacggtttcggggtccggaccccgtaagggttccggggtacccggtttcggaccccgttacgggtcccccggtacccccgtaaaagggttcggggtttacggacccgtaacccggttaccgaaaacggggacccgggggaaacccccaacggggtaacccccgttagggtacccggtacccgtacgtaaacggtttacgggaaacgaccgtaaccggtacccggaaaaccgttcccggaacggaccccggttcgggtaccgggttaacgttaccccggttggggtccgggggtaccctaacggggtcccgaaccgggtaccccccggaaacgggttacccccttaaaccccccgtaacgttttttcccggtacccgtacccggttttacccccg

SEQ ID NO: 291029 - DNA, 552 bp, Homo sapiens
  misc_feature: GYAE6OF01DK0WV.11.1.A01.1.454.CMB.1.raw
  modified_base (232)..(232): a, c, t, g, unknown or other
  misc_feature (232)..(232): n is a, c, g, or t
  modified_base (439)..(439): a, c, t, g, unknown or other
  misc_feature (439)..(439): n is a, c, g, or t
tcagcgagagataccacgaccggtgctcgatttagacgtctcatcaggggaggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcgggccagaggtgccctgaacctgaaggccaatgagacccaagacaggccaagtgggttgtgagacccctgaggagctgggccctggtcccaggcagcgctggccctgctgctgctgggtctggcatggtcgcccgatggcctgctcgcgccaatggtgcaccggcaaacggcgggacccagaccctgggacnccgtcgacgttggaacgcgagccgatccgagcccgtcgcggacggccgtggtcgggggcagggtccaagggccccgaacggccccaaacccccgagtcgtcccgacgttcccg

SEQ ID NO: 291030 - DNA, 610 bp, Homo sapiens
  misc_feature: GYAE6OF01DAJCL.11.1.A01.1.454.CMB.1.raw
tcagcgagagataccacgaccggtgctcgatttagacgtctcatcaggggaggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggagcccatgctgcaaggtcgggccaggaggtcgcccctgaaccctgaacggccaaatgacgacccaagacaggccaaggtgggttgtgagacccctgaggagcgtgggccctggtccccaggcagcgcgtcggccctgctgctggctgggtctcgggcctagtcggtccgcccgagtcgggccctggccttcggcccgtcccgtaagttcggttcgccgaaccggacgaaacggccggggaccccgacgacccgtcggacgccgtacgacggttcggaacgcgacgccgactccgacgcccgtggcggtacggccgtgggtcggggacacggtccgacggcccgaacggaccccaacccgacgtccgtccgccttacccg

SEQ ID NO: 291031 - DNA, 616 bp, Homo sapiens
  misc_feature: GYAE6OF01D4C8F.11.1.A01.1.454.CMB.1.raw
  modified_base (217)..(217): a, c, t, g, unknown or other
  misc_feature (217)..(217): n is a, c, g, or t
  modified_base (389)..(389): a, c, t, g, unknown or other
  misc_feature (389)..(389): n is a, c, g, or t
tcagcgagagataccacgaccggtgctcgatttagacgtctcatcaagggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattatttanacagctccgacagtaagaactacttatcttggttaccaacagaaaccaggacagcctacctaaattactcaatttattccactatctatcgcgggcctccggggtcccacgattcagtgcagcgggtctgggacagattcactctcacaatcagcagcctgcagactgaagntggtggtactttattagttcgtacaaactattatttcttctttaggttttacccgttttaaagttcggggacgggtaacggggtaaccctaaaggggttgggaataacgttacgaaaaaccgggttacttggggtacggccgttacggccctaaaccgtattccgttaggttaccctttacgaactttcccgtttacccccggacctaagtttcccgtggtaaaccg

SEQ ID NO: 291032 - DNA, 628 bp, Homo sapiens
  misc_feature: GYAE6OF01E2D0B.11.1.A01.1.454.CMB.1.raw
  modified_base (180)..(180): a, c, t, g, unknown or other
  misc_feature (180)..(180): n is a, c, g, or t
tcagcgagagataccacgaccggtgctcgatttagacgtctcatcaggggaggggcagttggtagatgcccctctgggagagatccccaggggtgacagccatggaccctggaagggcctgggctagggacagggaccagagccagtccagggagaggacagagccaatggactggggtntactgtaacagccctgctggcgagagggaccagggcaccgtcctccgagggacgcccatgctgcaagtcgggccagaggtcgcccctgaacctgaaggccaatgagaccaagacaggccaagtggttgtgacgacccgtgaggagcgtcgggcctggtcccgaggcagcgcgtcggccctgctgctgcgtgggtctggccagtcggtccgcccgagtcggcctgccgtcggccgtcccgtaagttcggttcgcgaccgaccgaaacggccgggacccacggacccgtgggaccgtccgtacgtacggttacggaacgtacgacgtccgactaccgacgccgtcggaccggtacgacccggttgggtcggggtcgtacgggtccgaccggaccccgaaaccggtacccccgaaaccccgtaccgttacccgtccgtaccgttaccccgg

SEQ ID NO: 291033 - DNA, 849 bp, Homo sapiens
  misc_feature: GYAE6OF01DLC84.11.1.A01.1.454.CMB.1.raw
  modified_base (234)..(234): a, c, t, g, unknown or other
  misc_feature (234)..(234): n is a, c, g, or t
tcagcgagagataccacgaccggtgctcgatttagacgtctcatcaggggaggggcagttggtagatgcccctctgggagagatccccaggggtgacagccatggaccctggaagggcctgggctagggacagggaccagagccagtccagggagaggacagagccaagtggacgtggggtgtactgtaacagccctgctggcgagaggaccagggcaccgtcctcgagggacncccatgctgcgaacggtccgggaccaggaggtccgaccccgtagaaccgtaggaacggccaaagtcggaacgaacccgaagaaccgacggaccgtaagggttggggttacggtacggaacggtacccccgttagggaacgggacggtccggttcggggtccccgttcgggtaccccgagggccgacggccggtccgtccgggcccccgttggccgttcggccgttggtccggtttcggggtccgttacgggacccgtacgggttccgggtcccgaccccgtacggttccgggtcccgttcggtaccgttccggaccgtacccgttaacggttccgggttacgacccgtaacccggtaaccgggaaaccggggaccccggggaaccccgacgggtaccccgtacgggtaacccgtcccgttacgggtaacgggttacgggaaaccggccggaaccggtacccgaaccgttacccggacggtacccggtacgggacccgggtacggtcccggttcgggggtacggggaccgtacggggtacccgaacccgggtaccccgaaaccccgggtacccctaaaccccgtacgtttaccgtaccccgtccggtttacccccg

SEQ ID NO: 291034 - DNA, 560 bp, Homo sapiens
  misc_feature: GYAE6OF01ELXY6.11.1.A01.1.454.CMB.1.raw
  modified_base (391)..(391): a, c, t, g, unknown or other
  misc_feature (391)..(391): n is a, c, g, or t
  modified_base (396)..(396): a, c, t, g, unknown or other
  misc_feature (396)..(396): n is a, c, g, or t
  modified_base (405)..(405): a, c, t, g, unknown or other
  misc_feature (405)..(405): n is a, c, g, or t
  modified_base (451)..(451): a, c, t, g, unknown or other
  misc_feature (451)..(451): n is a, c, g, or t
  modified_base (456)..(456): a, c, t, g, unknown or other
  misc_feature (456)..(456): n is a, c, g, or t
  modified_base (490)..(490): a, c, t, g, unknown or other
  misc_feature (490)..(490): n is a, c, g, or t
  modified_base (551)..(551): a, c, t, g, unknown or other
  misc_feature (551)..(551): n is a, c, g, or t
tcagcgagagataccacgaccggtgctcgatttagacgtctcatcaggggaggggcagttggtagatgcccctctgggagagatccccaggggtgacagccatggaccctggaagggcctgggctagggacagggaccaggagccagtccagggagaggacagagccaaatggactggggtgtactgtaacagccctgctggcgagagggaccaggggcaccgtcctccgagggacgcccatgcctgccaagtccgggccaggacggtgcccctgaaccctgaacggccaatgacgaccaagacaggccaaaggtcgggttgtgacgacccgtgacggacgcgtgggccctggtcccagggcagcgctcggccctgctgctgctggctgcntggcnccagtcgcncgctgcgccagtcggtcgctacgcgaacgccgggaccacgacccgnggacncgtcgagtaggacgcgacgccgatccgacgtccngcggacgccggtggtcgggcgaggtccgacggacccgaacgcccaaacccgactccgtacnccgttaccg

SEQ ID NO: 291035 - DNA, 644 bp, Homo sapiens
  misc_feature: GYAE6OF01AO3IK.11.1.A01.1.454.CMB.1.raw
  modified_base (180)..(180): a, c, t, g, unknown or other
  misc_feature (180)..(180): n is a, c, g, or t
  modified_base (233)..(233): a, c, t, g, unknown or other
  misc_feature (233)..(233): n is a, c, g, or t
  modified_base (256)..(256): a, c, t, g, unknown or other
  misc_feature (256)..(256): n is a, c, g, or t
  modified_base (261)..(261): a, c, t, g, unknown or other
  misc_feature (261)..(261): n is a, c, g, or t
tcagcgagagataccacgaccggtgctcgatttagacgtctcatcaggggaggggcagttggtagatgcccctctgggagagatccccaggggtgacagccatggaccctggaagggcctgggctagggacagggaccagagccagtccagggagaggacagagccaatggactggggtntactgtaacagccctgctggcgagagggaccagggcaccgtcctccaggggcncccatgctgcaaggtcgggcagnggtcncccctgaacctgaaggccaatgagaccaagacaggccaagtgggttgtgagcccctgaggagcgtgggccctggtcccaggcacgcgcgtcgcccctgctgctgcgtggtcgtggcctagtcggtccgcccgagtcggccgtcgccgtcggccgccccgtaagttcggttacgccgtaacccgacgtaaacgggcccggggaacccacgggacccctcgggaaccgcccgtacgtacggttacggaggtaccgacggtcccgaagttccccgacgcccgtcgggccgggacggtcccgtgggtcggggacccacggggtcccacggtaacccccgaaccgggacccccaaaccccgtaccgtacgtcccgtccgttaccccgg

SEQ ID NO: 291036 - DNA, 613 bp, Homo sapiens
  misc_feature: GYAE6OF01DR5LR.11.1.A01.1.454.CMB.1.raw
  modified_base (180)..(180): a, c, t, g, unknown or other
  misc_feature (180)..(180): n is a, c, g, or t
  modified_base (257)..(257): a, c, t, g, unknown or other
  misc_feature (257)..(257): n is a, c, g, or t
  modified_base (262)..(262): a, c, t, g, unknown or other
  misc_feature (262)..(262): n is a, c, g, or t
  modified_base (604)..(604): a, c, t, g, unknown or other
  misc_feature (604)..(604): n is a, c, g, or t
tcagcgagagataccacgaccggtgctcgatttagacgtctcatcaggggaggggcagttggtagatgcccctctgggagagatccccaggggtgacagccatggaccctggaagggcctgggctagggacagggaccagagccagtccagggagaggacagagccaatggactggggtntactgtaacagccctgctggcgagagggaccagggccaccgtcctcgagggacgcccatgctgcaagtcgggccagnggtcnccctgaacctgaacggccaatgagacccaagacaggccaagtgggttgtgagacccgtgaggagcgtgggccctggtcccaggcagcgctggcccctgctgctggctgggtctcggctagtcggtcgcctagtcggcctcgccgtcgccgtacccgtaagtcggttacgaccgtacccggacgtaaacgggcccggggaaccccacggaccccggtagggaccgtcccgtcgaaggttacgggaacgccgaacggccgaacgtccgacgccgtacggcggacgtcggtcgggtcgggcgacggtccgacgcccgaacggacccaaaccccgcgtaccgtccncgttacccg

SEQ ID NO: 291037 - DNA, 676 bp, Homo sapiens
  misc_feature: GYAE6OF01DOYFC.11.1.A01.1.454.CMB.1.raw
  modified_base (233)..(233): a, c, t, g, unknown or other
  misc_feature (233)..(233): n is a, c, g, or t
tcagcgagagataccacgaccggtgctcgatttagacgtctcatcaggggaggggcagttggtagatgcccctctgggagagatccccaggggtgacagccatggaccctggaagggcctgggctagggacagggaccagagccagtccagggagaggacagagccaaatggactggggtgtactgtaacagccctgctggcgagaggaccagggcaccgtcctccagggacncccatgctgcaagtccgggccaggacggtcgcccctgaacccgtgaaggccaaatgagacccaaagacacggaccaaggtgggttggtacgagaccccgtggaggacgcgttcgggccctcgggtcccaggcagccgctcggccccgtgctgcgtgcgtgggtctcggccagtcggtccgccgacgtcggccgtgccgttgccgcccgtaaattcggttcgcctaccggacaaacgggcccgggaacccgtacgaaccccggtacggacgtcccgtaccgtaggttacgggaacggtccgaacgaccgtacgtacccgaacgtcccgcggacggtccggaccggttcgggtacgggggacccacggggttacccgaccggtacccccgaaaccgggacccccgtaaacccccggaactcccggtaacccacccgtttccccgg

SEQ ID NO: 291038 - DNA, 771 bp, Homo sapiens
  misc_feature: GYAE6OF01EU6AN.11.1.A01.1.454.CMB.1.raw
  modified_base (182)..(182): a, c, t, g, unknown or other
  misc_feature (182)..(182): n is a, c, g, or t
tcagcgagagataccacgaccggtgctcgatttagacgtctcatcaggggaggggcagttggtagatgcccctctgggagagatccccaggggtgacagccatcggaccctggaagggcctgggctagggacagggaccagagccagtccagggagaggacagagccaatggacgtggggtntactgtaacacgccctgctggcgaggagggaccgagggccacccgtcctccgagggacgcccatcgctgcaaggtcggccaggacggtcgccccgtgaaccctggaacggcccaaagtcgaacgaacccgaaagaccgacggacccaagggttcgggttgtacggacgaccccgtggacggacggccgtcgggcccttcgggtcccgaaggtccgacggccgccgtcggccccgtgccgtcggaccgtggcggttcgggtccgtacgggccctaggttccggtacccgtcccgtaggtccgggtcctccggtcgtccggccgtacccgtaggttcggtacgaccgaccgtaccggaaccgggcccgggaacccctacggaccccgtggacccgtccgtcggtaacggttccggaacgtaccgaccggtcccgtacgtaccccgaacggtcccgtgggacccgggtacggtccggtttcgggggaccgggtaccgggtaccgggtacccgaacccgggtaacccccgaaccccgggtaacccccgtaacccgtacccgtacccggtttccccgccgttttaccccccggg

SEQ ID NO: 291039 - DNA, 891 bp, Homo sapiens
  misc_feature: GYAE6OF01CUJ59.11.1.A01.1.454.CMB.1.raw
  modified_base (184)..(184): a, c, t, g, unknown or other
  misc_feature (184)..(184): n is a, c, g, or t
  modified_base (194)..(194): a, c, t, g, unknown or other
  misc_feature (194)..(194): n is a, c, g, or t
tcagcgagagataccacgaccggtgctcgatttagacgtctcatcaggggaggggcagttggtagatgcccctctgggagagatccccgaggggtgacagccatggaccctggaagggcctgggctagggacagggaccagagccagtccgagggagaggacagagccaagtggacgtggggtntactgtaacngccctgctggcgagagggaccagggcaccgtcctccgagggacgcccagtcgctgccaaggtcgggaccaggacggttcgcccccgtaggaacccgtacggaacggacccgaaagtacggaacgaacccgaaaggaaccgaacgggtacccgtaaaagggttcggggtttacggtacggaaaccggtaaccccccgtaggaaccgggtaacggcccggttaccgggggtccccccgtttacggggttaccccccgaacggggacccgtaaccgggcccggtccggtttcccggggccccccgttggcccgtttcggccgttcgggtcccggttcgggggtccgtacgggtcccgtaaggttccgggtccgaccccggtacgtccggggtccccgtcgggtccgtccgggtacccgaccccgtaaagggtttcgggttaccggacccgtaacccggaccggaaaccgggcccggggaaccccgacgggaacccggtcgggaaccgtcccgtacggtacgggttaacgggaacgacccggtaacggcccgtacgtacccgaacggtccccggtaggacccggtaaccgggtcccggttacggggtccgggggaccctacggggttcccgaccgggaacccccgtaaaccgggacccccaaacccccgtacggttcccgtaccctaccggtttacccccg

SEQ ID NO: 291040 - DNA, 641 bp, Homo sapiens
  misc_feature: GYAE6OF01AOONC.11.1.A01.1.454.CMB.1.raw
  modified_base (239)..(239): a, c, t, g, unknown or other
  misc_feature (239)..(239): n is a, c, g, or t
  modified_base (276)..(276): a, c, t, g, unknown or other
  misc_feature (276)..(276): n is a, c, g, or t
  modified_base (522)..(522): a, c, t, g, unknown or other
  misc_feature (522)..(522): n is a, c, g, or t
tcagcgagagataccacgaccggtgctcgatttagacgtctcatcaggggaggggcgagttggtagatgcccctctgggagagatccccaggggtgacagccatggaccctggaagggcctgggctagggacagggaccaggagccagtccagggagaggacagagccaagtggactggggtgtactgtaacagccctgctgggcgaggacgggacagggcaccgtcctccgagggacncccatgcctggacctaaggtccgggccaaggaggtcncccccgtacgaaccgtggaacggcccaaatgacgaaccgaagacacggaccaaggttgggttcgtaggacgaccccgtaggaggacggcgtcggggccctagggtcccgaggccgacgccgcgtcggcccctgacctggctcggcgtgggtctacggcctagtcggtcgcccgtgtccgcgtcgcgtcgccgaccgtacgtcgtcgcgacgacgacggccgggaccacggacccgcgacgcgtcgngtacggagcgcgaccggctaccggacgccgtcggaccggcggtaccgtcgggtcggggcgcggaccggtccggaccgtacggacccgtacccggaccccgtcggtcccgtacgttcccg

SEQ ID NO: 291041 - DNA, 669 bp, Homo sapiens
  misc_feature: GYAE6OF01BSSUS.11.1.A01.1.454.CMB.1.raw
  modified_base (180)..(180): a, c, t, g, unknown or other
  misc_feature (180)..(180): n is a, c, g, or t
tcagcgagagataccacgaccggtgctcgatttagacgtctcatcaggggaggggcagttggtagatgcccctctgggagagatccccaggggtgacagccatggaccctggaagggcctgggctagggacagggaccagagccagtccagggagaggacagagccaatggactggggtntactgtaacagccctgctggcgagagggaccagggcaccgtcctccaggggacgcccatgctgcaaggtcgggccaggaggtcgcccctgaacctgaacggccaatgaagacccaagacacggccaagtgggttgtgagacccccgtaggaggacggcgtcgggcccctcgggtccccagggtccaggtcggaccgtcggcccctgctgcctggcgtgggtactcgggcctagtcggtcgcccgtagtcggtccgtgccgtcgccgacccgtaagttcggttccgaccgtaacccgaccgaaaccgggccggggaaccccgtacggaacccgtcgggaccgtaccgtaccgaaggttacggaacgtccgacgtccgactccgacgccgtggcggtccgaccggtcggtcggggtcgacgggtaccgaccggaccccgaaacggtcccccgaaacccccgtacgttacccgtcccgtaccgtttccccgg

SEQ ID NO: 291042 - DNA, 819 bp, Homo sapiens
  misc_feature: GYAE6OF01A92SD.11.1.A01.1.454.CMB.1.raw
tcagcgagagataccacgaccggtgctcgatttagacgtctcatcaggggaggggcagttggtagatgcccctctgggagagatccccagggtgacagccatggaccctggaagggcctgggctagggacagggaccagagccagtccagggagaggacagagccaaatggacgtggggtgtactgtaacagccctgctggcgagagggaccagggccaccgtcctccgaggggacgcccatcgctgaccgaagtcgggccaggacggtcgccccctgaaacccgtggaacggcccaaagtcggaacgaacccgaaagaccgacggacccgaaaggttcgggtttacggtaggaaccggtaccccccgtagggaacggggtaaccgccggttacggggccccccgtcgggttacccccgaagggccgaacgggcccggccggttccgggccccccgtggcccttcggtccgttcgggtcccggttggggttacctcgggccgtacgggttccggtcccgaccccggtacggtcgggtcccgtcggtaccgtccggacccgacccgttaaggttccgggttacgacccgtaacccggaccggtaaacccggggcccgggggaaacccccctacgggaaccccccggtagggacccgtacccgttacggtaacgggttaacgggacggtaccgacgggtacccacggtacccaccggtccggtcggaccggaccggtccggtacggggtcggggaccgtacgggtccgaaccggcccgaaacccggacccctaacccgacgtcgtcccgtaccttccccgg

SEQ ID NO: 291043 - DNA, 735 bp, Homo sapiens
  misc_feature: GYAE6OF01CYQH1.11.1.A01.1.454.CMB.1.raw
  modified_base (182)..(182): a, c, t, g, unknown or other
  misc_feature (182)..(182): n is a, c, g, or t
  modified_base (678)..(678): a, c, t, g, unknown or other
  misc_feature (678)..(678): n is a, c, g, or t
  modified_base (715)..(715): a, c, t, g, unknown or other
  misc_feature (715)..(715): n is a, c, g, or t
tcagcgagagataccacgaccggtgctcgatttagacgtctcatcaggggaggggcagttggtagatgcccctctgggagagatccccaggggtgacagccatggaccctggaagggcctgggctagggacagggaccagagccagtccagggagaggacagagccaagtggacgtggggtntactgtaacagccctgctggcgagacgggaccagggccacccgtcctaccgagggacgcccatcgctgcgaaggtccgggccaggacggtccgaccccgtagaacccgtggaaacggaccaaagtcggaacgaacccaaaggaacccgtaacgggacccgtaaagggttggggtttacggtacggaaccggacccccgttagggaacgggtacggtacccggttccggggcccccgttacgggtacccccgagggacccgccgggtccgccggttacccggcccccgtggcccgtttcggccgttcggtcggtcgggttccgtcggaccgtcgtcggtcccgaccgtagtccggtcgtcgcgtcgacccgtccgtagttcggtcaccgtacgaccgaacggtcccgggacccacgacccgtggacctacgtcgtaacgtggaacgtcgacgcctacgccgacgtccgcggaccggccgtaggtcgggccgggtacncgggtaccacccgggaccaccggacccctaaccccgngtaccctccgccttaccccg

SEQ ID NO: 291044 - DNA, 664 bp, Homo sapiens
  misc_feature: GYAE6OF01A9R0C.11.1.A01.1.454.CMB.1.raw
  modified_base (229)..(229): a, c, t, g, unknown or other
  misc_feature (229)..(229): n is a, c, g, or t
  modified_base (278)..(278): a, c, t, g, unknown or other
  misc_feature (278)..(278): n is a, c, g, or t
  modified_base (390)..(390): a, c, t, g, unknown or other
  misc_feature (390)..(390): n is a, c, g, or t
  modified_base (453)..(453): a, c, t, g, unknown or other
  misc_feature (453)..(453): n is a, c, g, or t
tcagcgagagataccacgaccggtgctcgatttagacgtctcatcaagggaaggaaggggcagcaagatggtgttgcagacccaggtcttcatttctctgttgctctggatctctggtgccgaacggggacatcgtgatcgacccagtctccagacttcctatttgtatctcgtgggacgaggagggcccacatacaactgacgaaggcaagccaagtatttattttanacagtctaccgaacaagtaacgaacttacttatcgtttcggtaccaaanaacgaaaccaggacacgtcctaactaaattactctatttactccatctacttagcggcgggcccgtcccggggacccacgtatcgacgtggcgtacgggcgggtactagganacgttacgttcactacctagaactagtacagcaacgcctgacagactagagtgttggtagttntttaatcttacgactaattattcttactttcggttacgtttaccgtttagttaccgggagggtaacgggtaccgtaggggtagtacgtaacgaacgtaaagtacgtcggtaaacggtcctaacggtaccctaacgtttacggtccctttaggttacccttagtttaccccttccccggtaccgttaccctatttcccgggtaggtttaacc

SEQ ID NO: 291045 - DNA, 666 bp, Homo sapiens
  misc_feature: GYAE6OF01BX0GQ.11.1.A01.1.454.CMB.1.raw
  modified_base (220)..(220): a, c, t, g, unknown or other
  misc_feature (220)..(220): n is a, c, g, or t
  modified_base (231)..(231): a, c, t, g, unknown or other
  misc_feature (231)..(231): n is a, c, g, or t
  modified_base (301)..(301): a, c, t, g, unknown or other
  misc_feature (301)..(301): n is a, c, g, or t
tcagcgagagataccacgaccggtgctcgatttagacgtctcatcaagggaaggaaggggcagcaagatggtgttgcagacccaggtcttcatttctctgttgctctggatctctggtgccgaacggggacatcgtgatgacccagtctccagacttcctatttgtatctcgtgggcgagacggccaccatcaactgcaaggcaagccagatttatttanacagctccganagtaagaacttacttatcttggtaccaacagaaaccaggacagcctacctaaatactctatttactccanatctagtgccggtccgtcccgggtccccacgtattcgaggtcggcaggtccgggtctacgggaccagttactttccacgttcctacaacgaactccgacgtccgaacgtcccgttaggacgtaacgaccgtaggaaacggtacgttagggttcgggtttaaccgttttaatttaacgttcggttaactaaacttaaacgtttagttttccttacgtttttacggttttacccgttttaaaggtttccgggacgggtaacgggtaaccgtaaggggttaggaagttaacgtacgaaacgtgtacggtgtcgtacgactaccgtattcgtgttcctataccttccgtccccattacttcgtgtaacg

SEQ ID NO: 291046 - DNA, 962 bp, Homo sapiens
  misc_feature: GYAE6OF01E2K1H.11.1.A01.1.454.CMB.1.raw
tcagcgagagataccacgaccggtgctcgatttagacgtctcatcaaaggaaggaaggggcagcaagatggtgttgcagacccaggtcttcatttctctgttgctctggatctctggtgccaacgggacatcgtgatgacccagtctccagacttcctatttgtatctcgtgggcgaggacggccaccatcaactgacaaggcaagccagtatttatttatacagtcctaccgactaagtaaagaacttacttaatctttcggttaccaaacaacgaaaccaggaaccacgcccttaaccttaaaattacctctaattttactaccacatcttatcgggaccgggtccccgtcccggggtccccgaccgtattcgaaggtcggcgtacgggccggggtcggtaggaacctagtacttttaccacgttcctaccaactaaagtccgaacggccctaacggtccctacggaccgtaaacggtaaccgttaaggaaacgttacggtttacgggggttacggggttttaaaccttttttaagttttaacggtttaaccgttaaccctaaaaacgttttaaacgtttaacgttttttaacccgtttttccgtttttttacccgggtttttttaaaaccccgggttttttaaggtttttaacccggggggtaaccggggggttaaaacccgggggttaaacccgggttaaaaggggggtttaccggggtaaaaaccggttaaaccgggttttaaaaacccccgggaaaaaaaccgggggtttaaccccgggtttagggttaccggggttaaacccgttacgggtaaaacccccccgttaaacccgtttaggtttttaacccccgttagggtttttaacccccttttaacccgtaaaccccgtttttccccccggttttaaccccccgtaaccgtttacccgtttacccgggttaacgtttaaacccgg

SEQ ID NO: 291047 - DNA, 724 bp, Homo sapiens
  misc_feature: GYAE6OF01E5KCR.11.1.A01.1.454.CMB.1.raw
tcagcgagagataccacgaccggtgctcgatttagacgtctcatcaggggaggggcagttggtagatgcccctctgggagagatccccaggggtgacagccatcggaccctggaaggcctgggctagggacagggaccagagccagtccagggagaggacagagccaaagtggacgtggggtgtactgtaacagccctgctggcgagagggaccaggggccaccgtcctccgaggggacgcccatcgctgacgaacggtcgggaccaggaggtcgcccctggaacctggaacggccaagtcgaacgacccaagacaggccgaagtcgggtagtcgacgacccgtgaggacgcgtacgggcccgttggcccgaggcacgccggccgtccggcccccgtgcgtcgccgtggtccgtcgggtccgtggccgtagttcggcgcccgtagtcggccgtcgcgtcgtaccgtcccaaggttcggtcgaccgaacccggtaccgaaacgggcccgggaacccgaaccggtaccccgtacgggaccgtacccgtacggaacgggtttacgggaacgtccgaacgtcccgaaccgttccgacgtcccgtacgggaccggtaccggtaccggtcggggtccgggtacggtaccggggtacccaccgggaccccggaaacccgggtaccccgtaacccccgtaaccgttccgtaccccgtcggtttaaccccccg

SEQ ID NO: 291048 - DNA, 725 bp, Homo sapiens
  misc_feature: GYAE6OF01CTIG9.11.1.A01.1.454.CMB.1.raw
  modified_base (101)..(101): a, c, t, g, unknown or other
  misc_feature (101)..(101): n is a, c, g, or t
  modified_base (267)..(267): a, c, t, g, unknown or other
  misc_feature (267)..(267): n is a, c, g, or t
tcagcgagagataccacgaccggtgctcgatttagacgtctcatcgagggggaggggcagttggtagatcgcccctcgtgggagagactccccgaggggtnacagccagtcggacccgtgggaagggcctgggacgtagggacagggaccagacgccagtaccgagggagaggacagacgaccaagtggacgtggggtatactagtaacacgtcccgtgcgtgggacggaggacgggaccgagggccacccgtccgacgacgggacncccgagtcgcgtacgacgaacggccggaccgaggacggtccgacccgtagaaccgtaggaacggactaatacggaacgaccgaaagacgacggaccgtaaggtcgggttgacggacgacccgtaggacggacggtccggtcggccgtcggtaccgacggacgacggccgccgtccggccgtcgcgtcgcgttgccggtcggtcgtcggtctggtaccggtcgaccgtcgtcgccgtcgacgtccgtcctacgtacgttccggtacgaccggtacgaacccggtacggacccgggtaccgaccggtaccggcggtacaccggtagttacggacgggactaccggacgtaccgacgtacccgagtacccggcgtaccgggcgcggttcgggacgggtccgtaaggcccgaccggacccgtaaccgacccgaacccgtagtccgtcccgtccgttaccccg

SEQ ID NO: 291049 - DNA, 975 bp, Homo sapiens
  misc_feature: GYAE6OF01EMHUY.11.1.A01.1.454.CMB.1.raw
  modified_base (608)..(608): a, c, t, g, unknown or other
  misc_feature (608)..(608): n is a, c, g, or t
tcagcgagagataccacgaccggtgctcgatttagacgtctcatcgagggggaggggcagttggtagatcgcccctcgtgggagagactccccgaggggtgacacgccagtcggacccgtaggaaggcccgtgggcgtagggacgacgggaccagacgccgacgtaccggaagggaggaggacgaaggacgaccgaagtggacgttggggtacgtacgttagtaacaccggcccgtgacgtcgggacggaacggaccggggaaccggacgggcctaccccggtacccgtaccggaacggggaccaccccgagtcgaccgtcgaccggtaacgggtccgggaccgagggtaccggtccgtaccccgtacggaacccgtagggaacgaccgtaacgacggtaccgaaaccgaacggaccgaacggacgtaacggttggggttacgaggtacccgtacccggtaggaccgggtacggtcccggtccggtccccggttacgggacccgacggtaccgaccgtccgggaccgtcccggtacccgtcggtccggtccgtacggtcggtaccggttcgggtaccggtcggtaacccggtgggttacccggtaccncccggttcggtaccggcggttacccgccgtacggcccgtacccggttacggtcggtaaccggacccgtaaccgggaacccggtaacccgggtaccccgggacccgttaacccggaacccggtccggtacccggtacgttacggtaacggtaccggaccgtccggtaacccgtaccggtacccgaccggtacccggtaggtacccgggtcccgggttacgggtccgggttaaccgggggtccgggttaacgggtaacccgggtaccccgggtaacccccgggaaacccggtaaccccccggtaaccccccgttaacggttccccggtttaaccgggttaccccgtttcccgggttaacccccccgggg

SEQ ID NO: 291050 - DNA, 892 bp, Homo sapiens
  misc_feature: GYAE6OF01BFX2S.11.1.A01.1.454.CMB.1.raw
  modified_base (240)..(240): a, c, t, g, unknown or other
  misc_feature (240)..(240): n is a, c, g, or t
tcagcgagagataccacgaccggtgctcgatttagacgtctcatcagggggaggggcagttggtagatgcccctctgggagagactccccgagggggtgacagccatcggaccctggaagggcctgggctagggacagggaccagagccagtccgagggagaggacagagccaatggacgtggggtgtactgtaacagtcccgtgcgtggcggaggacgggaccgagggccacccgtccnccgaggggacgcccatcgcgtgacgaacggtcgggaccgaggcggtacgtccccacgaaccgtacggaacggaccgaagtacggaacgaacccgaaggaccgaacggaccggtaaaggttcggggttggtacggaaccggtaccccgtaggaacgggacggccggtcggggtaccccgtccgggtacccgaacgggtccgaacggccggcccggtaccggcccgtcgccgtcggtccgtcggtccggttcgggttcccgtcggtacccggtacgttcccgggtacccggtccccggtacgtccggggtcccgttccgggtacccgttccgggtaacccggttaccccgttaacggtttccggggttaccgaccccgggtaaacccggaaccggggaaaccccggggttacccgggggaaccccccggtaaacccgggtaccccggtacgggacccggtaaccggttacgggttaaccggttaacggggaccgacggtaccggtacccgggaccttaccggaccgtccgggtacgggaccgggtcccggtcccgggtgggtacccgggtaggtacccgggaccggacccggacccggtaaacccccggacccgtaacccggtaccttacccggtcccgttacccttaccccgg

SEQ ID NO: 291051 - DNA, 701 bp, Homo sapiens
  misc_feature: GYAE6OF02H7N9T.11.1.A01.1.454.CMB.1.raw
tcagcgagagataccacgaccggtgctcgatttagacgtctcatcaggggaggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtggttgtgagacccctgaggagctgggccctggtcccaggcagcgctggccctgctgctgctggtctggccagtggtcgcccagtcggcctgctcgcgccctaagtcggttcgccaccggcaaacggcccggggaacccacggaccccgtcgggacgacccgttccgaaggtttcgggaaacggtccgaaccggacccggaacgttcccccgaaacgggtaccccgttggggaccccgggtaccgggtaccccggtttacgggggtccgggggggtacccggtaacgggggtttaccccgaaccggggttacccccccggaaaacgggggtacccccccaaaaccccccccggaacccggtttaccgggttaccccccgtaacccgttttaaccccccggg

SEQ ID NO: 291052 - DNA, 572 bp, Homo sapiens
  misc_feature: GYAE6OF02IYINH.11.1.A01.1.454.CMB.1.raw
  modified_base (254)..(254): a, c, t, g, unknown or other
  misc_feature (254)..(254): n is a, c, g, or t
tcagcgagagataccacgaccggtgctcgatttagacgtctcatcaggggaggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcggccagnggtgcccctgacctgaaggccaatgagaccaagacaggccaagtggtgtgagacccctgaggagctgggccctggtcccaggcagcgctggcccctgctgctgcgtggtctggccagtcggtcgcccgagtcggcctggcctgccgtcccaagtcggttcgccgaccgcgaaacggcgggacccgacggacccgtgacgcctcgacggttcgaacgaccgacgccgaacgtccgacgcccgtcggccggagtccgtcggtcggggcgtacgggtcgacgacccgacggacccgaacccgacctcgtccaccgttcccg

SEQ ID NO: 291053 - DNA, 637 bp, Homo sapiens
  misc_feature: GYAE6OF02I6YAZ.11.1.A01.1.454.CMB.1.raw
  modified_base (180)..(180): a, c, t, g, unknown or other
  misc_feature (180)..(180): n is a, c, g, or t
  modified_base (338)..(338): a, c, t, g, unknown or other
  misc_feature (338)..(338): n is a, c, g, or t
  modified_base (364)..(364): a, c, t, g, unknown or other
  misc_feature (364)..(364): n is a, c, g, or t
tcagcgagagataccacgaccggtgctcgatttagacgtctcatcaggggaggggcagttggtagatgcccctctgggagagatccccaggggtgacagccatggaccctggaagggcctgggctagggacagggaccagagccagtccagggagaggacagagccaatggactggggtntactgtaacagccctgctggcgagagggaccagggcaccgtcctccagggacgcccatgctgcaagtcggccagaggtgccccgaactgaaggccaatgacgaccaagacaggccaaggtgggttgtgacgaccctggaggagctgggccctggtccngcagcgctggcccctgccgtgtccgngcgttacgggctcggcgtacgtcggtccggacccagttcggcctcgctcgcgtaccccgagtaggttcgacgaccgaccggtaaacggaccggggtacccaacggacccgtggaacgccgtaccgtaggttcgggaacgccgaggacccgactccgaacgtccggtcgaccgggtacgccggtggtacggggccgtaacgggtccgacggtacccgaaacccgggtaccctaaccccggtaccttaccggtacccacgttacccttaccccgg

SEQ ID NO: 291054 - DNA, 538 bp, Homo sapiens
  misc_feature: GYAE6OF02FHG7K.11.1.A01.1.454.CMB.1.raw
  modified_base (232)..(232): a, c, t, g, unknown or other
  misc_feature (232)..(232): n is a, c, g, or t
  modified_base (526)..(526): a, c, t, g, unknown or other
  misc_feature (526)..(526): n is a, c, g, or t
tcagcgagagataccacgaccggtgctcgatttagacgtctcatcaggggaggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccagtcggtcgcccatcggcctgctgcgcccaatcggttgcgaccgcgaaacggcggggacccacgacccgtggacgccgtcgacgttggaagcagcccgatccagcctgcggagccgtggtcggggcagggtcacggcccaaggcccaacccnctcgtcactccg

SEQ ID NO: 291055 - DNA, 588 bp, Homo sapiens
  misc_feature: GYAE6OF02JQN0I.11.1.A01.1.454.CMB.1.raw
  modified_base (179)..(179): a, c, t, g, unknown or other
  misc_feature (179)..(179): n is a, c, g, or t
tcagcgagagataccacgaccggtgctcgatttagacgtctcatcaggggagggcagttggtagatgcccctctgggagagatccccaggggtgacagccatggaccctggaagggcctgggctagggacagggaccagagccagtccagggagaggacagagccaatggactggggtntactgtaacagcctgctggcgagaggaccagggcaccgtcctccagggagccatgctgcaagtcggcagagtgccctgacctgaaggccaatgagaccaagacaggccaagtggtgtgagaccctgaggagctgggccctggtcccaggcagcgctggccctgctgctgctgggtctggcctagtcgggtccgcccgtagtcggccgtgcgtcggccgcccgtaagtcggttacgccaaccggcgtaaacggccgggacccacggaacccgtgacgcctcgtacggtcggaacgccgacggccgacgtcccgagcccgtggaccggagtccggtgggtcggggccaacgggtccgaacggccccgtaacgggaccccaacccggtaccgtcggtaccgtaccgtacccg

SEQ ID NO: 291056 - DNA, 558 bp, Homo sapiens
  misc_feature: GYAE6OF02G1ZSB.11.1.A01.1.454.CMB.1.raw
  modified_base (181)..(181): a, c, t, g, unknown or other
  misc_feature (181)..(181): n is a, c, g, or t
  modified_base (233)..(233): a, c, t, g, unknown or other
  misc_feature (233)..(233): n is a, c, g, or t
tcagcgagagataccacgaccggtgctcgatttagacgtctcatcaggggaggggcagttggtagatgcccctctgggagagatccccagggggtgacagccatggaccctggaagggcctgggctagggacagggaccagagccagtccagggagaggacagagccaatggactggggtntactgtaacagccctgctggcgagagggaccagggcaccgtcctccagggancccatgctgcaaggtccgggccaggacggtcgcccctgaacctgaaggccaatgagacccaagacaggccaagtgggttgtgagacccctggagagctgggccctggtcccaggcagcgctggccctgctgctgctgggtctggccagtcggtcgcccatcggcctgctgccgccagtggtcgcaccgcaacggcgggacccagaccctggacgcctcgagttcgggaacgcgagaccgactccagcctcgcggacgcccgtggtcggggctacgggtcgaccgacccgaacggccccaacccgtactaccgtccacttccccgg

SEQ ID NO: 291057 - DNA, 679 bp, Homo sapiens
  misc_feature: GYAE6OF02I1K1E.11.1.A01.1.454.CMB.1.raw
  modified_base (232)..(232): a, c, t, g, unknown or other
  misc_feature (232)..(232): n is a, c, g, or t
  modified_base (260)..(260): a, c, t, g, unknown or other
  misc_feature (260)..(260): n is a, c, g, or t
tcagcgagagataccacgaccggtgctcgatttagacgtctcatcaggggaggggcagttggtagatgcccctctgggagagatccccaggggtgacagccatggaccctggaagggcctgggctagggacagggaccagagccagtccagggagaggacagagccaaatggactggggtgtactgtaacagccctgctggcgagagggaccagggcaccgtcctccagggngcccatgctgcaagtcggccaggagtcncccctgaacctgaaggccaatgagacccaagacaggaccaaagtgggttgtagagaccccgtagaggagacgtgggccctgggtaccccaggccaggcgctcggccccgtagcgtgcctggcgtaggttctcggcctaagtcgggtacgccccgtaacgtcggcccgtacgacgtcggaccgtacccgtaacgttcgggttacgccgtaaaccggaccgaaaccgggtaccgggaaccccgtaaccggaccccgtacgggaccgtccgtacgtaacggttaggaaacgtcgaacgaccgtactacccgacgtcccgtagaccggacgtaccggtacgggtccggggtacgaacggggtccaaccggacccgtaacgggaccccgaaaccccgacggtaccgtaccgtacccgttacccg

SEQ ID NO: 291058 - DNA, 661 bp, Homo sapiens
  misc_feature: GYAE6OF02GOPHL.11.1.A01.1.454.CMB.1.raw
  modified_base (180)..(180): a, c, t, g, unknown or other
  misc_feature (180)..(180): n is a, c, g, or t
  modified_base (235)..(235): a, c, t, g, unknown or other
  misc_feature (235)..(235): n is a, c, g, or t
  modified_base (392)..(392): a, c, t, g, unknown or other
  misc_feature (392)..(392): n is a, c, g, or t
tcagcgagagataccacgaccggtgctcgatttagacgtctcatcaggggaggggcagttggtagatgcccctctgggagagatccccaggggtgacagccatggaccctggaagggcctgggctagggacagggaccagagccagtccagggagaggacagagccaatggactggggtntactgtaacagccctgctggcgagagggaccagggccaccgtcctccgagggacncccatgctgcagtcggcagcggtcgccctgacctgaacggccaatgacgaccaagacaggccaagtgggttgtgacgacccgtgaggagcgtgggcccgtggtcccgaggcagcgctcggccctggctgctgcgtggtcgtgcgtgtcggtcgccgngtcggccgtgccgtcgccgtacccgagtcgggtcgccgtaacccggaccggaaacgggcccggggaacccaccgggaccccggtcggaccggtacccgttacggtacgggttaacggacggtaccgaacggcccgtaacgtcccgacggaccgtcgggaccggtacgtccggtcggggtcgggaccggtacgggtacccgaccggtaccccgaaaccggtaccccccgaaaccccgtacgtttcccggtacccgtaccgttacccccgg

SEQ ID NO: 291059 - DNA, 628 bp, Homo sapiens
  misc_feature: GYAE6OF02IXVNL.11.1.A01.1.454.CMB.1.raw
  modified_base (180)..(180): a, c, t, g, unknown or other
  misc_feature (180)..(180): n is a, c, g, or t
  modified_base (233)..(233): a, c, t, g, unknown or other
  misc_feature (233)..(233): n is a, c, g, or t
  modified_base (254)..(254): a, c, t, g, unknown or other
  misc_feature (254)..(254): n is a, c, g, or t
tcagcgagagataccacgaccggtgctcgatttagacgtctcatcaggggaggggcagttggtagatgcccctctgggagagatccccaggggtgacagccatggaccctggaagggcctgggctagggacagggaccagagccagtccagggagaggacagagccaatggactggggtntactgtaacagccctgctggcgagagggaccagggcaccgtcctccgagggcncccatgctgcaagtcggcagngtcgccctgaacctgaacggccaatgacgacccaagacacggaccaaggtgggtgtggacgaccccgtggacggagcgtcgggcccttgggtcccgaggccaggcggccgtcggcccctggcctcgctggcgtagggtcctcggccgagtcgggtccgcccgtagtcggtccgtcgctcggccgccgtagtcgggtcgaccgaccgacggaaacggccgggaacccacgacccgtgggacgtccgtacggaggttcggaacgcgaacggccgaacgtccgtacggccgtacggccggacgtccggtgggtacgggcgtacggtaccgaccgaccgaaccggacccaacccgtcgtacgtccctaccgttcccgg

SEQ ID NO: 291060 - DNA, 728 bp, Homo sapiens
  misc_feature: GYAE6OF02HODPN.11.1.A01.1.454.CMB.1.raw
  modified_base (231)..(231): a, c, t, g, unknown or other
  misc_feature (231)..(231): n is a, c, g, or t
tcagcgagagataccacgaccggtgctcgatttagacgtctcatcaggggaggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggngcccatgctgcaagtcgggccaggaggtgccctgaacctgaaggccaatgacgacccaagacaggccgaaagtcgggttgtcggagacccctgacggagcgtcgggcccgtggtcccacggcagcgcgtcggccctgctgcgtgcgtgggtctggccagtcggtcgcccgtagtcggccgtgtcgtcgccgacccgtaacgtcgggtttcgaccgacccggtacggaaaccggcggggtaacccccacgggaaccccgtcgggaccgtacccgtaccggtacggttacggggtaaacgcccgtaaacgggacccggtaaccgtccccggtaaacggtccccgttacggggaccccgggtacgggttacccgggttaccggggttaccggggggtacccgtaacgggggttacccgaaccgggtaacccccggtaaaacggacccccggaaaccccccggttaccgttacccggtacccgaaccccgttttaacccgg

SEQ ID NO: 291061 - DNA, 629 bp, Homo sapiens
  misc_feature: GYAE6OF02G60AZ.11.1.A01.1.454.CMB.1.raw
  modified_base (180)..(180): a, c, t, g, unknown or other
  misc_feature (180)..(180): n is a, c, g, or t
  modified_base (308)..(308): a, c, t, g, unknown or other
  misc_feature (308)..(308): n is a, c, g, or t
tcagcgagagataccacgaccggtgctcgatttagacgtctcatcaggggaggggcagttggtagatgcccctctgggagagatccccaggggtgacagccatggaccctggaagggcctgggctagggacagggaccagagccagtccagggagaggacagagccaatggactggggtntactgtaacagccctgctggcgagagggaccagggcaccgtcctccagggagcccatgctgcaagtcggccagaggtgcccctgaacctgaacggccaagtgagacccaagacaggccaagtgggttntagacgaccccgtgaggtagctgggccctggtcccaggcagcgctcggccctgctgctgctgggtctggcctagtcggtccgacctagtcggcctcgcgtcgccgcccgtaagtggttcgcctaccgacgaaacggccgggaccccaggacccgtaggaccggacctacgacggttagggaacgtccgacggacccgagttcccgacgccgtacggaccggacgtccggtagggtcggggaccacggggtccgaacccggtcccgaaaacccgggtccccaaaacccccggtcgtttaccggtacctacccgttaccccgg

SEQ ID NO: 291062 - DNA, 678 bp, Homo sapiens
  misc_feature: GYAE6OF02JO29W.11.1.A01.1.454.CMB.1.raw
  modified_base (181)..(181): a, c, t, g, unknown or other
  misc_feature (181)..(181): n is a, c, g, or t
  modified_base (234)..(234): a, c, t, g, unknown or other
  misc_feature (234)..(234): n is a, c, g, or t
  modified_base (617)..(617): a, c, t, g, unknown or other
  misc_feature (617)..(617): n is a, c, g, or t
tcagcgagagataccacgaccggtgctcgatttagacgtctcatcagggggaggggcagttggtagatgcccctctgggagagatccccaggggtgacagccatggaccctggaagggcctgggctagggacagggaccagagccagtccagggagaggacagagccaatggactggggtntactgtaacagccctgctggcgagagggacagggcaccgtcctccgagggacncccatcgctgacaggtccgggccaggacgtcgaccccgtgaaccgtgaacggtccaagtgacgaccgaagaacgaggaccaacggtgggttagtgaacggaccccgtaggacgggtagaccgtacgggcccctcgggtacccgaggcgacggcgtaccgcggccctggctcggctggcgtcggtcttggcctagtcggtccgccgtacgtcgggctacggccgtcgaccgtccgtaaggtcgttaacggcgtaacccgacggaaaccgggccgggaacccacggtacccggaggtaccgccgttacgacgggttacgaacggcgtaccggaccgttaacgcccgacggccgtacggccggtacgccggtaggtcggggtaccngggtaacccacgtaacccggacgtacccgaccgttaccggacgtaccgtaaccgttcccgg

SEQ ID NO: 291063 - DNA, 649 bp, Homo sapiens
  misc_feature: GYAE6OF02FW3XV.11.1.A01.1.454.CMB.1.raw
  modified_base (155)..(155): a, c, t, g, unknown or other
  misc_feature (155)..(155): n is a, c, g, or t
  modified_base (182)..(182): a, c, t, g, unknown or other
  misc_feature (182)..(182): n is a, c, g, or t
  modified_base (236)..(236): a, c, t, g, unknown or other
  misc_feature (236)..(236): n is a, c, g, or t
  modified_base (256)..(256): a, c, t, g, unknown or other
  misc_feature (256)..(256): n is a, c, g, or t
tcagcgagagataccacgaccggtgctcgatttagacgtctcatcaggggaggggcagttggtagatgcccctctgggagagatccccgaggggtgacagccatggaccctggaagggcctgggctagggacagggaccagagccagtccagggngaggacagagccaaatggactggggtntactgtaacagccctgctggcgagagggaccagggcaccgtcctccgagggacnccatgctgcaagtcggcagngtcgccctgacctgagccaatgagaccaagacagccaagtggttgtgacgacccgtggacggagcgtcggccctggtcccgaggcgagccgcgtcggcccctgctcgcgtcgcgtcggtcgtcggccgtagtccggtccgcccgacgtcggtccgtggtccgtcggcccgtcccgtaagttcggttcgacccgtaccggaccgtaaacgggaccgggaaccctacggacccgtacgggaccgccgttacgaacggttacggacgtaccgacggtcccgacgtcccgacggtccgtacgggacgaccggtccgcgggtcggggaccgaccggttccgaccgaacccgaaccggacccgtaaaccccgaccgtaccgtacccgtacgtttccccg

SEQ ID NO: 291064 - DNA, 859 bp, Homo sapiens
  misc_feature: GYAE6OF02GGMWI.11.1.A01.1.454.CMB.1.raw
  modified_base (183)..(183): a, c, t, g, unknown or other
  misc_feature (183)..(183): n is a, c, g, or t
  modified_base (216)..(216): a, c, t, g, unknown or other
  misc_feature (216)..(216): n is a, c, g, or t
tcagcgagagataccacgaccggtgctcgatttagacgtctcatcaggggaggggcagttggtagatgcccctctgggagagatccccagggggtgacagccatggaccctggaagggcctgggctagggacagggaccagagccagtccagggagaggacagagccaaatggactgggggtntactgtaacagccctgctggcgaggacggacgnggacctacccgtccaccggagggaccacccgtagtcgcgtacgacgacgggtccggacgaaggtacgggtccgtcccgtacggaaccgaggtaacggaacctaagtacggaaccgaacccgtaagaccgacggaccgtagggttagggtacgtacgggacccgtcccgtagggaacggtacggtaccgggtccgggtacccgtccgggtacccggacggacgaccggtcgccgtcccggtccgtagtcctcggtcgcgggtacgttcgggtacggtacgccgtaacggttccggccgaccgtacggtccggtcgaggtccgtacgcccggtacctacgggttcggtacccgtacccgaaccgaaccggggaaccgggttaacccgggacccgggtaaccggtacccggtaccggggaccctttaacccgggtacggttaaccgggtaccgggtaaccgaccggtaacccgggttaacccggaaccgttacccggaacggttccgggtccgggtaacccgggtcccgggttaacggggtcccgggttacggggtccggaaccgggttccggaaccccgggtaacccggtaccccggtaaaccccgacccgtccccggttaccggaccttacccggttaccccgg

SEQ ID NO: 291065 - DNA, 783 bp, Homo sapiens
  misc_feature: GYAE6OF02GDDNH.11.1.A01.1.454.CMB.1.raw
  modified_base (215)..(215): a, c, t, g, unknown or other
  misc_feature (215)..(215): n is a, c, g, or t
  modified_base (250)..(250): a, c, t, g, unknown or other
  misc_feature (250)..(250): n is a, c, g, or t
  modified_base (759)..(759): a, c, t, g, unknown or other
  misc_feature (759)..(759): n is a, c, g, or t
tcagcgagagataccacgaccggtgctcgatttagacgtctcatcgaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaagcaagcagattatttanacagctcgacagtaagactacttatcttgtccaanagaaccagacacgctactaaatactactatttactccacatactagtcggacgggtcccgtcccgggggtaccccgtacccgtagttcaacggtcgggaccgtacggccgggggttccgtaggggtaacccgtaggtactttaccgtaccgttaccgttcaacctaaagtaccacggtccaaggtccccgtgaaccacgtaacgttacgggaaaatgtttccggggttagggtttaaccgttttaagtttacgttacggtaacccgtaaatttaaacttacggttttacctttacgtttttaccgggttttaacccggtttttttaaagggtttacccggggaaccggggggttaaccggtaaaccggggttaaacggggttagggtaaccgtaagttaaaccccggtaaaacgggtaacgttcggggtacgggtactacggggtaccctaacccgtaagtttcccgttaactttccgttacccgttagttcccccgtttaaccccggnttaccttcgggtaactttaccggg

SEQ ID NO: 291066 - DNA, 785 bp, Homo sapiens
  misc_feature: GYAE6OF02FOE1K.11.1.A01.1.454.CMB.1.raw
tcagcgagagataccacgaccggtgctcgatttagacgtctcatcaagggaaggaaggggcagcaagatggtgttgcagacccaggtcttcatttctctgttgctctggatctctggtgccaacgggacatcgtgatgaccagtctcagtacttcctatttgtatctcgtcgggcgagacgggtcccaaccgattacaacctgaccgaaaggcaaggccaagtacttttaattttagacacgacctacccgaacgtaagtaacgtaaccttaactttattccgttcggttaccaaaccgtacgaaaaccaacggtaacacgtacccttaaccttaaaattacctactaattttaacttccaaccgtattacctaaagtcggccgggtccccggttaccccgggggtaccccgtacccgtacgttacctacggttacgggctacgggtcggggttcttaggggaccgtaaggtaactttaccggaacctttccgtaccaactaagttaccaacgtacgaaccgtcccgtagacgtaaccgtaacgtacgaaagtacgttggttacgggtacggttttacttaacgttcgtaagtaaaccttaacttacgtttactttaccgtttacgttttaccgtttttaacgttcgggttacggtacggtaacgtaagggtaggtagtaacgtaacgaacgtaacgttacgtaggtaccgtacgtaccgtacgtacgtaccgtactttccgttaacgtacttacccgttcccgtaactcttcgttacgttaacg

SEQ ID NO: 291067 - DNA, 748 bp, Homo sapiens
  misc_feature: GYAE6OF02I0V3G.11.1.A01.1.454.CMB.1.raw
  modified_base (182)..(182): a, c, t, g, unknown or other
  misc_feature (182)..(182): n is a, c, g, or t
  modified_base (238)..(238): a, c, t, g, unknown or other
  misc_feature (238)..(238): n is a, c, g, or t
tcagcgagagataccacgaccggtgctcgatttagacgtctcatcaggggaggggcagttggtagatgcccctctgggagagatccccaggggtgacagccatggaccctgggaagggcctgggctagggacagggaccagagccagtccagggagaggacagagccaagtggactggggtntactgtaacagccctgctggcgagagggaccagggccaccggtcctacgacgggcncccatgctcgacgaagtcgggaccaggacggtcgccccgtagaaccgtagaacggaccaagtcgaacacccgaaagacacgggaaccaaggttcgggttagtcggaacgtaccccggtaggacgggaacgtccggtcgggtcccctagggtccccagggacctagggcccgtccgttaccgggccccttgggccgtcgtacccgttcgggacggttcggggttcccgtacgggtcccgtagttccgggtccccgaccgtagggttccggtcccgtacggtccgtccggcccgacccggtaacgttacggtacggtacccgaaccggaaccggtaaaccgggaccgggtaaccccgaccggtacccgtacggtaccgtaccgtcgtaaggtacggacgacgacgacccgaacttaccgacgtaccggcgacggtacggtacgtcgggtcggacgtacggtacgacggacccgaaccgaccgtaacccgtaccgtactccgtaccgtcccgg

SEQ ID NO: 291068 - DNA, 702 bp, Homo sapiens
  misc_feature: GYAE6OF02FUPUI.11.1.A01.1.454.CMB.1.raw
  modified_base (180)..(180): a, c, t, g, unknown or other
  misc_feature (180)..(180): n is a, c, g, or t
  modified_base (236)..(236): a, c, t, g, unknown or other
  misc_feature (236)..(236): n is a, c, g, or t
  modified_base (262)..(262): a, c, t, g, unknown or other
  misc_feature (262)..(262): n is a, c, g, or t
tcagcgagagataccacgaccggtgctcgatttagacgtctcatcaggggaggggcagttggtagatgcccctctgggagagatccccaggggtgacagccatggaccctggaaggcctgggctagggacagggaccaggagccagtccagggagaggacagagccaatggactggggtntactgtaacagccctgctggcgagacgggaccagggcaccgtcctccgaggggacncccatgactgacaaggtccggcaagnggtcgcccctgacctggaacgccaatacgacgacccaagtacacggacctaagggtcgggttagtcggaacgtaccccgtagggaacggtacggtacgtcgggaccccgtgggtccccacggccgacgcggtccctcgggtccccgtggtcctcgaccgtcggcgttcgggtccgtcggtcctaggtccggttccgacccgtaggtccggtccttcggccgtacggccgtaccccgtaagtcgggttacacccgtaccggaacgaccgggacccggaccgaaccggtccgtaccgggacgtaccgtacggtacgggtacgacggtccgacgccgtaccgccgacgtacggtcgccggacgtcggtcgggtcgggaccgtacgggtacccgaccgacccgaaccggcccgtaacccgtagtccgtaccgtaccgttccccg

SEQ ID NO: 291069 - DNA, 773 bp, Homo sapiens
  misc_feature: GYAE6OF02HLV7A.11.1.A01.1.454.CMB.1.raw
tcagcgagagataccacgaccggtgctcgatttagacgtctcatcagggggaggggcagttggtagatgcccctctgggagagatccccgagggggtgacagccatggaccctggaagggcctgggctagggacagggaccagagccagtccaggagaggacagagccaagtggactggggtgtactgtaacagccctgcgtggcgaggacgggaccagggccaccgtcctccgagggctcccgatcgctgcaacggtccggccagacggtcgcccctagtaacccgtaggaacggacccaagtaggaaccgaacccaaacggaccgaaggacccgaaacggggttagggttacggtacggtaccggtaccccggtaggagggtacgtacgggccgggtccccgtcgggtaccccgtgggaccgtaccgccggtccgtccggcccccgttagggtcctcgggtccgtacggtcggtcggggtccgtcgggtaccctacggtccggtacccgccgtacggtttccggcgtcccggtcgtcggtaccgcccgttaaggttcggtcgggaacccgtacccgggaacgaacccgggtaaccgggaaccccgacgggttacccgacgggtaccgtacctcggaacgttacgggacgaccgtacgtacccgtacgtaccgccggtcgacggcgtaccggtcggtacggtcggggacctggggacctacggacccgaaccgtcccgaacccggtaccgtacgtacccgtcttaccccggg

SEQ ID NO: 291070 - DNA, 689 bp, Homo sapiens
  misc_feature: GYAE6OF02ILLHW.11.1.A01.1.454.CMB.1.raw
  modified_base (189)..(189): a, c, t, g, unknown or other
  misc_feature (189)..(189): n is a, c, g, or t
tcagcgagagataccacgaccggtgctcgatttagacgtctcatcaggggagggcagttggtagatgcccctctgggagagatccccaggggtgacagccatggaccctggaagggcctgggctagggacagggaccagagccagtccagggagaggacagagccaatggactggggtgtactgtaacngccctgctggcgagagggaccagggcaccgtcctccgagggacgccccatcgctcggcaaggtccgggccgaggacgggtcgccccgttcgaaccttaggaacggacccaagtcggaacgaaccccaaagacgacggaccgaaacggttgggttggtaggaccggaccccgtaggacggagcggtcggcccgtcggtcccgacggcgacgccgcgcggtcccgtcgcgtcggcgtcgtacgtcggtcgtcggtccgtcggtccggtcccgccgtacgtcggccgtcgccgtcggccgtacccgtagttccggtacgacccgtaaccgacggtaaccgggacccggaacccgcgtaaccgtcgggaccgtcgtaccgttagtacgggaacgtcgacgtaccgaccgtaccgacgccgacggcgcggtccgtcgggcgggacgtcggtaccgccggtaacccgacccgacccgtaccccgagtaccctccgtaccgttcccg

SEQ ID NO: 291071 - DNA, 246 bp, Homo sapiens
  misc_feature: GYAE6OF01EZBIT.13.26.C04.1.454.CMB.1.raw
  modified_base (243)..(246): a, c, t, g, unknown or other
  misc_feature (243)..(246): n is a, c, g, or t
tcagtcacgtactacacgaccggtgctcgatttagtctagcgactttgggtttgggggaggtgtgtcacaagatttgggctcagggaaccctggtcaccgtctcctcagcttccaccaagggcccatcggtcttcccctggcgccctgctccaggagcacctctgggggcacagcggccctgggctgcctggtcaaggactacttcctagtacgtgactgagcgggctggcaaggcgcatagnnnn

SEQ ID NO: 291072 - DNA, 223 bp, Homo sapiens
  misc_feature: GYAE6OF02FXCQ9.13.26.C04.1.454.CMB.1.raw
  modified_base (220)..(223): a, c, t, g, unknown or other
  misc_feature (220)..(223): n is a, c, g, or t
tcagtcacgtactacacgaccggtgctcgatttagtctagcgactttgggtttggggccagggagccctggtcaccgtctcctcagcctccaccaagggcccatcggtcttcccctggcaccctcctccaagagcacctctgggggcacagcggccctgggctgcctggtcaaggactacttcctagtacgtgactgagcgggctggcaaggcgcatagnnnn

SEQ ID NO: 291073 - DNA, 250 bp, Homo sapiens
  misc_feature: GYAE6OF02F9FN2.13.26.C04.1.454.CMB.1.raw
  modified_base (242)..(250): a, c, t, g, unknown or other
  misc_feature (242)..(250): n is a, c, g, or t
tcagtcacgtactacacgaccggtgctcgatttagtctagcgactttgggtttgggggaggtgtgtcacaagatttgggctcagggaaccctggtcaccgtctcctcagcttccaccaagggcccatcggtcttcccctggcgccctgctccaggagcacctctggggcacagcggccctgggctgcctggtcaaggactacttcctagtacgtgactgagcgggctggcaaggcgcatagnnnnnnnnn

SEQ ID NO: 291074 - DNA, 281 bp, Homo sapiens
  misc_feature: GYAE6OF01EI3JA.1.38.D05.1.454.CMB.1.raw
  modified_base (258)..(281): a, c, t, g, unknown or other
  misc_feature (258)..(281): n is a, c, g, or t
tcagacgagtgcgtcacgaccggtgctcgatttagtatctgatagttgggtttgggacagagttcaccctcaccatcagcagcctgcagtctgaagattttgcagtttattactgtcagcagtacaatgactggccccagcgtacacttttggccaggggaccaagctggacatcatccgaactgtggctgcaccatctgtcttcatcttcccgccatctgatctctcgactctgagcgggctggcaaggcgcatagnnnnnnnnnnnnnnnnnnnnnnnn

SEQ ID NO: 291075 - DNA, 263 bp, Homo sapiens
  misc_feature: GYAE6OF01B00NJ.1.38.D05.1.454.CMB.1.raw
  modified_base (259)..(263): a, c, t, g, unknown or other
  misc_feature (259)..(263): n is a, c, g, or t
tcagacgagtgcgtcacgaccggtgctcgatttagtatctgatagttgggtttgggacagagttcaccctcaccatcagcagcctgcagtctgaagattttgcagtttattactgtcagcagtacaatgactggcccccagcgtacacttttggccaggggaccaagctggacatcatccgaactgtggctgcaccatctgtcttcatcttcccgccatctgatctctcgactctgagcgggctggcaaggcgcatagnnnnn

SEQ ID NO: 291076 - DNA, 263 bp, Homo sapiens
  misc_feature: GYAE6OF01CZG5N.1.38.D05.1.454.CMB.1.raw
  modified_base (258)..(263): a, c, t, g, unknown or other
  misc_feature (258)..(263): n is a, c, g, or t
tcagacgagtgcgtcacgaccggtgctcgatttagtatctgatagttgggtttgggacagagttcaccctcaccatcagcagcctgcagtctgaagattttgcagtttattactgtcagcagtacaatgactggccccagcgtacacttttggccaggggaccaagctggacatcatccgaactgtggctgcaccatctgtcttcatcttcccgccatctgatctctcgactctgagcgggctggcaaggcgcatagnnnnnn

SEQ ID NO: 291077 - DNA, 258 bp, Homo sapiens
  misc_feature: GYAE6OF01DEYG7.1.38.D05.1.454.CMB.1.raw
  modified_base (257)..(258): a, c, t, g, unknown or other
  misc_feature (257)..(258): n is a, c, g, or t
tcagacgagtgcgtcacgaccggtgctcgatttagtatctgatagttgggtttgggacagagttcaccctcaccatcagcagcctgcagtctgaagattttgcagtttattactgtcagcagtacaatgactggccccagcgtacacttttggccaggggaccaagctggacatcatccgaactgtggctgcaccatctgtcttcatcttccgccatctgatctctcgactctgagcgggctggcaaggcgcatagnn

SEQ ID NO: 291078 - DNA, 265 bp, Homo sapiens
  misc_feature: GYAE6OF01DY2LC.1.38.D05.1.454.CMB.1.raw
  modified_base (258)..(265): a, c, t, g, unknown or other
  misc_feature (258)..(265): n is a, c, g, or t
tcagacgagtgcgtcacgaccggtgctcgatttagtatctgatagttgggtttgggacagagttcaccctcaccatcagcagcctgcagtctgaagattttgcagtttattactgtcagcagtacaatgactggccccagcgtacacttttggccaggggaccaagctggacatcatccgaactgtggctgcaccatctgtcttcatcttcccgccatctgatctctcgactctgagcgggctggcaaggcgcatagnnnnnnnn

SEQ ID NO: 291079 - DNA, 273 bp, Homo sapiens
  misc_feature: GYAE6OF01DS3Z2.1.38.D05.1.454.CMB.1.raw
  modified_base (260)..(273): a, c, t, g, unknown or other
  misc_feature (260)..(273): n is a, c, g, or t
tcagacgagtgcgtcacgaccggtgctcgatttagtatctgatagttgggtttgggacagagttcaccctcaccatcagcagcctgcagtctgaagattttgcagtttattactgtcagcagtacaatgactggcccccagcgtacacttttggcctaggggaccaagctggacatcatccgaactgtggctgcacatctgtcttcatccttcccgcatctgatctctcgactctgagcgggctggcaaggcgcattagnnnnnnnnnnnnnn

SEQ ID NO: 291080 - DNA, 263 bp, Homo sapiens; identical to SEQ ID NO: 291075
  misc_feature: GYAE6OF01DU0EQ.1.38.D05.1.454.CMB.1.raw
  modified_base (259)..(263): a, c, t, g, unknown or other
  misc_feature (259)..(263): n is a, c, g, or t

SEQ ID NO: 291081 - DNA, 262 bp, Homo sapiens
  misc_feature: GYAE6OF01A5VPI.1.38.D05.1.454.CMB.1.raw
  modified_base (259)..(262): a, c, t, g, unknown or other
  misc_feature (259)..(262): n is a, c, g, or t
tcagacgagtgcgtcacgaccggtgctcgatttagtatctgatagttgggtttgggacagagttcaccctcaccatcagcagcctgcagtctgaagattttgcagtttattactgtcagcagtacaatgactggcccccagcgtacacttttggccaggggaccaagctggacatcatccgaactgtggctgcaccatctgtcttcatcttcccgccatctgatctctcgactctgagcgggctggcaaggcgcatagnnnn

SEQ ID NO: 291082 - DNA, 261 bp, Homo sapiens
  misc_feature: GYAE6OF01AW2B4.1.38.D05.1.454.CMB.1.raw
  modified_base (257)..(261): a, c, t, g, unknown or other
  misc_feature (257)..(261): n is a, c, g, or t
tcagacgagtgcgtcacgaccggtgctcgatttagtatctgatagttgggtttgggacagagttcaccctcaccatcagcagcctgcagtctgaagattttgcagtttattactgtcagcagtacaatgactggccccagcgtacacttttggccaggggaccaagctggacatcatccgaactgtggctgcaccatctgtcttcatcttcccgcatctgatctctcgactctgagcgggctggcaaggcgcatagnnnnn

SEQ ID NO: 291083 - DNA, 262 bp, Homo sapiens; identical to SEQ ID NO: 291081
  misc_feature: GYAE6OF02HJ3BT.1.38.D05.1.454.CMB.1.raw
  modified_base (259)..(262): a, c, t, g, unknown or other
  misc_feature (259)..(262): n is a, c, g, or t

SEQ ID NO: 291084 - DNA, 256 bp, Homo sapiens
  misc_feature: GYAE6OF02GH4LS.1.38.D05.1.454.CMB.1.raw
  modified_base (254)..(256): a, c, t, g, unknown or other
  misc_feature (254)..(256): n is a, c, g, or t
tcagacgagtgcgtcacgaccggtgctcgatttagtatctgatagttgggtttgggacagagttcaccctcaccatcagcagcctgcagtctgaagatttgcagtttattactgtcagcagtacaatgactggccccagcgtacactttggccagggaccaagctggacatcatccgaactgtggctgcaccatctgtcttcatcttccgccatctgaacgcactcgtctgagcgggctggcaaggcgcatagnnn

SEQ ID NO: 291085 - DNA, 265 bp, Homo sapiens
  misc_feature: GYAE6OF02H65Z8.1.38.D05.1.454.CMB.1.raw
  modified_base (256)..(265): a, c, t, g, unknown or other
  misc_feature (256)..(265): n is a, c, g, or t
tcagacgagtgcgtcacgaccggtgctcgatttagtatctgatagttgggtttgggacagagttcaccctcaccatcagcagcctgcagcctgaagattttgcaatttattactgtcaacagtattatagtacccctacgtggacgttcggccaggggaccaaggtggaagtcaaccgaactgtggctgcaccatctgtcttcatcttcccgccatctgaacgcactcgtctgagcgggctggcaaggcgcatagnnnnnnnnnn

SEQ ID NO: 291086 - DNA, 262 bp, Homo sapiens
  misc_feature: GYAE6OF02G4I40.1.38.D05.1.454.CMB.1.raw
  modified_base (258)..(262): a, c, t, g, unknown or other
  misc_feature (258)..(262): n is a, c, g, or t
tcagacgagtgcgtcacgaccggtgctcgatttagtatctgatagttgggtttgggacagagttcaccctcaccatcagcagcctgcagtctgaagatttgcagtttattactgtcagcagtacaatgactggcccccagcgtacacttttggccaggggaccaagctggacatcatccgaactgtggctgcaccatctgtcttcatcttcccgccatctgatctctcgactctgagcgggctggcaaggcgcatagnnnnn

SEQ ID NO: 291087 - DNA, 268 bp, Homo sapiens
  misc_feature: GYAE6OF02HH3KC.1.38.D05.1.454.CMB.1.raw
  modified_base (259)..(268): a, c, t, g, unknown or other
  misc_feature (259)..(268): n is a, c, g, or t
tcagacgagtgcgtcacgaccggtgctcgatttagtatctgatagttgggtttgggacagagttcaccctcaccatcagcagcctgcagtctgaagattttgcagtttattactgtcagcagtacaatgactggcccccagcgtacacttttggccaggggaccaagctggacatcatccgaactgtggctgcaccatctgtcttcatcttcccgccatcgatctctcgactctgagcgggctggcaaggcgcaatagnnnnnnnnnn

SEQ ID NO: 291088 - DNA, 261 bp, Homo sapiens
  misc_feature: GYAE6OF02FEZ4U.1.38.D05.1.454.CMB.1.raw
  modified_base (257)..(261): a, c, t, g, unknown or other
  misc_feature (257)..(261): n is a, c, g, or t
tcagacgagtgcgtcacgaccggtgctcgatttagtatctgatagttgggtttgggacagagttcaccctcaccatcagcagcctgcagtctgaagattttgcagtttattactgtcagcagtacaatgactggcccccagcgtacactttggccaggggaccaagctggacatcatccgaactgtggctgcaccatctgtcttcatcttccgccatctgatctctcgactctgagcgggctggcaaggcgcatagnnnnn

SEQ ID NO: 291089 - DNA, 263 bp, Homo sapiens
  misc_feature: GYAE6OF02HZKJI.1.38.D05.1.454.CMB.1.raw
  modified_base (259)..(263): a, c, t, g, unknown or other
  misc_feature (259)..(263): n is a, c, g, or t
tcagacgagtgcgtcacgaccggtgctcgatttagtatctgatagttgggtttgggacagagttcaccctcaccatcagcagcctgcagtctgaagattttgcagtttattactgtcagcagtacaatgactggcccccagcgtacactttggccaggggaccaagctggacatcatccgaactgtggctgcaccatctgtcttcatccttcccgccatctgatctctcgactctgagcgggcgtggcaggcgcatagnnnnn

SEQ ID NO: 291090 - DNA, 325 bp, Homo sapiens
  misc_feature: GYAE6OF02H234E.1.38.D05.1.454.CMB.1.raw
  modified_base (266)..(267): a, c, t, g, unknown or other
  misc_feature (266)..(267): n is a, c, g, or t
  modified_base (271)..(272): a, c, t, g, unknown or other
  misc_feature (271)..(272): n is a, c, g, or t
  modified_base (274)..(274): a, c, t, g, unknown or other
  misc_feature (274)..(274): n is a, c, g, or t
  modified_base (276)..(276): a, c, t, g, unknown or other
  misc_feature (276)..(276): n is a, c, g, or t
  modified_base (281)..(325): a, c, t, g, unknown or other
  misc_feature (281)..(325): n is a, c, g, or t
tcagacgagtgcgtcacgaccggtgctcgatttagtatctgatagttgggtttgggacagagttcaccctcaccatcagcagcctgcagtctgaagattttgcagtttattactgtcagcagtacaatgactggcccccagcgtacacttttggccaggggaccaagctggacatcatccgaactgtggctgcaccatctgtcttcatccttccccgcctatctgactcgtctcgactctgaggcggctggcaaggcgcatacggnncgannantnactgnnnnnnnnnnnnnnnnnnnnnnnnnnnnnnnnnnnnnnnnnnnnn

SEQ ID NO: 291091 - DNA, 621 bp, Homo sapiens
  misc_feature: GYAE6OF01D5X08.13.38.D05.1.454.CMB.1.raw
tcagtcacgtactacacgaccggtgctcgatttagtatctgatagttgggtttgggggggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtcgtggggggggcttggttaagcctggggggtccctcagactctcctgtgcaacctctggattcattttctctgaccgtcctggttgagtcgtgggtccgccgaggccgtccccggggaaggggccgtgggaggttggggttcggccgtaagttaaaggtagaagacagtggtacgacaacagactacagtcgtcccgtagaaggcagattcactactctacaagagatagaactacgaaaaagaatagaattatatactagactaaatcgaaaccaaccgtaagaaaacgtcggaagaacaacgagggtacgttagtattaccgtagtaaccagagacgtcgggaccagtactcggaacaaaggtcggaccgcggaacgacgttaccgacgtacgggtggggacccggtaacgg

SEQ ID NO: 291092 - DNA, 659 bp, Homo sapiens
  misc_feature: GYAE6OF01AQKK8.13.38.D05.1.454.CMB.1.raw
  modified_base (455)..(455): a, c, t, g, unknown or other
  misc_feature (455)..(455): n is a, c, g, or t
tcagtcacgtactacacgaccggtgctcgatttagtatctgatagttgggtttgggggggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtcgtgggggggcttggttaagccgtgggggtcctcgagactctcctgtgcaacctctggtattctattttctctgaccgtcctggttgagcgtcggggtcccgccgacgggtccgtaccggggaacggggcgtgggaggttggggttacggccgttaagttaaaggtagaagacagtgggtacggaacaacgagactaacgaggttcgttacccggtagaaaggcaagacttacactatctacgaaganatagaactaacgaaaaagtaatagtaataagtactactaagaactaaaatacgaaaacctaaccgtaaaggaaaacgtacggaaacggtaaccaacgaggtccgtagtaacttacgtacgtaccagtagagtcggacagagtcgaacgtaagtcggaccgacggacgtacggtaccgaacgttcgggcggggtacccggtaacg

SEQ ID NO: 291093 - DNA, 692 bp, Homo sapiens
  misc_feature: GYAE6OF01CQX40.13.38.D05.1.454.CMB.1.raw
  modified_base (278)..(278): a, c, t, g, unknown or other
  misc_feature (278)..(278): n is a, c, g, or t
tcagtcacgtactacacgaccggtgctcgatttagtatctgatagttgggtttgggggggagaggagccccagccttgggattcccaagtgttttcattcagtgatcaggactgaacacagaggactcaccatggagtttgggctgagctggattttcctcgctgcttaattttaaaaggtgtccagtgtgaggtgcaagtggtggagtcgtgggggggcttggtaagccgtgggggtccctcgagactctcctgtcgacaacctcgtggattcagtntttgatgagtatggcatacacgtcgggtcccgacctaaccctccggaagggggacgggctggcgaggtcgggtctcgtaggtaacgtaaacgtgggtaagtgggtacgaccagccaactaacttagtcgacgtacgtacctcgtaggtacggaaacgggtcctacttaccacctacttcctaccgaggacgaacctaggtccgaccgaacgtaacccgttccgaactactactacgaacaacgtacgactacggtcgtacgggtaacgtccggaacggtaccgtaccggtttacctttagttcgtttcgttgggtaggtaccgggtagggttacgcggtagggttcggttcgttaccggtacctttaacgacgttagtccggggtaaccggtcgggttaccgggggaaacccgg

SEQ ID NO: 291094 - DNA, 817 bp, Homo sapiens
  misc_feature: GYAE6OF01BJXYX.13.38.D05.1.454.CMB.1.raw
  modified_base (482)..(482): a, c, t, g, unknown or other
  misc_feature (482)..(482): n is a, c, g, or t
  modified_base (554)..(554): a, c, t, g, unknown or other
  misc_feature (554)..(554): n is a, c, g, or t
  modified_base (563)..(563): a, c, t, g, unknown or other
  misc_feature (563)..(563): n is a, c, g, or t
  modified_base (724)..(724): a, c, t, g, unknown or other
  misc_feature (724)..(724): n is a, c, g, or t
tcagtcacgtactacacgaccggtgctcgatttagtatctgatagttgggtttggggggagaggagcccagccttggattcccaagtgttttcattcagtgatcagactgaacacagacgactcacatggagtttgggctgagcgttggtattttcctcgtcctggtacttaaagtttttaaaaacggtcgtacctaggttggttggaagggttcgacggtaaggttgggtgggtacgggttccggggtggggggggtcctttaggggttaacggtccgggttcgggggtccctacgacggtaccttcgttacctgtcgaccgtaaccgttcgtaggtactttattactttctccgtgtaccgtccgttggttcgcgtcgttccgggacccgcgacgggtccggtaccgggggaggtcgtagggtggttcgggtacggtacgttaaaggttaaggaacgacgtagtacgttagggaccgaanaacgaacgtactacgtacgtcggttaaccgtaggaaacgtctaagtccttacgactaacttcgaagaaggtntaacggtanaactaaaacgtaaaagtattaataagttatagttacgaaataagaaactaacggtaaaccaaacgaaacgggaacgtaaccgggagtaacccgaggtaacgggttaccttaagtttaacccgttaccgttacggaaacccgaaggaagttacggaaccggntaaaggtacgtaacgaacggtacgtcgggaacccgtacgtaaccggttccgttaccgggaccggtacgggggtaccccgggtacgtaacccgg

SEQ ID NO: 291095 - DNA, 822 bp, Homo sapiens
  misc_feature: GYAE6OF01C5R3J.13.38.D05.1.454.CMB.1.raw
  modified_base (501)..(501): a, c, t, g, unknown or other
  misc_feature (501)..(501): n is a, c, g, or t
tcagtcacgtactacacgaccggtgctcgatttagtatctgatagttgggtttgggggggagaggagccccagccttgggattcccaagtgttttcattcagtgatcaggactgaacacagagactcacatggtagtttggctgagctgggtttttccttgttgacttaagttttaaaaggtcgccagtggtgaggtgcagtcgtggtgagtcgtgggaggacggtcttgactccgtacggccgggttggggggtcccctaggacgtccgttccgtacgtcggtcgacgaccgtccgttcggttcgggttaccctaccgtacgtaccgtaccaaccctaacccttaagactacgggacgtcccgggttaccggggtcccccgaacggtacgggtaccgtaaccgggggagggggtaacggggtcggtaggggtacggttacgtccgtttactttttacttttaacgttaagtaggttaggttgtaacgttactactaccgnaccgtacgtacgtaccggaggtaccgggtctacttccactcgtactaccggagtaaacgtacctaaactacccgaaacgaacctacggttcgtttaacgttactaaacgtagtaaccaaccgtacgtaccggtaaaggaaccgtacgaccggtaataccgggaaccggtccggtacgtttaacttaccggtttcgagggtaccgaaagggtacaaccggggtacgtacccggggtaaacccaaggtttaaacccggttcgtaccgtaacggtacggtccgggtacgtaccggggccgggtaaccggacgggttaacccccg

SEQ ID NO: 291096 - DNA, 894 bp, Homo sapiens
  misc_feature: GYAE6OF01BIPTQ.13.38.D05.1.454.CMB.1.raw
  modified_base (336)..(336): a, c, t, g, unknown or other
  misc_feature (336)..(336): n is a, c, g, or t
  modified_base (473)..(473): a, c, t, g, unknown or other
  misc_feature (473)..(473): n is a, c, g, or t
tcagtcacgtactacacgaccggtgctcgatttagtatctgatagttgggtttgggggggagaggagccccagccttgggattcccaagtgttttcattcagtgatcaggactagaacacaggagactcaccagtgggtaggtttgggcgtgagtcgtggttacttttcccgtcgtctgtactttaaagttttaaaaggtcgtaccgtagttgtaggtaggtgacgtaaggttggtggtaggtcgggtgggggggtctttagggtaacggtccgggttcgggggtccctacgaacgtcttcctcgtgtcacctaaccgtgtagtattcttatttcngtacgccgttcgtggtcgagtccggttccggcccgacgcgggtcccggaccgggggtaggtcggtagggtcgggttcgggtaccggtacgttaaaggtttaaaggaacgtaagaacgtacggtacgggaaccgaaanaacgtacgtaacgtaacgtaggttcccggtttacggaagaacggacgtaacttagtacctaatacgttaccagtaaaggactacgtacgtaaactaaaacgaaagtacgttactaattaacgtacttaacgaagtaaacgtaaacgttaaaccgaaacccgttaaaacggaaaggtaaacccggacggtaaaacgtaaccggaacggttaacggggttacttaaaacggtttaacctttaaaccggttaccgtaaaacccggaaggttaacgggacggttaaaccggacgtaaaggttacgttaaccggaaacggttaaccggaccccggggagtaaaccccgggtaaggtttaacccgggtaacccggtaaacccgggtttaccgggggaaaccccgggggtaacccggttaaacccggg

SEQ ID NO: 291097 - DNA, 229 bp, Homo sapiens
  misc_feature: GYAE6OF01APYBO.13.38.D05.1.454.CMB.1.raw
  modified_base (220)..(229): a, c, t, g, unknown or other
  misc_feature (220)..(229): n is a, c, g, or t
tcagtcacgtactacacgaccggtgctcgatttagtatctgatagttgggtttggggccagggaaccctggtcaccgtctcctcagcctccaccaaggcccatcggtcttccccctggcaccctcctccaagagcacctctgggggcacagcggccctgggctgcctggtcaaggactacttcctagtacgtgactgagcgggctggcaaggcgcatagnnnnnnnnnn

SEQ ID NO: 291098 - DNA, 571 bp, Homo sapiens
  misc_feature: GYAE6OF01C7C6Y.13.38.D05.1.454.CMB.1.raw
  modified_base (349)..(349): a, c, t, g, unknown or other
  misc_feature (349)..(349): n is a, c, g, or t
  modified_base (370)..(370): a, c, t, g, unknown or other
  misc_feature (370)..(370): n is a, c, g, or t
  modified_base (399)..(399): a, c, t, g, unknown or other
  misc_feature (399)..(399): n is a, c, g, or t
  modified_base (449)..(449): a, c, t, g, unknown or other
  misc_feature (449)..(449): n is a, c, g, or t
  modified_base (550)..(571): a, c, t, g, unknown or other
  misc_feature (550)..(571): n is a, c, g, or t
tcagtcacgtactacacgaccggtgctcgatttagtatctgatagtttgggttttgggctcaacttttcttgtccgccaggctcccgggaaggggctggagtgggttggcctttattaaaggtagaagacattgggtcgacaacagactacagtgttcccgtaggaaaggcagattcactatctcaagagatgactacaaaaagaatgatatatctgacaatagaaccaacctagaaaagcggaggacacgagcgtagtatacgtataccacaggcgtagggacagatacgaacaaggtcggaccgacgacgtacgttaccgacgtacgggtccgggggaccggtaacnccgtacggtcgcgtccgtccncctcgacgtcccaccgaaccggcggaccncgttccggtccccttcccggtcgcccaccctaccgacacgccgctaccgngggtacggccacggccgcccggtcgtcgggctccgcgttgacgtaaccgtcttacgttcgacgtcgacgcgtagcggtcggcgtacggcgacgcagatcgnnnnnnnnnnnnnnnnnnnnnn

SEQ ID NO: 291099 - DNA, 827 bp, Homo sapiens
  misc_feature: GYAE6OF01AOYHS.13.38.D05.1.454.CMB.1.raw
  modified_base (156)..(156): a, c, t, g, unknown or other
  misc_feature (156)..(156): n is a, c, g, or t
  modified_base (444)..(444): a, c, t, g, unknown or other
  misc_feature (444)..(444): n is a, c, g, or t
tcagtcacgtactacacgaccggtgctcgatttagtatctgatagttgggtttgggggggaggaggagccccagccttgggattcccaagtgtttcattcagtgatcaggactgaacacagaggactcaccatggagtttgggctggagcgtggtnttttcctcgctgtactaagttttaaagtgtccagtgtagcggtgacagtggtggagtcggtggggggtacttggtaaggccgttgggggtccctgagctctccgtgtcgaccacctcgttaggtacttctactttttcgcgttacgaccgtccttgggttagacggtcgttcggggtcccgaccgttagggcccgtaccggggaagggtccgtgggtacgttgggttaccggcgttaacgttaaggacggtagacgtaagtgggtacggacacgtaacgcgtaaacgnggttaccgttacccgaagaaacgggtacctaggactttacccaagtttacgaccgtcgaaaacgtgtagtaacgacttaaacggaaagtaagtagtaaacggttactcgttaagaaccgtaacggttaacaaagttaaaccccggtaaaccgaacggtaaaaggccgtaaacgggttaacccgaacggtaacggttaccggttaaagtaccccgtttaaaggttacaaaccccgacggtttaaaaggcccggtaaaggacccccgtaaaagtcgtaccggttaagaaacccgggttaacggcccgtttaaacccgggaaccggtttaacggtcccaaaacccggggttttggggtaaacccccgggccgggggtaaaaccccg

SEQ ID NO: 291100 - DNA, 701 bp, Homo sapiens
  misc_feature: GYAE6OF01BECOS.13.38.D05.1.454.CMB.1.raw
  modified_base (184)..(184): a, c, t, g, unknown or other
  misc_feature (184)..(184): n is a, c, g, or t
  modified_base (261)..(261): a, c, t, g, unknown or other
  misc_feature (261)..(261): n is a, c, g, or t
  modified_base (655)..(655): a, c, t, g, unknown or other
  misc_feature (655)..(655): n is a, c, g, or t
  modified_base (665)..(665): a, c, t, g, unknown or other
  misc_feature (665)..(665): n is a, c, g, or t
  modified_base (678)..(678): a, c, t, g, unknown or other
  misc_feature (678)..(678): n is a, c, g, or t
  modified_base (680)..(680): a, c, t, g, unknown or other
  misc_feature (680)..(680): n is a, c, g, or t
  modified_base (694)..(694): a, c, t, g, unknown or other
  misc_feature (694)..(694): n is a, c, g, or t
  modified_base (697)..(697): a, c, t, g, unknown or other
  misc_feature (697)..(697): n is a, c, g, or t
  modified_base (699)..(699): a, c, t, g, unknown or other
  misc_feature (699)..(699): n is a, c, g, or t
tcagtcacgtactacacgaccggtgctcgatttagtatctgatagttgggtttgggctcaactttcttgtccgccaggcgtcccgggaagggctggagtgggttggccgtattaaaggtagaagacatgggtcggacaacagactacagttgttcccgtagaaaggcagattacactatcctanaagagatgaactacaaaaagaatgaatatactcgtagacaaatacgaaacaacgtagaaaagcgaagaacacgtagngttacgtatacgtagtaaccatagacgtacgggacagaatgaacgaaagtcggaccgacgtacgacgttacgacgtacggccggggaacccggaagtccgtagtacgacggtacctcgtacctacgactaccccgtaccgaacggaaacgccctacgtcccggtaccctcccgtacgaccttaccccgccctaacgaacggactacccgtacccggagggtcggaccgaccggtacggccccgggttccggtacgggtccgtacggtacgttaccgtaacgtaacccgtaaccgtttaacccttacgttaccggtaacgtacgggtaacgtacggtaacgggtacccggtaggtacgggaaccgtaacggtaccgaggtaaccgtaagccgtanagtcctagcngcgagagtgacgncngacagacacacgancgngngc

SEQ ID NO: 291101 - DNA, 573 bp, Homo sapiens
  misc_feature: GYAE6OF02GMIRM.13.38.D05.1.454.CMB.1.raw
  modified_base (364)..(364): a, c, t, g, unknown or other
  misc_feature (364)..(364): n is a, c, g, or t
  modified_base (385)..(385): a, c, t, g, unknown or other
  misc_feature (385)..(385): n is a, c, g, or t
tcagtcacgtactacacgaccggtgctcgatttagtatctgatagttgggtttgggggggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtctggggggggcttggttaagcctggggggtccctcagactctcctgtgcaacctctggattcattttctctgacgcctggttgagctgggtccgccaggcctcccgggagggctggagtgggttggccgtattaaggtagaagacagtgggtcgganaacagactacagtgttcccgngaaaggcagattcactatctacaagagatgactacaaaaagaatgaatatatctagacaaatgaaacaacctagaaaagcgaaggacaacgagggtctagtaattactagtaaccacagatcgggaccagatgacaaagtcggacccgaggacgtaggttccgaacgtacggtcgggggcccggaacg

SEQ ID NO: 291102 - DNA, 670 bp, Homo sapiens
  misc_feature: GYAE6OF02IIL9Z.13.38.D05.1.454.CMB.1.raw
tcagtcacgtactacacgaccggtgctcgatttagtatctgatagttgggtttggggagctctgggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtcgtgggggggcttggttaagccgtgggggtccctcgagactcctcctgtcgcaacctctggattcattttctctgacgccttggttgagtcgtcgggtcccgccacgggccgtccccgggggaagggggtccgtgggaggtacggggttggaccgttaagttaaaagggtagaagacagttggtcggaacaacgagactacagtcgttacccggtagaaacggcgaagtatttaccaacttactactacaaagtacgagtgaactaacaaaaagtaaatacgaatattaatctagactaaaagtcgaaaactaaacgtaagaaaacgtacgaacgaacaaacgaggtacgttagtaaatttaccgtacgtaaccgaacctaaggtacgtacgggaccctaagaacgtaacgacgtaaacgtcgggacccgtacggaacggtacgttaccgtaaccgg

SEQ ID NO: 291103 - DNA, 616 bp, Homo sapiens
  misc_feature: GYAE6OF02F74QL.13.38.D05.1.454.CMB.1.raw
  modified_base (456)..(456): a, c, t, g, unknown or other
  misc_feature (456)..(456): n is a, c, g, or t
tcagtcacgtactacacgaccggtgctcgatttagtatctgatagttgggtttgggggggggagaggagccccagccttgggattcccaagttgttttcattcagtgatcaggactgaacacagaggactcaccatggagtttgggctgagctggattttcctcgctgctattttaaaaggtgtccagtgtgaggtgcaagtggtggagtcgtgggggggcttggttaagccgtggggggtccctcgagactctcctgtgcaacctctggattcattttctctgacgcctggttgagtcgtgggtcccgccgaggccgtaccccggggaaggggtctagggaggttgggttcggccgttaagtttaaagggtagaagacagtggtacggaacaacagactacagtcgttcccgtagaaaggcagtacttcaacttatctacgaagagatgaactanaaaaacgaatagaattatatctagacaaatagaaactaacctagaaaagcgaaggacacgaggcgtagtaagttactacgaaccagagacgtcgggaccaagagtgacaagtcggccgacggacgtaggttccgacgtacggacggggacccggtaacgg

SEQ ID NO: 291104 - DNA, 590 bp, Homo sapiens
  misc_feature: GYAE6OF02GXUBU.13.38.D05.1.454.CMB.1.raw
  modified_base (362)..(362): a, c, t, g, unknown or other
  misc_feature (362)..(362): n is a, c, g, or t
tcagtcacgtactacacgaccggtgctcgatttagtatctgatagttgggtttgggggggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtcgtggggggggcttggttaagccgtggggggtccctgagactctcctgtgcggcctctgggctcaccgtcaacaccaactacatgagctgggtccgcaggctccagggaagaggccggagtgggtctcgagttatttatgtcgacggtgccactnttctacgcagactccgtgacggggccgttcaccatcctaccgagacgactaattaccaaagaaccacggtagtattacttacaaatcgaacgacctggagacgtcgaggacacggccgtctattactgtcgacgaagatgcagacgacgggccccgtaaggcggggtcgtgggtaggtacgggtttcgtttcgttcgtacgtggtcggtcgggccgacgggtacccgg

SEQ ID NO: 291105 - DNA, 579 bp, Homo sapiens
  misc_feature: GYAE6OF02FNEXN.13.38.D05.1.454.CMB.1.raw
tcagtcacgtactacacgaccggtgctcgatttagtatctgatagttgggtttgggggggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtccggggggggcttgggttaagcctggggggtccctcagactctcctgtgcaacctctggattcattttctctgacgcctggttgagctgggtccgccaggctcccgggaagggctggagtgggttggccgtattaaaggtagaagacatggtcggacaacagactacagtgttcccgtgaaaggcagattcactatctcaagagatgactacaaaagaatgaatatatcagacaaatgaaacaacctagaaaacgcgaaggacacgaggacgtagtattactgtaccacagagtaggccagatcgaacaaagtcgggacccgacgacggtacgttacggacgtacggtcgggggacccgggtaaggtacccg

SEQ ID NO: 291106 - DNA, 598 bp, Homo sapiens
  misc_feature: GYAE6OF02G5AHH.13.38.D05.1.454.CMB.1.raw
tcagtcacgtactacacgaccggtgctcgatttagtatctgatagttgggtttggggggagaggagccccagccttgggattcccaagtgttttcattcagtgatcaggactgaacacagaggactcaccatggagtttgggctgagctggattttcctcgctgctattttaaaggtgtccagtgtgaggtgcaagtggtgagtctggggggggcttggttaagccgtggggggtccctcagactctcctgtgcaacctctggattctatttctctgacgctggttgagctcgggtccgcaggccgtcccgggaagggctggagtgggttggccgtataaaggtagaagacagtggtacggacaacgagactacagtcgttcccggtagaaaggcaagagttcaacttatctacaaagagatgactacaaaaagatagaatatatctagaactaaagtcgaaaacctactaagaaaacgcgaaggacaacgaggacgtataagttactagtaacccagagtagtcggacagtagtagactaagtcggacccgagacggttacgtaccgttacggtacggtacggggacccggtaccgg

SEQ ID NO: 291107 - DNA, 617 bp, Homo sapiens
  misc_feature: GYAE6OF02FXTZI.13.38.D05.1.454.CMB.1.raw
  modified_base (271)..(271): a, c, t, g, unknown or other
  misc_feature (271)..(271): n is a, c, g, or t
  modified_base (297)..(297): a, c, t, g, unknown or other
  misc_feature (297)..(297): n is a, c, g, or t
  modified_base (371)..(371): a, c, t, g, unknown or other
  misc_feature (371)..(371): n is a, c, g, or t
tcagtcacgtactacacgaccggtgctcgatttagtatctgatagttgggtttgggggggagaggagccccagccttgggattcccaagtgttttcattcagtgatcaggactgaacacagaggactcaccatggagtttgggctgagctggattttcctcgctgcttattttaaaaggtgtccagtgtgaggtgcaagtggtggagtcgtgggggggcttggtaagcgtgggggtcctcagactctctgtgcacctctggttcaccgtcngtcacacctacatgagcgtgggtccncaggcctcgaggggaaggggctgggagtcgcgtctctttttattacgtagtagttggtagtaacatacgtccgnaagtacttcgtggacgggcctatcaccaattccgaccaagacgtaacaacttaccaaaggaaccacgtctcgtttactacaaattgaaacagtccgtgaagtacgccgtaatacgacgacggtccttagttattccgtggtcgagtagaggtcgcggggaaccctacggaaccgttacgtacgaccgttaggtcgggtacgtccggtacggggcctaaacggggacccacggtcccgaccgttccg

SEQ ID NO: 291108 - DNA, 790 bp, Homo sapiens
  misc_feature: GYAE6OF02H2SVC.13.38.D05.1.454.CMB.1.raw
  modified_base (149)..(149): a, c, t, g, unknown or other
  misc_feature (149)..(149): n is a, c, g, or t
  modified_base (313)..(313): a, c, t, g, unknown or other
  misc_feature (313)..(313): n is a, c, g, or t
  modified_base (640)..(640): a, c, t, g, unknown or other
  misc_feature (640)..(640): n is a, c, g, or t
tcagtcacgtactacacgaccggtgctcgatttagtatctgatagttgggtttggggggggagaggagccccagccttgggattcccaagtgttttcattcagtgatcaggactgaacacagaggactcaccatggagtttgggctganctggattttcctcgctgcttaatttaaaggtgtccagtgtgaggtgcaagtggtggagtcggtggggggggtcttaggttaacggccggttggggggtcccctcgagtacctcgttcctggttgccaaccttgtaggtacttctaagttttctcttaggtaccnccgttgggtacgaggtccgtcgggggtacccgccgacgggtccggttaccccgggggaaggggtcccgtaggggtggttcggggggttcggaccggtttaaggttaaagggtacggaaagtacgtaggttcggggaaccgaacgtaaacgaggtacctaacgtacggtttccgttacccgggtaaggaacgtacgtagtaacttaccaagtttacctcgttacgaaagagtacgttaacgaccttaaagaaaaagtaacgttaggaattaaagtactactacggtaaactaaacgtaacgtaaaacctaaccgtaaagaaaaccggngtaaccggaaacgacgacggtagttacggtaacttacggacgtaaccctaaaggcgttaacgggacgtacgaacggtacgtaacgaacgtacggtacggccgagtacggttacgtacggtaaccgtcggggtacgggtacccggtaacgg

SEQ ID NO: 291109 - DNA, 497 bp, Homo sapiens
  misc_feature: GYAE6OF01EBD3L.40.77.G11.1.454.CMB.1.raw
  modified_base (278)..(278): a, c, t, g, unknown or other
  misc_feature (278)..(278): n is a, c, g, or t
  modified_base (365)..(365): a, c, t, g, unknown or other
  misc_feature (365)..(365): n is a, c, g, or t
  modified_base (489)..(489): a, c, t, g, unknown or other
  misc_feature (489)..(489): n is a, c, g, or t
  modified_base (493)..(493): a, c, t, g, unknown or other
  misc_feature (493)..(493): n is a, c, g, or t
tcagtctagcgactcacgaccggtgctcgatttagctagtcactcgaaaggggaaagggggagtcagacccagtcaggacacagcatggacatgagggtccccgctcagctcctgggctcctgctgctctggctcccaggtgccaaatgtgacatccagatgacccagtctccttccaccctgtctgcatctgtaggagaccagagtcaccatcaccttgccgggccagtcagagtattagtacctggttggcctggtatcagcacaaaccagggaancccctaagctcctgatctataaggcatctagtttagaaagtgggtcccatccaggttcagcggcagtggatctgggacagaattcgntctcaccatcagcagcctgcagcctgatgattttgctaacttattactgaccaacactatgattagttattctccgtactacctttggccagggaccaagggtggagatcaagcgaactgtagntgcnctac

SEQ ID NO: 291110 - DNA, 520 bp, Homo sapiens
  misc_feature: GYAE6OF01AKCGI.40.77.G11.1.454.CMB.1.raw
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtacctggttggcctggtatcagcacaaaccagggaagcccctaagctcctgatctataaggcatctagtttagaaagtgggtcccatccaggttcagcggcagtggatctgggacagaattcgctctcacatcagcagcctgcagcctgatgtattttgactaattattactgacctaacactatgtatagttacttcttaccgtactacctttggaccgtaggggtacccaaagggttcggaagacgtacaaggcgtaactggtacggatcgcctacgtacg

SEQ ID NO: 291111 - DNA, 538 bp, Homo sapiens
  misc_feature: GYAE6OF01AYT1L.40.77.G11.1.454.CMB.1.raw
  modified_base (281)..(281): a, c, t, g, unknown or other
  misc_feature (281)..(281): n is a, c, g, or t
  modified_base (344)..(344): a, c, t, g, unknown or other
  misc_feature (344)..(344): n is a, c, g, or t
  modified_base (376)..(376): a, c, t, g, unknown or other
  misc_feature (376)..(376): n is a, c, g, or t
  modified_base (379)..(379): a, c, t, g, unknown or other
  misc_feature (379)..(379): n is a, c, g, or t
tcagtctagcgactcacgaccggtgctcgatttagctagtcactcgaagggaaagggggagtcagacccagtcaggacacagcatggacatgagggtccccgctcagctcctggggctcctgctgctctggctcccaggtgccaaatgtgacatccagatgacccagtctccttccaccctgtctgcatcgtgtaggagacagagtcgaccatcacttgccgggccagtcagagtattagtacctggttcgccttggtatctagtcacaaaccagggaacncccctaagctccctgactctataaggcatctagtttagaagtgggtccatccaggttcagcgnagtgatctgggacagattcgctctcacatcancanctgcacgctacgatgtattttgactaacttatactagacctaacactatagtatagtttacttcttccgtactacgtttcggaccgtacggggtaccctaagggtcgtaaggtacgtacgaagtacgaacgttaggtacggtactagtcgtaccgtacg

SEQ ID NO: 291112 - DNA, 511 bp, Homo sapiens
  misc_feature: GYAE6OF01CFQAO.40.77.G11.1.454.CMB.1.raw
  modified_base (414)..(414): a, c, t, g, unknown or other
  misc_feature (414)..(414): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggcagtcagagtattagtactggttgcctggtatcagcaacaaaccgagggaacgcccctaagctcctagatctataagcatctagttagaagtgggtccatcagttcagtcggcaggtgatcgtagggacagtaattcgctctacaccatcagactacgcctgcagcctgatgtattttgactaactttatactnaccaactactatgtattagttacttcttaccgtactaccgtttggaccgtagggtaccaagggtgagatcgaagcgaactggtagactgctactacg

SEQ ID NO: 291113 - DNA, 642 bp, Homo sapiens
  misc_feature: GYAE6OF01DGXDE.40.77.G11.1.454.CMB.1.raw
  modified_base (102)..(102): a, c, t, g, unknown or other
  misc_feature (102)..(102): n is a, c, g, or t
  modified_base (273)..(273): a, c, t, g, unknown or other
  misc_feature (273)..(273): n is a, c, g, or t
tcagtctagcgactcacgaccggtgctcgatttagctagtcactcaagggaaagggggagtcagacccagtcaggacacagcatggacatgagggtccccgntcagctcctggggctcctgctgctctggctcccaggtgccaaatgtgacatccagatgacccagtctccttcaccctgtctgcatctgtaggagacagagtcaccatcacttgccgggccagtcagagtattagacctggttggcctggtatcagcacaaaccaggggaancccctaagctcctgatctataaggcatctagtttagaaagtgggtcccatccgaggttcagcggcagtggatcgtgggacagtaattcgctctcacctatacagcagcctgcagcctgatgattttgacctaaacgtttacttactcgtacccgtaaactacgtttaacttaggtaactttaacgtttaactttccgttaacccgtttaacctaacccggtttttacggggaccccgttaaacggggggtaccctaaaagggggttacgggtaacggttaacgttaacccggtaaaaacgggtcccggtaaaaaccgtttcggggttaaccgggtaccgtttacgggacccgtaaaccccgttaaacgg

SEQ ID NO: 291114 - DNA, 557 bp, Homo sapiens
  misc_feature: GYAE6OF01BVP2P.40.77.G11.1.454.CMB.1.raw
  modified_base (275)..(275): a, c, t, g, unknown or other
  misc_feature (275)..(275): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtacctggttggcctggtatcagcacaaaccaggggaancccctaagctcctgatctataaggcatctagttagaaagtgggtccatccgagttcagcggcagtgatcgtgggacagaattcgctctcaccatcagcagcctgcagcctagatgtattttgactaacttattactcgaccaactactatagtaattacgttattcctaccgttacctaccgtttcgggacccgtaacggggtaaccctaaggggtacggaagtaacgtaccgaaaggtaccggtaaacgttcggtacggtacttcggcccgtaaccgtacg

SEQ ID NO: 291115 - DNA, 560 bp, Homo sapiens
  misc_feature: GYAE6OF01EBS01.40.77.G11.1.454.CMB.1.raw
  modified_base (274)..(274): a, c, t, g, unknown or other
  misc_feature (274)..(274): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtacctggttgcctggtatcagcacaaacgagggaacncccctaagctcctgatctataggcatctagtttagaaagtgggtacccatccaggttcagcggcagtggatcgtgggacagatcgctctcaccatcagcacgctgcagcctgatgtattttgacttaacttattactacgaccaactactaatacgtaattaagtttacttccttaccgttacctaccgtttcggacccgtaacggggtaaccgtaaggggtaggaagtaacgtacgaaacggtacgtaaacgttcgggtacggtaccgtcgaccgtaccgtaacg

SEQ ID NO: 291116 - DNA, 547 bp, Homo sapiens
  misc_feature: GYAE6OF01DTBJO.40.77.G11.1.454.CMB.1.raw
  modified_base (278)..(278): a, c, t, g, unknown or other
  misc_feature (278)..(278): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtacctggttggcctgggtatcagcacaaaccgaggggaacncccctaagctcctgatctataaggcatctaagtttagaaaggtgggtcccatccaggttcagcggcagtggatcgtgggacagaattcgctctcacccatcagcagcctgcagcctgatgtattttgactaactttattactcgacctaacgacttaatagaatttagttactttccttaccgttactacccgtttggaccgtacggggaacctaagggtcggaagactacaaggacgtaacgtcggtagaccttcggaccaccgtacg

SEQ ID NO: 291117 - DNA, 766 bp, Homo sapiens
  misc_feature: GYAE6OF01B8PC5.40.77.G11.1.454.CMB.1.raw
  modified_base (431)..(431): a, c, t, g, unknown or other
  misc_feature (431)..(431): n is a, c, g, or t
tcagtctagcgactcacgaccggtgctcgatttagctagtcactcaagggaaagggggagtcagacccagtcaggacacagcatggacatgagggtccccgctcagctcctgggggccctcgtgcgtgccttggtcggtccctcccgtaggtccgaacctaaagttggtacgaactacctaccgaagtagtacccgaacccgtacgttccctttccccttacccctacccgttgtctcgctacttcgttagggaaggaggaacaaggtacgtacccaactctaccgttacggttccgggcccgggacctagtacgaaggtaattagtttaaccggtaccggttgggttccgtccggttaggtactagacgaccaaaccaaacggggaagggaccccgtaaccgtaagtcctcgtagtactactaagtacgntattacgtttaagtaaagtaagggtccggtacctagtaccggtagttacgacggcgacgtagggtagacttcgggagacgtaagttacgtcgtacttcaccaactactacgacgacaccgtcgtacgacgtccgtcgtagtagttagtttagtttacaaacctttaactttacttacgacaacctaactacttaggtacttaagtttacttacttacccgtacccgttacgttaccggttcggaaccgggtaccggaaacggtaagggtaacggaattacggaacgaaccggtacgtaacggttgggtacgtaccttcggaaaccctcgtttacg

SEQ ID NO: 291118 - DNA, 518 bp, Homo sapiens
  misc_feature: GYAE6OF01BJ50F.40.77.G11.1.454.CMB.1.raw
  modified_base (483)..(483): a, c, t, g, unknown or other
  misc_feature (483)..(483): n is a, c, g, or t
  modified_base (513)..(513): a, c, t, g, unknown or other
  misc_feature (513)..(513): n is a, c, g, or t
tcagtctagcgactcacgaccggtgctcgatttagctagtcactcaaggggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtacctggttggcctggtatcagcaacaaaccaggggaacgcccctaagcctcctgatctataaggcatctagttagaaagtggggtcccatccaggttcagcggcaggtggatcgtgggacagaattcgctctcaccatcagcagcctgcagcctgatgtattttgactaactttattactcgaccaacactatgtattagtttacttccgtacctaccttacgttcgacggtacggacgtaggngtagactagaacgagacgtggcgagcgccncgtcg

SEQ ID NO: 291119 - DNA, 558 bp, Homo sapiens
  misc_feature: GYAE6OF01BNJTV.40.77.G11.1.454.CMB.1.raw
  modified_base (275)..(275): a, c, t, g, unknown or other
  misc_feature (275)..(275): n is a, c, g, or t
  modified_base (415)..(415): a, c, t, g, unknown or other
  misc_feature (415)..(415): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcacatcacttgccggccagtcagagtattagtacctggttgcctggtatcagcaacaaaccgaggggaacncccctaagctcctgatctataggcatctagttagaagtgggtccatccaggtcagcgcagtgatcgtgggacagaacttcgctctcaccatcagcagcctgcagcctgatgtatttgactaacttacttactgacctaanactaatacgtaatttagttactttcgttacccgttactcccgttttagggacccgtaagggggtaaccctaagggtagggaagtaactaccgaaaggtccgtaaaccgttgggtaccgggtactacggccctaacccgtaacg

SEQ ID NO: 291120 - DNA, 565 bp, Homo sapiens
  misc_feature: GYAE6OF01E24F7.40.77.G11.1.454.CMB.1.raw
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtacctggtggcctggtatcagcacaaaccaggggaacgcccctaagctcctgatctataaggcatctagtttagaaagtggggtcccatccaggttcagcggcagtggatcgtgggacagaattcgctctcaccatcagcagcctgcacgcctgatgtattttgctaaactttattactgacccaactacctaatgtaattagtttacttccttaccgtacctacctttgggcccgtaacggggggacccgaaaggggtcgggaaggtactaccgaaacggtccggtaaaaccgttgggttacggccgttacggccctaaccctaacg

SEQ ID NO: 291121 - DNA, 559 bp, Homo sapiens
  misc_feature: GYAE6OF01DNJ06.40.77.G11.1.454.CMB.1.raw
  modified_base (278)..(278): a, c, t, g, unknown or other
  misc_feature (278)..(278): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtcctccttccaccctgtctgcatctgtaggagacagagtcaccatcacttgccgggccagtcagagtattagtacctggttggcctggtatcagcaacaaacgaggggaacncccctaagctcctgatctataaggcatctagttagaagtgggtccatccagtcagcgcagtgatcgtggacagattcgctctcacatcagcagcctgcagcctgatgtattttgactaactttattactacgaccaaactacttaatgtaatttagtttaactttccgttacccgttaccgtaacccgtttcgggaccgtaccgggggtaaccaaaggggttacggaagtactacgaaacggtacggaacgttaggtacggtacgtcgaccgtaccgtacg

SEQ ID NO: 291122 - DNA, 530 bp, Homo sapiens
  misc_feature: GYAE6OF01CPZ12.40.77.G11.1.454.CMB.1.raw
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggcagtcagagtattagtacctggttggcctggtatcagcaacaaaccgaggggaacgccctaagcctcctgatctataagcatctagttagaagtgggtccagtccaggttcagcggcaggtggatcgtagggactagtaatcgctctacacatcagcagcctgcacgcctgattgtatttgactaactttatactcgaccaactactaatgtaattagttacttcttaccgtactaccgtttggaccgtaggggacctaagggtcggaagacgtacgaacggacgtaactggtacgctgacctacgtacg

SEQ ID NO: 291123 - DNA, 516 bp, Homo sapiens
  misc_feature: GYAE6OF01DFCC0.40.77.G11.1.454.CMB.1.raw
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtacctggttggcctggtatcagcacaaaccaggggaagcccctaagctcctgatctataaggcatctagtttagaaagtggggtcccatccaggttcagcggcagtggatctgggacagatcgctctcaccatcagcagcctgcagcctgatgattttgactaactttattactgacctaacactatagtattagttattctaccgtactaccgtttcggaccgaggggacctaagggtcggagtatcgaaagcgaaacgtggtaggctcgcacctacg

SEQ ID NO: 291124 - DNA, 564 bp, Homo sapiens
  misc_feature: GYAE6OF01AMMDM.40.77.G11.1.454.CMB.1.raw
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggcagtcagagtattagtacctggttggcctggtatcagcacaaaccaggggaagcccctaagctcctgatctataaggcatctagtttagaaagtggggtcccatccaaggttcagcggcagtggatctgggactaggaaacttcgctctcaccatcagcagcctgcacgcctgatgtattttgactaactttattactgaccctaaactccttaagtgtaacttaagtttacttccttaccgtaacctcccttttagggcccgtaaacgggggaccctaaaggggtcggaagtagttacgaaacggtccgtaaacttcggtacggctacggccaaccgttacg

SEQ ID NO: 291125 - DNA, 517 bp, Homo sapiens
  misc_feature: GYAE6OF01DW2FF.40.77.G11.1.454.CMB.1.raw
  modified_base (276)..(276): a, c, t, g, unknown or other
  misc_feature (276)..(276): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtacctggttggcctggtatcagcacaaaccaggggaacncccctaagctcctgatctataaggcatctagtttagaaagtgggtcccatccaggttcagcggcagtggatctgggacagattcgctctcaccatcagcagcctgcagcctgatgtattttgactaactttattactcgaccaacactatgtaattagttattctaccgttactaccgtttcggccgtacggggacctaagggtgagatacgaacgtcgaacgtgtcggctcgccactacg

SEQ ID NO: 291126 - DNA, 741 bp, Homo sapiens
  misc_feature: GYAE6OF01CGNOX.40.77.G11.1.454.CMB.1.raw
  modified_base (233)..(233): a, c, t, g, unknown or other
  misc_feature (233)..(233): n is a, c, g, or t
tcagtctagcgactcacgaccggtgctcgatttagctagtcactcgaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagacgtcacatcacttgccgggcagtcagagtnttagtacctggttggcctaggtatcagaccaacaaaccgaggggaacgcccctaaagcctccctggacttacctaacgtaacggcctagttacttaggtttaacggaaaaggttcgggggttacccctaaggttcccgtaagggtttccgaaggtccgggtacgaacggtgggaactttcgtacggggaactaacggtaaacgttccggacttactaccgaacctacgttcgaacgtacgaacgtcccgtcggacctaggtacccttgtaacgttgttaacgttttcggaaccttaaacgtttactttaacgtacggtaaccctaaactaacctttaagtacgtaacgttttacgtttaaccgttacccgttaaccggttaccgttaacccggtttcgggacccgggtaaaccggggtaacccgtaaggggttacgggtaacgaacggttacccgaaggtaccccgtaaggttacggtaggtcccgttacggacctacccgttaaccg

SEQ ID NO: 291127 - DNA, 542 bp, Homo sapiens
  misc_feature: GYAE6OF01BJ8XL.40.77.G11.1.454.CMB.1.raw
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtacctggttggcctggtatcagcaacaaaccgaggggaacgcccctaagcctcctgatctataaggcatctagttagaagtgggtccatccaggttcagcggcaggtgatcgtgggacagaattcgctctcaccatcagcagcctgcagcctgatgtattttgctaactttattactcgaccaactacttaatgtaatttagtttactttccgtaccgtacttaccgtttgggacccgtaggggaaccctaagggtcggaagactacgaagtacggaacttgggtacgacgttgacctacgtacg

SEQ ID NO: 291128 - DNA, 641 bp, Homo sapiens
  misc_feature: GYAE6OF01DH9QP.40.77.G11.1.454.CMB.1.raw
  modified_base (280)..(280): a, c, t, g, unknown or other
  misc_feature (280)..(280): n is a, c, g, or t
  modified_base (397)..(397): a, c, t, g, unknown or other
  misc_feature (397)..(397): n is a, c, g, or t
tcagtctagcgactcacgaccggtgctcgatttagctagtcactcaagggaaagggggagtcagacccagtcaggacacagcatggacatgagggtccccgctccagctcctggggctcctgctgctcgtggctcccaggtgccaaatgtgacatccagatgacccagtctccttccaccctgtctgcatctggtaggagacagagtcacatcacttgccggccagtcagagtattagtaccgtggttggcctggtatcgagcaacaaacgaggggaacnccctaagcctcctgatctataagcatctaagttagaaagtgggtccatccgaggttcgacgcggcaaggtcggtatcgtgggactagtaattcgctctcacgatcagcagcctgacncggtcctagtacgtagttattttacggaccttaaacttttactacgtttacaaccctaaacgtacttaagtacgttagtttaacgttttacttacccgtttacccgttaccgttacccgtttacgggtacccggtaaacgggggtaaccccgtaaaggggttacgggtagaaaccggtttaccggaaacggtaccggtaaacgtttgggttacgggtaccctagtaaccccgtaccgtttaccg

SEQ ID NO: 291129 - DNA, 563 bp, Homo sapiens
  misc_feature: GYAE6OF01COCSG.40.77.G11.1.454.CMB.1.raw
  modified_base (279)..(279): a, c, t, g, unknown or other
  misc_feature (279)..(279): n is a, c, g, or t
  modified_base (422)..(422): a, c, t, g, unknown or other
  misc_feature (422)..(422): n is a, c, g, or t
tcagtctagcgactcacgaccggtgctcgatttagctagtcactcaaggggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtacctggttggcctggtatcagcaacaaaccgaggggaacnccctaagctcctgatctataagcatctagttagaagtgggtaccatccaggttccagcggcaggtggatcgtgggacagtaacttcgctctcacatcagcagcctgacacgcctagattgtattttcgactaactttattacngtaccaactactatgtaattacgttattcctacgttacctaccgtttagggacccgtaagggggtaccgtaaaggggtcggaagtaacgttaccggaaagtaccggtaaacgtggtacgggaccttacggacctacctacg

SEQ ID NO: 291130 - DNA, 590 bp, Homo sapiens
  misc_feature: GYAE6OF01B3G4O.40.77.G11.1.454.CMB.1.raw
  modified_base (278)..(278): a, c, t, g, unknown or other
  misc_feature (278)..(278): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtacctggttggcctggtatcagcaacaaaccgaggggaacncccctaagctctgatctataaggcatctagtttagaaagtggggtccatccaggttcagcggcagtggatcgtgggacagaattcgctctcaccatcagcagcctgcagcctgatgtattttcgactaactttattacgtacgaccctaataacttaatacgtaattaaggtttacttcccgttaccgttaccttacccgttttcgggacccgtacgggggtaaacccctaaggggttacggaacggtacggttaacccgaaagggtacccggtaaacgttgggtacggtacgtcgtaccgtaccgttaacg

SEQ ID NO: 291131 - DNA, 533 bp, Homo sapiens
  misc_feature: GYAE6OF01ENTIS.40.77.G11.1.454.CMB.1.raw
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtacctggttggcctggtatcagcacaaaccaggggaagcccctaagctcctgatctataaggcatctagtttagaaagtgggtcccatccagttcagcggcagtggatctgggacagaattcgctctcacctatcagcagcctgcagcctgatgtattttcgactaacttagtttactcgacctaaacacttatagattagtttactttacgtcccgttacgtacccgtttcgggacctaacggggaaccaagggtcggagatcgaaagcgaaacgtggtaggctacgcacctacg

SEQ ID NO: 291132 - DNA, 555 bp, Homo sapiens
  misc_feature: GYAE6OF01CSUEZ.40.77.G11.1.454.CMB.1.raw
  modified_base (276)..(276): a, c, t, g, unknown or other
  misc_feature (276)..(276): n is a, c, g, or t
  modified_base (372)..(372): a, c, t, g, unknown or other
  misc_feature (372)..(372): n is a, c, g, or t
  modified_base (415)..(415): a, c, t, g, unknown or other
  misc_feature (415)..(415): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtacctggttggcctggtatcagcaacaaacaggggaacncccctaagctcctgatctaataggcatctagtttagaagtcgggtccagtccaggttcagcggcagtggatcgtagggacagacttcgctctcacntcagcacgctgcagcctgatgtactttgactaacttacttacncgaccaactactatagtattacgttattcctaccgttactaccgtttgggacccgtaacgggggtaacctaagggtacgggaagtacgtaacgaaacgggtacgaaaccgttgggtacgccgttcgaccctaccgtaacg

SEQ ID NO: 291133 - DNA, 678 bp, Homo sapiens
  misc_feature: GYAE6OF01CVLG0.40.77.G11.1.454.CMB.1.raw
  modified_base (273)..(273): a, c, t, g, unknown or other
  misc_feature (273)..(273): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggcagtcagagtattagtactggttgctggtatcagcaacgaaaccgagggaacncccctaagcctacctgatctaagtaaggctatacgttaaggtttaagaaacggttcggggtaccccagtcccgtaaggttaccgaggccggactagggtcggtacgtcggtagggaactaagtaacgtttccgactcctacgaaccctagttaccgacggtccaacggtcccgtacggaccgtacgtaccgtagtacttagttacgttttacgtaaccttaactttacttaaccgtacaaccctaataaccgttaagttacgttaacgtttacgtttaccttacccgttaaccctaccgttaccggttaccgggaccggtaaacggggtaacgtaaacgggtacggtaacgtaacgtaacggaacggtacgtacgtagggtaccgacgtaccgcgaaccgttacg

SEQ ID NO: 291134 - DNA, 554 bp, Homo sapiens
  misc_feature: GYAE6OF01BKP03.40.77.G11.1.454.CMB.1.raw
  modified_base (274)..(274): a, c, t, g, unknown or other
  misc_feature (274)..(274): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtacctggttggcctggtatcagcacaaacagggaacncccctaagctctgatctataaggcatctagttagaaagtgggtcccatccaggttcagcggcagtggatctgggacagaattcgctctcaccatcagcagcctgcagcctgtatgtattttgacctaacttattactcgacctaacacttatgtaattacgtttattccttcccgtacttaccgtttacgggacccgtaagggggaccgtaaggggtacggagtaacgttccgaaacggtccggaaacgttcgggtacggacgttcgaccgtaccctacg

SEQ ID NO: 291135 - DNA, 911 bp, Homo sapiens
  misc_feature: GYAE6OF01EY117.40.77.G11.1.454.CMB.1.raw
  modified_base (271)..(271): a, c, t, g, unknown or other
  misc_feature (271)..(271): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtcctccttccaccctgtctgcatctgtaggagacagagtcaccatcacttgccggcagtcagagttattacgtacgtgtgcctggtatcagcacaacgagggacncccgtaagctcctagacttacgtaagtaaggctacgttacgttaacggtttaaggtaaacgggttcggggtacccctaacgttccgtaacgggtttccgaacggtccgggtaacgtaacgggttacggtaaccgttcgggtaacggggtaactaacgggtttaaacgtttcccgggtacttaccccggttaacctaaaccccgttaacgttacccggtaaccggacccgtaacgggtccccgtttaacgggtaccccggtaaacgttaccccggtttagggttaaacggtttacgggtttttaacgttttttaccggtaaaccctttaaaccgtttttaacgtttaaacccgtttacccggaaacccctttaaaacgtaaccgtttaacgttttaaacggttaaccggtttttaaatttttaccccggtttaacccgtttaaccccccggttttaaacccgtttaccccggggttttaacccggggaacccggttaaaaccggggggggttaaacccccttaaaagggggggttaccgtaaaacggttaccggtaaccggtaaaccggggtacccggttaaaacggttccggggttaacgggacccgtttaacggaaccccgttaaccgtttaacccggg

SEQ ID NO: 291136 - DNA, 586 bp, Homo sapiens
  misc_feature: GYAE6OF01B1QMY.40.77.G11.1.454.CMB.1.raw
  modified_base (279)..(279): a, c, t, g, unknown or other
  misc_feature (279)..(279): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttcggccgggccagtcagagtattagtacctggttggcctggtatcagcaacaaacgaggggaacncccctaagcctcctgactctataaggctatctaagttagaaaggtcgggtcccatccgtaggtcaggcgcaggtggatcgtgggaacagtaattcgactactcactatcagcacgcctgcacgctgtatgtatttcgacttaacttattactcgacctaactactaatgtaatttacgtttactttacccgtaccgtaccgttaccgtttcgggaccggtaacggggtaaccgtaaggggtacggtaaggtacgtacgaaacggtacgtaaacggttggtacggtacctcggtacccgtccgttacg

SEQ ID NO: 291137 - DNA, 563 bp, Homo sapiens
  misc_feature: GYAE6OF01ESWX8.40.77.G11.1.454.CMB.1.raw
  modified_base (290)..(290): a, c, t, g, unknown or other
  misc_feature (290)..(290): n is a, c, g, or t
  modified_base (441)..(441): a, c, t, g, unknown or other
  misc_feature (441)..(441): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtcctccttccaccctgtctgcatcgtgtaggagacagagtcaccatcacgttcggccgggccagtcgagtagtattagtacctggttggtcttggtatcgagaccaacaaaccgaggggaaccncccctaaggctcctagactcgtaataggcattctagtttagaaaggttgggtacccagtcctaggttcaggccgagagtggatcgtggacagtacttcgctcgtacaccatcagcacgcctagcacgctagattgtatttgacttaacttnttacctgacctaacattatgtatttattactttcctacgttacctaccgtttcgggaccgaacggggtactaaggggtgagtaataccgaagtacgtaacgtgtacggactgcccgtactcg

SEQ ID NO: 291138 - DNA, 526 bp, Homo sapiens
  misc_feature: GYAE6OF01AOF3B.40.77.G11.1.454.CMB.1.raw
  modified_base (359)..(359): a, c, t, g, unknown or other
  misc_feature (359)..(359): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggccagtcagagtatagtactggtgctggtatcagcacaaaccagggaacgcccctaagcctctgatctataaggcatctagttagaagtgggtcccagtccaggttcagcggacagtggatcgtggactagaatcgctcncacatcagcagctgcagctgatgtatttgactattattactgaccaacgtactatcgtaattacgttattcctaccgtactaccgttacggccgtaacggggtacccgaagggttcggaaggtactacgaacggacgtaacgtggtacggctaggtccaaccgtacg

SEQ ID NO: 291139 - DNA, 683 bp, Homo sapiens
  misc_feature: GYAE6OF01BUCV2.40.77.G11.1.454.CMB.1.raw
  modified_base (278)..(278): a, c, t, g, unknown or other
  misc_feature (278)..(278): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtccgcatctgtaggagacagagtccaccatcacttgccggccagtcagagtattagtacctggttggcctggtatcagcaacaaaccgaggggaacncccctaagcctccctgatactagtaaaggcatcttaaggtttaagaaagggttcggggtaccctagtcccgtaggttccaggtcggcgtaggtggagttcggtacgggtaactaagtaactttccgaccttcgtacctaaccctatccaggaccacgtccccgtgacctacggtcccgttagaacgtttacgtaagtttttcggaaccttaactttaacgttaccgttacgaacccctaaacgtacgttagttaacgttagtttaacgtttaccgtttccgttacccgttaccgttacccggttttaccgggaccggtaaaccggggtaaccgtaaggggtaggaacgtacgtacgaacggtaccgtaacgttcggtacggtccgtacgcctaccgtgtttcccg

SEQ ID NO: 291140 - DNA, 810 bp, Homo sapiens
  misc_feature: GYAE6OF01BQFTY.40.77.G11.1.454.CMB.1.raw
  modified_base (152)..(152): a, c, t, g, unknown or other
  misc_feature (152)..(152): n is a, c, g, or t
tcagtctagcgactcacgaccggtgctcgatttagctagtcactcaaggggaaagggggagtcagacccagtcaggacacagcatggacatgagggtccccgctcagctccgtggggctcctgctgctcgtcggctcccgaggtgaccaaangttttagacactaccagatcgaccctacgtcctcccttccctaccctcgtctgctactcgtggtaggacgacgagacgtccacctactaccgtacgttcggcccgggaccgacgtacgagtagttagttacggtacgttggttcggtccgtaggtactcgacgaccaacgaaaccggacgggaaccgaccccgtaacgcctaccgtagactactaacgtacggactattacgttaaggttaaggaacgggttacgggtacctacgtaccgtaggttcgaacggtcggacgtaggtaggtacgtacggaggacgtaagtacgttcgtaccgtacctaccaccgtactaccgacggtacaccggttcccgacggtacccaacgggtccttaggtagtttacgtttaacttttccgaaacctttaacgtttaccgtaacgtacgaaaccccgttaataacgttaacttacgttaaccgttttacgtttacccgttaccgtttaaccccgtaaccggtttacccgggttaacggggaacccgggtaacgggggtaaaccggtaaggggttaccgtaaacgggtaaccttaaccgggaaccggtaaccggtttaaccggtaggggttaccccggacttacccggtaaccctcccggttaaccg

SEQ ID NO: 291141 - DNA, 527 bp, Homo sapiens
  misc_feature: GYAE6OF01BRVZV.40.77.G11.1.454.CMB.1.raw
  modified_base (276)..(276): a, c, t, g, unknown or other
  misc_feature (276)..(276): n is a, c, g, or t
  modified_base (334)..(335): a, c, t, g, unknown or other
  misc_feature (334)..(335): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtacctggttggcctggtatcagcacaaaccaggggaacncccctaagctcctgactctataggcatctagttagaagtgggccatccaggtcagcgnngtgatcgtggacagagttcgctctcaccatcagccagcctgcagcctagactgtatttgactaattacttactagacctaactactactagtaattagtttacttccgtacgtacctacgtttcggaccgtacggggacctaagggtcggaagtatacgaacgacgtaacgtcgtaggtactcgctacgtac

SEQ ID NO: 291142 - DNA, 553 bp, Homo sapiens
  misc_feature: GYAE6OF01DOJ03.40.77.G11.1.454.CMB.1.raw
  modified_base (265)..(265): a, c, t, g, unknown or other
  misc_feature (265)..(265): n is a, c, g, or t
tcagtctagcgactcacgaccggtgctcgatttagctagtcactcaagggaaagggggagtcagacccagtcaggacacagcatggacatgagggtccccgctcagctcctgggctcctgctgctctggctcccaggtgccaaatgtgacatccagatgacccagtctccttccaccctgtctgcatctgaggagacagagtcacatcacttgccggcagtcagatattagactggtgctggtatcagcacgaaacgagggaacnccccagctcctgatactataggctatctagttaaggaagtcgggtaccacgtcgagttcagcggacgaggtggtacgtcgagggacagtactcgctctcacatcagcacgctgcagcgtagtagttgttatttcgacttaacttattacactaccaacgtattagtagtatttattacttccttaccgtacttaccggtttacggaccggtaaacggggtaccgtaagggtaggaagtacgttacgaaaggtaccgtaacgtcggtaggtctaacgcctaaccgtacg

SEQ ID NO: 291143 - DNA, 575 bp, Homo sapiens
  misc_feature: GYAE6OF01BOCHS.40.77.G11.1.454.CMB.1.raw
  modified_base (278)..(278): a, c, t, g, unknown or other
  misc_feature (278)..(278): n is a, c, g, or t
  modified_base (298)..(298): a, c, t, g, unknown or other
  misc_feature (298)..(298): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtacctggttggcctggtatcagcaacaaaccgaggggaacncccctaagctcctgatctanaaggctatctaagtttagaagtcgggtacccatccgaggttcagcggcagtggatcgtagggacagtaattcgctctacacatcagcagcctgcacgcctagatgtattttgaccttaactttattacgtcgaaccctaactaactattgtaatttaacgttactttccttaccgtactaccgtttcgggaccgtacggggaacctaagggtggtaagacgttaaccgaacggtacgtaaacgttggtacggtacctacgtacccgtaaccgttacg

SEQ ID NO: 291144 - DNA, 571 bp, Homo sapiens
  misc_feature: GYAE6OF01DS31T.40.77.G11.1.454.CMB.1.raw
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtactggttggcctggtatcagcaacaaaccgaggggaacgcccctaagcctcctgatctataaggcatctagtttagaaagtgggtcccatccagttcagcgcagtgatcgtggacagacttcgctctcaccatcagcacgcctgcagcctgatgtattttacgctaactttattactcacctaacacttatagtattacgtttacttaccttcccgttactaccgtttcgggaccggtaacggggtaacccgtaagggtacggtaaggtaacgtccggaaaacggccggtaaacgttcgggttacggtccgtacgtacccgaccgttaaaccg

SEQ ID NO: 291145 - DNA, 730 bp, Homo sapiens
  misc_feature: GYAE6OF01DFYAI.40.77.G11.1.454.CMB.1.raw
tcagtctagcgactcacgaccggtgctcgatttagctagtcactcaagggaaagggggagtcagacccagtcaggacacagcatggacatgagggtccccgctcagctccgtggggctcctgctgctctggctcccaggtgccaaatgtgacatccagatgacccagtcctccttccaccctgtctgcatctgtaggagacagagtccaccatcacttgccggcagtcagagtattagtactggttggcctggtatcacgcaacaaaccgaggggaacgccccgtaagcctacccgtagacttacgtaagtaaggactattacgttaaggtttaaggtaaaagggttcggggtaccctaagttcccgaaggtttacgaggacggtacgaaggtgggtaacttcggtaggggaacaacggtaaacgtttccggacctttacgtaccaaccgtattaccgaacggcccgtacggcccttcggaccgtacgtacccgttaggaacgttacgttacgtttttacgacctttaaactttacgtttaacctacggtaaccctaaactaaccgtttagtacgttaagtttaacgttttaactttacccgttacccgtttacccgtaccggttttaccgggacccggtaaacgggggtacccgtaaaggggtacgggtagttaacgtaaccgaaacggtacgtaaacgtggttacggccgtcgacccgtaccgtaacg

SEQ ID NO: 291146 - DNA, 577 bp, Homo sapiens
  misc_feature: GYAE6OF01AM9K0.40.77.G11.1.454.CMB.1.raw
  modified_base (384)..(384): a, c, t, g, unknown or other
  misc_feature (384)..(384): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggccagtcagagtattagtaccgtggttggcctggtatcagccacaaacccgaggggaacgccccctaaaggcctaccgtgaactctataacggcaatctaagtttagaaggttcggggtcccatccgaggttcagcggcagtgatcgtggacagaacttcgctcncacctatcagcagcctgcagcctgactgtattttcgactaacttattactgacctaacgtctatagtattacgtttacttctaccgttactaccgtttcggaccggtaacggggaacccgtaaggggtcggaagtacgttaccgaaacggtacggtaacgtcggttacggtacctacgcccgtaaccttaccg

SEQ ID NO: 291147 - DNA, 546 bp, Homo sapiens
  misc_feature: GYAE6OF01ETLYX.40.77.G11.1.454.CMB.1.raw
  modified_base (197)..(197): a, c, t, g, unknown or other
  misc_feature (197)..(197): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtagganacagagtcaccatcacttgccgggccagtcagagtattagtacctggttggcctggtatcagcaacaaaccgaggggaacgcccctaagctcctgatctataggcatcgtagtttaagaaaggtcgggtacccagtcctaggttcaggcggcaggtgatcgtgggacagtaatcgctctcacatcgagcagcctgcacgctgatgtactttgactaacttattactcgtaccaactactatagtatttagtttacttacctaccgtaccttaccgttaggacccggtaacgggaaccgtaagggtgaagtactacgaacgacgtaacgtggtacgatcgacgacctacg

SEQ ID NO: 291148 - DNA, 586 bp, Homo sapiens
  misc_feature: GYAE6OF01DT2WE.40.77.G11.1.454.CMB.1.raw
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggccagtcagagtattagtacctggttggcctggtatcagacaacaaaccgaggggaacgcccctaagctcctagatctagtaaggctattcgtaagtttaagaaaggtcgggtcccagtccgtaggttcagcggcagtggatcgagggacagattcgctctcactatacagcacgcctgcacgctgtattgtattttcgacttaactttattacgtcacctaacacttaatagtaatttacgtttactttcccgttaccgttaccttaccgtttaccgggaccggtaaccggggtaacgtaacggggtaggaacgtacgtacgaaacggtacgaacgttgggtacggtactacgccgtaaccgtacg

SEQ ID NO: 291149 - DNA, 792 bp, Homo sapiens
  misc_feature: GYAE6OF01BQXZL.40.77.G11.1.454.CMB.1.raw
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatcgacccagtctccttccaccctgtctgcatctgtaggagacagagtccaccatcacgttcggcccggccagtcagtagttagttacgtaccgttggttacggccttggtactcgaggaccaacgaaaccgaggggaacgtcccccgtaaagtcctaccgtaggtactacgtaagtaacgggactaacgttacgttaaggttttaacggaaacgggttccggggtacccctagttacccgtagggttaccagggtcccggagaggtcggtaacgtcggttagggaactaagtacttccgtacctcgtaccaactacttaccgagaccgacgtcccgtacgtaccgaacggtccgttaggtaacgtttacggtttaaccgtttttcggaaacccttttaaaccgtttacgttttaacccgtacggtaaacccctaaaccttaccgtttaagttacggttaacttttaacgtttttaccttaaccccgttaacccgggtttaccgttaacccggttttacggggaaccccggtaagggggttaacccggtaaggggtacgaacggttaactacggaaaccgggtaaccgtaaccgggttcgtacgggtaccttcgggtaaccctaacccggttacg

SEQ ID NO: 291150 - DNA, 757 bp, Homo sapiens
  misc_feature: GYAE6OF01ARR15.40.77.G11.1.454.CMB.1.raw
tcagtctagcgactcacgaccggtgctcgatttagctagtcactcaaggggaaagggggagtcagacccagtcaggacacagcatggacatgagggtccccgctcagctcctggggctcctgctgctctggctcccaggtgaccaaatgtgacatccagatcgacccagtcctcctccaccctgtctgcatcgtgtaggagacagagtcaccatcacttcggccggccagtcagagttattacgtaccgttggttacgccttaggtactcagacaaccgaaacggacgggaaccgaccccgtaagtcctacctgtactactaagtaaggctaattacgttaaggtttaacggaaacggttccggggtaccctaacgttacccggtacggtttaccgaacggtccggtacgtacgggtaggtacgtccggtaaggggtaactaacggttaaccgttcggtaccttaccgtacctaacctacgtaccgaacgtacccgtacggtcccgtacggacgtaaccggtcgtaaggtaacgtttgttaacgttttaccgaacctttaacgttttaaccgttacctaccgtaaccctaacttacgttaacgttacgttaacgtttaacctttaccgtttaccgttacccggttaacccgttaaccggtttacgggaaccccggtaaggggtaacccgtaagggtacggtaagtaaccgtagaaacgtacgttaacgtggtaccggactcgtacccgtcgttaccg

SEQ ID NO: 291151 - DNA, 715 bp, Homo sapiens
  misc_feature: GYAE6OF01ASB9R.40.77.G11.1.454.CMB.1.raw
  modified_base (314)..(314): a, c, t, g, unknown or other
  misc_feature (314)..(314): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtcctccttccaccctgtctgcatctggtaggagacagacgtccaaccactctaccgttcggcccgggaccagtcgaggtagttaacttacggttaccgttgggttcggccttggtatacgacgaccaaccgaaaccggacgggaaccncccctaagcctaccgtagtacttactagtaacggctaagttacgttaaggttaacgaacgggtccgggtaccctacggtaccgtacggttcgacggtcggtacgtaggtcggtacgtacggtacggaactacgtaattccgtcgtacctacacctactcgacgtcaccgtcgacgtcgacgtccgtagtacgttcgttactttacgaaccttagtttaacctacgaccgtaaacctaacgttactaattacgggtttaactttaaccggtttacttacccgttaacccggtcccgtttaaccgggttaccggaccggtaaacggggtaacccgaagggttacgaacggtaggtaaccgaccggacgtaccggttgtaccggactaccgtactccgttaacg

SEQ ID NO: 291152 - DNA, 782 bp, Homo sapiens
  misc_feature: GYAE6OF01CVTVB.40.77.G11.1.454.CMB.1.raw
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtcctccttccaccctgtcctgctatctgtaggagacagagtcaccatctacgttggccgggaccagtcaggtatattacgtacgtggttcggccttggtactacgacgcgaaaccgaaaacccggagggggaaacccaccccctaaaggccttacccgtaggtaacttcctaaagttaaacgggccctaagtttacggtttaaagtttaacggtaaaagggttccggggttaccccaagttcccgtaagggttaccaagggtccggtactaaggggttggaaactttcggtacggggaactaagtaaacgtttccgacgttacctaccaacccgtataccgaacgccaacgtcctcggacgtacgtccgttaggtactttagttacgttttacgtaactaaactttactttaaccgtcgtaaccctaaacgtaaccttaagttaacgtaacgtttaacgtttacctttacccgttaccccggtttaccgttaacccgttttaccggggaaccgggtacggggtaaaccccgggtaagggttaacggtaaggtacgttaaaccggaacggtaaccgtaacgttacgggtacggtacgttacgcccgtaaccgtaccg

SEQ ID NO: 291153 - DNA, 526 bp, Homo sapiens
  misc_feature: GYAE6OF01EJ14L.40.77.G11.1.454.CMB.1.raw
  modified_base (310)..(310): a, c, t, g, unknown or other
  misc_feature (310)..(310): n is a, c, g, or t
  modified_base (340)..(340): a, c, t, g, unknown or other
  misc_feature (340)..(340): n is a, c, g, or t
  modified_base (520)..(520): a, c, t, g, unknown or other
  misc_feature (520)..(520): n is a, c, g, or t
  modified_base (523)..(523): a, c, t, g, unknown or other
  misc_feature (523)..(523): n is a, c, g, or t
tcagtctagcgactcacgaccggtgctcgatttagctagtcactcaaggggaaaggggggagtcagacccagtcaggacacagcatggacatgagggtccccgctcagctcctggggctcctgctgctctggctcccagggtgccaaatgtgacatccagatgacccagtcctccttccaccctgtctgcatctgtaggagacagagtcaccatcacttcgccgggccagtcagagtattagtaccgtggttggcctggtatcagcacaaaccgaggggaacgcccctaagctcctgatctataggcatntagttagaagtgggtccatcagtgagcggnaggtgatcgagggacagtatcgctctacacatcagcagcctgcagtccgtgacgtagtttcgtactaacttattactctaccactaactatatagttagttacttcttcgtacctaccgttacgcgtacgggacggtaacggtaggtagtagtacgacgacgagtacggtcggcgtagcnctntcg

SEQ ID NO: 291154 - DNA, 670 bp, Homo sapiens
  misc_feature: GYAE6OF01CDOCK.40.77.G11.1.454.CMB.1.raw
tcagtctagcgactcacgaccggtgctcgatttagctagtcactcaagggaaagggggagtcagacccagtcaggacacagcatggacatgagggtccccgctcagctcctgggctcctgctgctctggctcccaggtgccaaatgtgacatccagatgacccagtctccttccaccctgtctgcatctgtaggagacagagtcaccatcacttgccggccagtcagagtattagtacctggttggcctggtatcagcacaaaccgagggaacgacccctaagctcctgatctataacgcatactaggtttaagaaaggtcgggtacccagtaccgtaggttcaggcggacaggtaggatcgtgggaacagtaacgttcgctcctacgacctatcacgccacgtcctgcctacgccttagtacgttagttacgttttcgaccttaaactttacttaccgtacgtaaccctaaactacctttaagttacgtaacttttaacggtttactttacccgttacccggttaacccttacccgttttacggggaccccggtaaacgggggtaaacccgtaaagggggttacgggtaaacggtaacgttaaccggaaacgggtaacccggtaaacgttcgggtaccggttaccgtacgtacccgtaaccgttaaccg

SEQ ID NO: 291155 - DNA, 667 bp, Homo sapiens
  misc_feature: GYAE6OF01BMX99.40.77.G11.1.454.CMB.1.raw
  modified_base (201)..(201): a, c, t, g, unknown or other
  misc_feature (201)..(201): n is a, c, g, or t
tcagtctagcgactcacgaccggtgctcgatttagctagtcactcaagggaaagggggagtcagacccagtcaggacacagcatggacatgagggtccccgctcagctccgtggggctcctgctgctctggctcccaggtgaccaaatgtgacatccagatcgacccagtcctccttccaccctgtctgcatctgtagganacagactcaccatcacgttcggccggcagtcagtatattacgtaccgttggttcgccttggtatcagacaacgaaacgaggggaacacccctaagcctcgtgacttacgtaagtaacggctaatacgttaagtttaagtaaaacgggttcgggtaccctaagttcgtacggttacgacggcggacgtaggtcggacgttcgtagggactaagtaactcgtactcacctacagtacacgccgacgcctgactcgcgtagtattagttatttacgaacttaaacgttactacgtacgtaccctaataattacgttattaagtttacgtaactttcccgtacgttaccgttaaccggttcggaaccggtaacggggtaaccgtaaagggtacggtaacgacgttaacccggaaagggtaccgttaaacgggtgggttaccgtaccggtactaaccccgtaacgttaacg

SEQ ID NO: 291156 - DNA, 578 bp, Homo sapiens
  misc_feature: GYAE6OF01CUU9C.40.77.G11.1.454.CMB.1.raw
  modified_base (279)..(279): a, c, t, g, unknown or other
  misc_feature (279)..(279): n is a, c, g, or t
  modified_base (384)..(384): a, c, t, g, unknown or other
  misc_feature (384)..(384): n is a, c, g, or t
  modified_base (432)..(432): a, c, t, g, unknown or other
  misc_feature (432)..(432): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtacctggttggcctggtatcagacaacaaaccgaggggaacncccctaagcctcctgatctaagtaaggcattctagtttaagaaaggttcgggtcccagtccaggttcaggcggcaggtggatcgtgggacagattcgctctcacntcagcacgctgcagcctagattgtagttttcgactaactttacttacncgacctaactacttatagtaatttagtttactttccgttacccgtacttacccgtttacgggacccgtaagggggtaaccgaagggtggaacgtaacgttacgaagtaccgtaagttcgggtacggccttacgcccgtaacgtacg

SEQ ID NO: 291157 - DNA, 791 bp, Homo sapiens
  misc_feature: GYAE6OF01AX0AB.40.77.G11.1.454.CMB.1.raw
tcagtctagcgactcacgaccggtgctcgatttagctagtcactcaagggaaagggggagtcagacccagtcagggacacgagcagtggacagtggacgggtccccgctcacgctccgtggggctcctgctgctcgtggcctcccgaggtcgacctaaatggtcgacactccgagtatcgaccctagtccttcccttcccaccctgtcctgcctattcgtaggtaggagacgagacgtaccacctatctacgttcggcccgggacagtacgagtacgttaagttacgttacgttgggttcggtccgttaggtactcgacgtaccgaacaaaccgggacggggtaaccgtacccctaaacggtcctaccgtacggtacttacgtaaacgttaaacggaccgtattaccggttaaggttttaacggtaaacgggttaccggggggtacccctacggttaccggtaacggtttaccgaacggtccgggtacgtaggggtaggtacgtaccggtagggaacgtaacggtaccgtttacgtccgtacctacctaacccgtaactacgtacgaccgacgtccccgtggaccgtacgtaccgtagtaagttgttacgtttcgactttaacgttacttacgttacgaacctaactacttagtacgtagttacgttaacttccgttacgttccgttaaccggtttcgaacccgggtaacggtaaccggttaaggggtacggtaagtcgtaaacggacgtacggtaacgtcgggtactacggttcaaccggtacttaccgg

SEQ ID NO: 291158 - DNA, 722 bp, Homo sapiens
  misc_feature: GYAE6OF01ER3K8.40.77.G11.1.454.CMB.1.raw
  modified_base (102)..(102): a, c, t, g, unknown or other
  misc_feature (102)..(102): n is a, c, g, or t
  modified_base (478)..(478): a, c, t, g, unknown or other
  misc_feature (478)..(478): n is a, c, g, or t
tcagtctagcgactcacgaccggtgctcgatttagctagtcactcaagggaaagggggagtcagacccagtcaggacacagcatggacatgagggtccccgntcagctccgtggggctcctgctgctctggctcccaggtgcaaatgtgacatccagatcgaccctagttcctcccttcccacccttgtctcgctacttcgtaggtaggagacgagtacgtaccactatccacgttcggacccggccagtcgagtaagttacttacggtaccgttgggtacgtccgttaggtactacgacgaccgaaaccgaaccggaaggggtaacccacccccgtaaggtcctccgtagtacttacgtaagtaacggtatacttagttaaaggttaacggaacggttcgggtacctacgtacggtacggttcaacggtcgacgtaggtcgatcggtaggaactaagtacgtcgcctacaccacgtntacgacgcgtagtccgtcgaactcgtaccgtagttacgttacgtttaatttaccgtaatttaacctttaacgttaccgtaacgtaacctaactacgttaatacgttagtttaacgtttaccgttaccgttaacccgttaccgttaccggttacggggaacccgtaaacggggtacctaaggggtaacgtagtaaccggtacgaacggtacgtacgttcggtcggtaacctctaacgtcgttacg

SEQ ID NO: 291159 - DNA, 746 bp, Homo sapiens
  misc_feature: GYAE6OF01BEI1I.40.77.G11.1.454.CMB.1.raw
  modified_base (149)..(149): a, c, t, g, unknown or other
  misc_feature (149)..(149): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtnacatccagatcgacccagtcctccttccaccctgtctgcatctgtaggagacagagtaccacctatctaacttcggcccgggaccaggtcaagtagttacttacggtaccgttggttcggccgttaggtaactcgagacctaaaccgaaaccggtagggaacctaccccgtaagccttcgtagtactactaagtaacggctattcgttaagttagaacggttcgggtacccagtccgtaggtcgaggcggtacgaggtggacgtcggtaagggtaactagtaacgttcgacctcgtaccacctagtccgaacgtccgaacgtacctcggacgacggtccgtagtacgtttacgttaactttcggtaaacctttaaaccttttacgtacccgtaacggtaaccccctaagttaacttaaggttacgttaagtttaaccgtttacctttacccgttaacccggttaaccgtttacccggttacggggaacccggtaaacggggttaacccgtaagggggtccgttaacgtaacggttaaccgaacggttaacgtaacggttcggttaccggtacgtacccggaccgtaacccgttaccg

SEQ ID NO: 291160 - DNA, 795 bp, Homo sapiens
  misc_feature: GYAE6OF01E6ERT.40.77.G11.1.454.CMB.1.raw
  modified_base (102)..(102): a, c, t, g, unknown or other
  misc_feature (102)..(102): n is a, c, g, or t
tcagtctagcgactcacgaccggtgctcgatttagctagtcactcaagggaaagggggagtcagacccagtcaggacacagcatggacatgagggtccccgntcagctccgtgggctcctgctgctctggctccgaggtgaccaaatgtgacactccagactcgacctagtcctcctccaccgtgtctgactagtcgtaggtacggacgacgacggtactaccaaccgtacgttccgtaaccggtttccgggacccgggtactaaggtaccgtaaggttaacggttaacgtttaacggtaccggttgggtcggtaccgttaggtactacgacgaaccgaaaccggaaaccggtacggggtaaccctacccgtaacgtccgtacgtacgtacttacgtaaacgtacgtacgtagtttacgttaaggttaacggtaccgggtccggtacctacggtaccggtagtacggacggtcggtaggtaggtaccggtacgttacgggacgtaaagtaccgttaccgtccgtacttaacccgacctaaccggttacgccgtaacccggtaacgccgtaccggtacggaccgttccggttacgtagttttaaagtcggttttaactaacgtaacctttaacgtttaccgacgtaaccaacgtaaacgttgttaacgttcgtttaacgttacgtttacccgtacccgtaaccgtaccgggttctaaggggacccgaaggtaacgggtagcgtaacgacgtaggaccggtacgtcgtcgggcgtacctcggtaaacctcgttaccg

SEQ ID NO: 291161 - DNA, 663 bp, Homo sapiens
  misc_feature: GYAE6OF01CNC2W.40.77.G11.1.454.CMB.1.raw
  modified_base (104)..(104): a, c, t, g, unknown or other
  misc_feature (104)..(104): n is a, c, g, or t
  modified_base (493)..(493): a, c, t, g, unknown or other
  misc_feature (493)..(493): n is a, c, g, or t
  modified_base (655)..(655): a, c, t, g, unknown or other
  misc_feature (655)..(655): n is a, c, g, or t
  modified_base (659)..(659): a, c, t, g, unknown or other
  misc_feature (659)..(659): n is a, c, g, or t
tcagtctagcgactcacgaccggtgctcgatttagctagtcactcaagggaaagggggagtcagacccagtcaggacacagcatggacatggacgggtccccgntcagctccgtgggctcctgctgctcgtggctcccgaggtcaccaaatgcgacagtccagatcgacctagtcctccttccaccctgtcctagctatcgtggaagagactaggactacacctatccgtacgttcgggcccggcaagtcaaggtattagttacgtaccgttggtcggtcctaggtacacgaacgtaccaaacgtaaacccgggaagggaaccctaccccgtaagtcccgttaccgagtaactacgtaaacgaaggtctaagttacgttaaggttaaggaacgggttcccgggtacctaacgttaccgacggttacgaaccggtggtacgaagggttcgaactcggtacggaatacgttacgtcgtactacaccgaacttacncgacgacgaccgtactcgacgtacgtacgtagtacgtagttacgtacgtacttactacttacgtacgaacctaagtactagtattagtacttactacgttaccgtacgtacgacgtacgacggtacgaggacgagactacgagtcgacgtgtacgacgtacncgtntacg

SEQ ID NO: 291162 - DNA, 908 bp, Homo sapiens
  misc_feature: GYAE6OF01BFKEI.40.77.G11.1.454.CMB.1.raw
tcagtctagcgactcacgaccggtgctcgatttagctagtcactcaagggaaagggggagtcagacccagtcaggacacagcatggacatgagggtccccgctcagctcctgggctcctgctgctctggctcccgaggtgccaaatgtgacatccagatgacccagtcctccttccaccctgtctgcatctgtaggagacagagtcaccatcacgttcggccggaccagtcagtagttatagtaccgtgggttcgcctggtactcgagaccaaacgaaaccggaggggaaccaccccgtaaagtcctaccgtagacttactaagtaaggctaattcgttaaaggtttaaggaaagggttcgggtacccctaagttaccggtacggttacgaacggcggtacgaaggttcggtacgttcggtaacggggaacgtaaggttaaactttaccggcctttaccgtaacccgtacccttaacgttaccgaacggtaccgtaaccggttccccgttacgggaacccgtaacggtacccgttagggtaacgttttacgggtttaaccgtttttaacgaacccgttttaaaaaccttttacgttttaaaccccgtttaccggaaaaccccccttttaaaagtaacccttttaaaggttaaccggtttaaaactttttaaaaccggggtttttacccttttaaccccggttttaaccccccggtttaaacttaaccccccgggtttttacggggggaaaccccccggtaaaacgggggggttaaaccccggttaaaggggggttaaaccgggtaaccggttaaacggttaacccggaaacggggtaaccccgttaaacccgggtttgggtaacccgggttcccggtaacggtacccccgttaaaccgtttacccggg

SEQ ID NO: 291163 - DNA, 843 bp, Homo sapiens
  misc_feature: GYAE6OF01ES5S2.40.77.G11.1.454.CMB.1.raw
  modified_base (205)..(205): a, c, t, g, unknown or other
  misc_feature (205)..(205): n is a, c, g, or t
tcagtctagcgactcacgaccggtgctcgatttagctagtcactcaaagggaaagggggagtcagacccagtcaggacacagcatggacatgacgggtccccgctcagctccgtggggcctccgtgctgctcgtggcctcccgaggtgaccaaatgtagacatccagatcgaccctagttcctcccttcccacctgtcgtcgctntcgtggacggagacgagacgtcaacctatacctacgttcggcccggtactagtcgaagtacgttaacgttacgtaccggttggttcggtcgttaggtaactccgaaacgtaccaaaacggtaaaacccggaacggggtaaaccctacccctaacgtccccgttacgcggttaacttaaccgtaagtaccggtacttagtaaggtttaacgttaaaggtaacggttccgggaccctaaggttccggtaacgtccggaacggtcggtaacgaggttaggcgtaggtacggtaacgtaacgtacgtcgaaccgtttacacccaacgttacgacgacgacgtacgaccgtcgaaccgtcgtacgtggttactttacgttacgtttaacgtaaccgttttaacgttaccgtaccgttaaccaacccgtaaactaacgtttaacggtaacgttttaaccgtttaacttttaacccgttaacccggtttaacccgttacccggtttaaccgggttaccggggaaacccgggttaccgggtaaaaccggttaggggtaacgggtaacttacggtaaacccgggtaaacggtacccggttaacggttccgggtaagtacccgttacgtccccgtaaaccgtttccgg

SEQ ID NO: 291164 - DNA, 767 bp, Homo sapiens
  misc_feature: GYAE6OF01BPUUV.40.77.G11.1.454.CMB.1.raw
  modified_base (101)..(101): a, c, t, g, unknown or other
  misc_feature (101)..(101): n is a, c, g, or t
tcagtctagcgactcacgaccggtgctcgatttagctagtcactcaagggaaagggggagtcagacccagtcaggacacagcatggacatgagggtccccntcagctctgggctcctgctgctcgtggcctcccgaggtcgaccaaatgtagacactccgagactcgaccctagtcctccttcccacctgtctgctatcgtggtagagacgagtacgtcacctatcacgttcggccgggaccagtcaggtagttacgttacgtccgtggttcggccgtggtactacgacggtaccaacgaaccggagggaacgaccccgtaagtccgtccgtagacttacgtaagtaacggtctacttacgttaagttaacggaaacggttccgggtaaccctagttaccggtacggttaccgacggtccggtacgtaacggtacggtacgtcggtaacgggaacgtaacggtaacgttccgaccttccgacctaacctacgtaccgacgacctacggtcccgtagacccgtacgtccgtagttacgttagtttacgtttacggtaacctttaaccgtttactacggtaacctaacccgtaacggttacttaacgttacggttaactttaccggttttaacctttacccgtacccgttaccggttacccggttacgggaaacccgggttaacggggtaaaccgtaggggtacgagttaaccgtaacggaacgggttacgtacggttcggtacggaccgtccggtcccgtagttaccg

SEQ ID NO: 291165 - DNA, 605 bp, Homo sapiens
  misc_feature: GYAE6OF01A9A1U.40.77.G11.1.454.CMB.1.raw
tcagtctagcgactcacgaccggtgctcgatttagctagtcactcaagggaaagggggagtcagacccagtcaggacacagcatggacatgagggtcccccgctcagctcctggggctcctgctgctctggctcccaggtgccaaatgtgacatccagatgacccagtctccttccaccctgtctgcatctgtaggagacagagtcaccatcacttggccgggccagtcagagtattagtaccgtggttcggcctggtatcgagaccaacaaaccgaggggaacgcccctaagcctcctgatctagtaaggctatactagtttaagaaggttcgggtcccagtccgagttcgagcggtgaggtggatcggtagggacaagtaagttccgtactcctcacctatccgagtcaacgcctgcctagcctgacttgtagtttcacgttaacttcgtactacgacctaactaacgtattaggtactttacgttattacccgttaccgtaccttacggtttcgaccggtacgggtaaccgtagggtacgtacggtaacgtacggtaacggaacgtacggttcggtacgggtacaccggtcctaaccgttcg

SEQ ID NO: 291166 - DNA, 580 bp, Homo sapiens
  misc_feature: GYAE6OF01BOTVM.40.77.G11.1.454.CMB.1.raw
  modified_base (291)..(291): a, c, t, g, unknown or other
  misc_feature (291)..(291): n is a, c, g, or t
  modified_base (337)..(337): a, c, t, g, unknown or other
  misc_feature (337)..(337): n is a, c, g, or t
  modified_base (347)..(347): a, c, t, g, unknown or other
  misc_feature (347)..(347): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtacctggttggcctggtatcagcaacaaacgaggggaacgcccctaagctccgngatctataaggcatctagttagaaggtgggcccatcaggtcagcgnaggtgatcgnggacagtactcgctctacactatacagcagcctgacacgtcctgacttgtacttttcgacgttaaactttaactttcctacgtacctaaacgtacttagtacgttaatttaacgtttactttacccgtaccgtttaaccctaccggtttacggacccggtaacgggggtaacctaaggggtgaacggaactacggaaacgtcgtaacgtgggtacggactcggcctaactacg

SEQ ID NO: 291167 - DNA, 798 bp, Homo sapiens
  misc_feature: GYAE6OF01EP3A6.40.77.G11.1.454.CMB.1.raw
  modified_base (103)..(103): a, c, t, g, unknown or other
  misc_feature (103)..(103): n is a, c, g, or t
tcagtctagcgactcacgaccggtgctcgatttagctagtcactcaaggggaaagggggagtcagacccagtcaggacacagcatggacatgagggtccccgntcagctccgtggggcctcctgctgctctggcctcccaggtgaccaatgtgacatccagatcgaccctagttcctcccttcccacccttgtcctgctagttcgtaggtaggagacaggtactaccacctatctacgttcggcccggtaccagtcaaggtagttacttacggttacgttgggttcggtccgttaggtactacgacgtaaccgaaaccggaaaaccggacggggtaaccctaccccgtaacgtccttaccggtagtaccttaacgtaacggtacggtactacgtttaacggtttaacggtttaaacgggaacgggttccgggtaccctacggtaccgtacgggtacgacggccggagtacggtacgtacgtcggtaacgggtaacgtacgttaccgttccgtaccttaccgtacctaaccgtactccggaacgtccggtacgtccgtacgggtacccgtaccggtacgttagttacgttacgtttagttttaccgaacgttttaagtttaccttaccgtaccgaaccttaacgtactttaagtacgtttaagtttaccttacgtttcccgtaccgttacccgttcggtaccggggaacggtaacccgggtaacttaacggggacgtaaggtaactaacgggacgtacggtaccgttacggggctacccgggtactaccgtaagttccg

SEQ ID NO: 291168 - DNA, 591 bp, Homo sapiens
  misc_feature: GYAE6OF01DWP3N.40.77.G11.1.454.CMB.1.raw
  modified_base (279)..(279): a, c, t, g, unknown or other
  misc_feature (279)..(279): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtcctccttccaccctgtctgcatctgtaggagacagatcaccatcacgttcgccggccagtcagagttattagtacgtggttcggctggtatcagacaacaaccgagggaacncccctaagctctagactactagtaggactattacgtaggtttaaggaaacggttcggggtacccagttaccgtaggttcacggtcggacgtaggtggagtcgtagggactaagtacttcgctctacaccatacgacgcacgtcctacgacgtcgactgagttgttatttacgacttaactttacttaactacacctaactactatagtattacgtttacttaccttaccgtacttacgttccggacgtacgggtacgaagggtcgtaagtacgtacgaacgtcgaacgttggacgtctacgccgtacttacg

SEQ ID NO: 291169 - DNA, 532 bp, Homo sapiens
  misc_feature: GYAE6OF01BDIHO.40.77.G11.1.454.CMB.1.raw
  modified_base (528)..(528): a, c, t, g, unknown or other
  misc_feature (528)..(528): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccagtgccaaatgtgacatccagatgacccagtctccttccaccctgtctgcatctgtaggagacagagtcacatcacttgccgggccagtcagagtattagacctggttggcctggtatcagcaacaaaccgaggggaacgcccctaagcctcctgactctaataaggcatctaagtttaagaaagtcggggtacccatccgaggttcagcggcaggtggatcgtgggactagaacttcgctctcaccatcagccacgcctgcgagcctgtatagtattttgactaacttattactcgaccaacacttatagtattacgttacttcctaccgtactaccgttggaccgtagggaccgtagggtgtagatcgaacgcgaacgtggtacgctcgcncctg

SEQ ID NO: 291170 - DNA, 860 bp, Homo sapiens
  misc_feature: GYAE6OF01DP9W7.40.77.G11.1.454.CMB.1.raw
tcagtctagcgactcacgaccggtgctcgatttagctagtcactcaaggggaaagggggagtcagacccagtcaggacacagcatggacatgacgggtccccgctcagctccgtggggctcctgctgctctggctcccgaggtgaccaatgtgacatccagatcgacccagttcctcccttcccacccgttgtctcgctattccgtaggtaacggagacgaggtacgtaccaccgtaactccgtacgttccgggcccggaccgtacggtaccaggtaacgttagtttacggtaccgttcgggttcgtccgttaggtactaccgaacgaccaaaccgaaaccggtaacggggaaccctacccctaggacccttaccgtaatccgttataacggaaggtacctaacgtttaacgttaaggtttaacgggtaaccgggttacgggtacccctacgttaccggtacgggttaccgacggtcggtaaccggtaggttaacggtgttaacggtacgggtaagttacggtaacttcggaccttaccgtacctaaccgtacgtaccgaacgtaccgtcgtccggtaagtccgaaccttcggaatttaggttacgtttaacgtttacgaaacccttttacgtttaaccttacggtaaccgtaacccttaagtcgtttaagtttaaccgtttaacgtttttaaccgttttccgttaaccccggtttacccgttaccggtttaaccccgggtacggtacccgggtaacggggtaaaccgttagggggtaactaagggttacctaaacgggtacggttaaaccggttacgggtaccggtacccggttattacccgggaaccttaccgttacg

SEQ ID NO: 291171 - DNA, 739 bp, Homo sapiens
  misc_feature: GYAE6OF01A5W14.40.77.G11.1.454.CMB.1.raw
  modified_base (102)..(102): a, c, t, g, unknown or other
  misc_feature (102)..(102): n is a, c, g, or t
  modified_base (127)..(127): a, c, t, g, unknown or other
  misc_feature (127)..(127): n is a, c, g, or t
  modified_base (198)..(198): a, c, t, g, unknown or other
  misc_feature (198)..(198): n is a, c, g, or t
  modified_base (519)..(519): a, c, t, g, unknown or other
  misc_feature (519)..(519): n is a, c, g, or t
  modified_base (608)..(608): a, c, t, g, unknown or other
  misc_feature (608)..(608): n is a, c, g, or t
tcagtctagcgactcacgaccggtgctcgatttagctagtcactcaagggaaagggggagtcagacccagtcaggacacagcatggacatgagggtccccgntcagctcctggggctcctgctgctntggctccaggtgaccaatgtgacatccagatcgacccagttctcccttccaccctgtcctgactagttccnggtaggacgacaggtacgtaccaaccgtatcctaacgttcggcccggggtacccaaggtctaaggtagttacgttttacggttaacccgttggggtttcggcccgtttaggggttactaccgaacgccaaaccgaaaaccggaagggggtaacctccccctaaaggtcccttccgtagtacttactaataacggcctatttacgtaagttttaggaaacggttcggggtacccctagtaccgtagggttccaggtaccggtgaacggttggaacttggacggtaacaggtactcggaccttccgactaacctacgacgtanaacccggtcgtccgtgtaccgaccgtcgtcgttagtagtttaaccgttttagaactttaaccgttaatttaccggtacaaccctttaancctaagtttacgattttacgttacttcccgttacgttacctccgttaggacccggtacgggtagacggtaagggtataccgtaacggtaccgtacggtaagtcggttacggacgtaccgactaaccgttcg

SEQ ID NO: 291172 - DNA, 715 bp, Homo sapiens
  misc_feature: GYAE6OF01ENL5G.40.77.G11.1.454.CMB.1.raw
  modified_base (105)..(105): a, c, t, g, unknown or other
  misc_feature (105)..(105): n is a, c, g, or t
  modified_base (367)..(367): a, c, t, g, unknown or other
  misc_feature (367)..(367): n is a, c, g, or t
  modified_base (546)..(546): a, c, t, g, unknown or other
  misc_feature (546)..(546): n is a, c, g, or t
  modified_base (561)..(561): a, c, t, g, unknown or other
  misc_feature (561)..(561): n is a, c, g, or t
  modified_base (575)..(575): a, c, t, g, unknown or other
  misc_feature (575)..(575): n is a, c, g, or t
tcagtctagcgactcacgaccggtgctcgatttagctagtcactcaaggggaaagggggagtcagacccagtcaggacacagcatggacatggacgggtcccccntcagctccgtggggcctcctgctgctcgtggcctcccgaggtcgaccaaattgtacgacatccgaagactacgaaccctgttcccttaccccttacccaccctggtctcgctattcgaggtaagacgactagcgtacacctatcgtacgtccggcccggactagacgtaggtattacttacgtaccgtggttcggacgttaggttacacgacgtaaccaaaccggaaacggaacggggaaccacccctaacggtacttaccnggtaacttaacgtaacggtaacgtactaacgtttaacggttaaaggttttaaacgggaacgggtttacccgggtaaccctaacgttcccgttaagggtcgaacggttccgagtaggtcgaattcggaggtaacaagttacctcgtactccactacagcgacacgcgtccaggtcacgtntagatagttacttanaacgttaatactancgactagtactaagtactagttactattacgtttacctaccgtaacttcggttacgggaaaccggacgggtaaacggagggtagaacgtaaacacggtaaacgtacggtaacgtgggtccggtaacctcggtaacctacg

SEQ ID NO: 291173 - DNA, 806 bp, Homo sapiens
  misc_feature: GYAE6OF01AHWP5.40.77.G11.1.454.CMB.1.raw
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaatgtgacatccagatcgacccagtctccttccaccctgtctcgcatctggtaggagacaggacgtccaccgataccacgtttcggcccggcagtcaggtagtactttaggtacctggttcggccgttaggtactcgagtaccgaacgaaaaccgaaggggaaccgtacccccgtaaggtcccttaccgttagtaacgttactaacgttaacgggcctaacgttacgtttaacggtttaaacggtaaacgggttccgggggttacccctaggtacccgtacggtttacgaacggtccggacgtaggtacggactcggtagggacgtaggtaaacttccggacttaccgtcgtaacctacgtacgacgaccgacgtacccgttcgaccgtacgtccgtacggtactacggtttacttttacgaacgttaaccctttataccctaggttaccccaaacgtacccttaattacgtaactttaacgtttactttacccgttacccgggttacttacccgggttttacgggacccggtaaaagggggttacccgaaacgggggtttaccgggtaaaaggtaccggttaaaccgggtaaacccgtacggggtaaaccgttagggtttacccggaacccggtttaacgggaccccttaaaccggttaccgg

SEQ ID NO: 291174 - DNA, 697 bp, Homo sapiens
  misc_feature: GYAE6OF01BJPHP.40.77.G11.1.454.CMB.1.raw
  modified_base (102)..(102): a, c, t, g, unknown or other
  misc_feature (102)..(102): n is a, c, g, or t
  modified_base (691)..(691): a, c, t, g, unknown or other
  misc_feature (691)..(691): n is a, c, g, or t
tcagtctagcgactcacgaccggtgctcgatttagctagtcactcaagggaaagggggagtcagacccagtcaggacacagcatggacatgagggtccccgntcagctccgtgggctcctgctgctctggctcccaggtgccaaatgtgacatccagatcgacccagtcctccttccaccctgtctgcatctggtaggagacagagtaccacatcacgttcggccggcagtcagtagttagttacgtaccgttgggttcgtccgttggtactacgacgaccaaaccgaaaccggacgggaaccgtaccccgtaacgccgttaccgtaggtacttacgtaagtaacggtctaacttacgttaaggtttaacggtaaacgggttccgggtaccctaacgttccgtaacggttaccgaacggtccggtacgtaacggtcggtaacgtcggtagggtaacgtaagttaaacgtccgtacctccgtaaccgaccgtacgtacgacggtaccaccggtcccgtacgacccgtacggtccgtatacggttacgttaagttttacgaacctttaagtttacttaaccgaccgtaacctaacgtacttacgtagttacttacgtttacttccgtacgtaccgtacggttacggacggtacggacgtaggtacgatacggtagacgtagtacgtgcagtcngccgtg

SEQ ID NO: 291175 - DNA, 816 bp, Homo sapiens
  misc_feature: GYAE6OF01EI5ON.40.77.G11.1.454.CMB.1.raw
  modified_base (107)..(107): a, c, t, g, unknown or other
  misc_feature (107)..(107): n is a, c, g, or t
tcagtctagcgactcacgaccggtgctcgatttagctagtcactcgaaaggggaaagggggagtcagacccagtcaggacacagcatggacatggacgggtccccgntcagctccgtgggcctcctgctgctcgtcggcctcccgagggtcaccaaagtgtacgaactactaccgaagtactacgaaccccgtgttcccttccccgttccctacccgttgttcctgactacgtctagggtaacggaacgaccgtagtacgtaccaacctagttccgtaccgttaccggcccggtaccagtaccgtaaggttagttaacgttacggtacggttaggttcggtacgttaggtactacgaacgaccgaaaaccgaaaccggaacgggaacccgtaccccgtaacgtccctacgtagtacgtagttaacgaacgtacgtacgtacgttaaggttaacggtaacgggttccggtactacgtacggtaggtacgcgacggagtacgtaggtaccgtcggaacggtaactaagttactaccggtacctacgtaacccgactaacccgtacgtacgacccggtacgtcggtaccgacgtccgtacgttacgttaacgtacgtttacgttaccgtaacgttactttaacgtacgttacctacgtaacctagttaactagttactttaacggttacccttaccgttaccgtttaccgtaaccggttccggaaccgggttaacgggtaaccgggtaggtaaccggataaacggtacggaacggttcccggtaagtccggggtacaaccgtcgtaccgtaacggttcc

SEQ ID NO: 291176 - DNA, 838 bp, Homo sapiens
  misc_feature: GYAE6OF01E172N.40.77.G11.1.454.CMB.1.raw
  modified_base (308)..(308): a, c, t, g, unknown or other
  misc_feature (308)..(308): n is a, c, g, or t
  modified_base (482)..(482): a, c, t, g, unknown or other
  misc_feature (482)..(482): n is a, c, g, or t
tcagtctagcgactcacgaccggtgctcgatttagctagtcactcaagggaaagggggagtcagacccagtcaggacacagcatccggacatggacgggtccccgctcagctccgtggggcctcctgctgctctggctcccaggtgccaaatgtgacatccagatcgaccctgtccttcccttcccaccctgtcctagctattcgtggtaggacgacagtacgtccaacctagtctaccgttcggcccgggacctagtacaggtaagttactttacggtaccgtggggttcggtccgtagggttaacnccgtaacggaccaaaccggaaaaacccgggaacgggggaaaccccaccccccggttaaagcccttaccccgtaggtaaccttaccgttaaggtaaaccggtctagttacgtttaacggttttaaggaaacggttcgggtaccctacgtccggtaaggttccgaacgggtaccgngtaacgggttcggtagttacgggtcgggaacgtagttaaaccgtccgtaccgttcccgtacctaccgaactaccgcgggtaccctaccggtcctacggaccgtacgttaccgtagtacgtttacgtagttttaccgaactttaacgtttacttaacccgtcgaacctaactttcgtaagttacgttaacgtttaacgtttaccgtttaccgtaccctttaaccggttaccccggttcggtaaacccgggttaacggtacccggtaacggttaaacgggttaggtaacggtaacgttacccgggaaaggttacccggttaaacgtcggttaaccgggcccgttaagaccccgttacg

SEQ ID NO: 291177 - DNA, 871 bp, Homo sapiens
  misc_feature: GYAE6OF01CDQDH.40.77.G11.1.454.CMB.1.raw
  modified_base (103)..(103): a, c, t, g, unknown or other
  misc_feature (103)..(103): n is a, c, g, or t
tcagtctagcgactcacgaccggtgctcgatttagctagtcactcgaaggggaaagggggagtcagacccagtcaggacacagcatggacatgagggtccccnctcagctccgtggggctcctgctgctctggctcccgaggtcgaccaaatgtgacatccgagatcgaccagtcctccttccgaccttgtcctgactagtcgtggtaaggagacgagactaccaccatccgtacgttcggaccggcagtacgagagttattacggtcgttggttcggcgttaggtactcgaacgtaccaaaccggtaaaaccggaacgggggtaacctaccccgttaaacggtcccctttacccgtaacggtaactttaaccgtaaacgggttaaaccggtcgttaaacggttttaaaccggttttaaaagggtttttaaaacgggtaaaaccgggggttcccggggttaaccccttaaaacggtttacccgggtaacggggtttaccaaaggggtccgggtaaacgtacgggttaacgggtacgttaacgggtaacgggtaaaccgtaacgtttaacgttcccggacctttaaccggtaaccaacgttacgtacgaccgggtactacccggtcgtaacgcgtaacggtacctaggaacttttcgttaacgttttaccgtacttaaacctttcgttaacgacctaacccgttaaataccttaggttaacgttaacgttttagtttacccttacgtaaccccgttttaggtaccgtaacccgggggtaacgtaccggggtaacggttaacgggtcgtaaattaccggaaacttacgggaacgttacgttggggtacctaccggactacccgtaacccgttg

SEQ ID NO: 291178 - DNA, 741 bp, Homo sapiens
  misc_feature: GYAE6OF01AWNCA.40.77.G11.1.454.CMB.1.raw
tcagtctagcgactcacgaccggtgctcgatttagctagtcactcaagggaaagggggagtcagacccagtcaggacacagcatggacatgagggtccccgctcagctcctggggctcctgctgctctggctcccaggtgaccaaatgtgacatccagatcgacccagtcctccttcccaccctgtctgctatcgtaggtaggagacagacgtccaccatctacgttcggcccggccagtcaggtattagttacgtaccgtggttcggccgttggtactcgagaccaaccgaaaccggacggggaaccgtaccccgtaacgcccttccgtagtacttacgtaagtaacggtactaacgtttacgttaaggtttaacggaaacgggttccggggttacccctacgttaccggtaacggttaccgaacgggtccggacggtagggtacggtacgtacggtaggggtaactaacgtaacgttccgtaccttacctaccaaccgtacgtaccgacgtacccgacggtcctacgtacccgaccggtccgtagtacttacgtttacgttttacgtaacctttaacgtttactacgtaccgaaccctaagtacttaatacgtaagtttacttaccttcccgttaccgttaccgttaccgttaccgggaccggtaccgggaacgtagggtacggagtacggaccgtaacggtacgtacggtcggtacggactccgaccgtaccgttacg

SEQ ID NO: 291179 - DNA, 574 bp, Homo sapiens
  misc_feature: GYAE6OF01BNIIG.40.77.G11.1.454.CMB.1.raw
  modified_base (309)..(309): a, c, t, g, unknown or other
  misc_feature (309)..(309): n is a, c, g, or t
  modified_base (417)..(417): a, c, t, g, unknown or other
  misc_feature (417)..(417): n is a, c, g, or t
  modified_base (565)..(565): a, c, t, g, unknown or other
  misc_feature (565)..(565): n is a, c, g, or t
tcagtctagcgactcacgaccggtgctcgatttagctagtcactcaagggaaagggggagtcagacccagtcaggacacagcatggacatgagggtcccccgctcagctcctggggctcctgctgctctggctcccaggtgccaaatgtgacatccagatgacccagtctcccttccaccctgtctgcatctgtaggagacagagtcaccatcacgttcggcccgggccagtcagagtattagtccgtggttggccgtggtatcagacaaccaaaccgaggggaacgcccctaagcctcgtgatctaanaggcatcgtaagttaggaaggtcgggtacccatccgagtcaggcggatggtgatcgtgggacagtaacttcgctcctacacctactcacgccagtcctgcagcctagntgtatttgacttacttactactacgacctaacgtctaagtacgtacttacgtttacttacccgttacccgtaccttaccggttacggacccggtaacgggtaccgtaagggtacggagtacgtacgtaacgcgtaacgtgtcgagtcnccgtactcg

SEQ ID NO: 291180 - DNA, 785 bp, Homo sapiens
  misc_feature: GYAE6OF01ANLCK.40.77.G11.1.454.CMB.1.raw
  modified_base (172)..(172): a, c, t, g, unknown or other
  misc_feature (172)..(172): n is a, c, g, or t
  modified_base (364)..(364): a, c, t, g, unknown or other
  misc_feature (364)..(364): n is a, c, g, or t
tcagtctagcgactcacgaccggtgctcgatttagctagtcactcaagggaaagggggagtcagacccagtcaggacacagcatggacatggacgggtcccccgctcagctccgtggggctcctgctgctctggctcccgaggtgaccaaatgagacatccgagatcgaccngtcctccgttccacctgtctgcacttcgtagtaaggagtacaggtacgtaccacctactctaacggttccggccggggtcctaggtacgtaagtacgttaagtacgttaccgtgggtttacggccttaggtactacgaacgaccgaaaccgaaaccggggaggggtaaccctacccgtagtcccttaccgtnacgttactaacgttaaggcctaagtttaaccggttaaggtttaaacgggaacgggtttacccgggtacctagttacccgggtaagtttaccgacgggaccggtacgtagggtacggtactttacggggagtaaggtaaccgtacgttccgtacttaccgaccaccgtactagtacgcgtaccggtcaccgtacgcctgtagttagttagtttcttaacggtacctaacgtttacttacgacccgtaacttacgtattaacgacgtttaagtttaaccgtcgtttaccgtacccgttaacgtcccgggttacgggtaccggtaaacggggtaaccgtacggggttaacgcggttaacaaaccgggttaaggttaacccgaagggttcggtacggtaccggtaccttcccggatttaacccgg

SEQ ID NO: 291181 - DNA, 698 bp, Homo sapiens
  misc_feature: GYAE6OF01AISED.40.77.G11.1.454.CMB.1.raw
  modified_base (198)..(198): a, c, t, g, unknown or other
  misc_feature (198)..(198): n is a, c, g, or t
tcagtctagcgactcacgaccggtgctcgatttagctagtcactcaaggggaaagggggagtcagacccagtcaggacacagcatggacatgagggtccccgctcagctcctggggctcctgctgctctggctcccaggtgccaaatgtgacatccagatgacccagtctccttccaccctgtctgcatctgtagganacagagtcaccatcacttcggccgggcctaggtccagtagttacttacgttaccgtggttacggcctgggtatcgtagaccaacaaaccgaggggaacgccccgtaagcctcctagactctagtaacggcattacgttaaggtttaaggaaacggttcgggggttaccccaacgttacccgagggtttaccgacggcgggacgacggttgggaacgtccggttaggggaaccagggtaaactttcccgggaccttacctacgtacccgtaactacgaacgtacccgacgtaccgtacggacgtacggcccttacggatttacgtacgtttttaacgaccgtttaactttaactttaccgtacgtacctaactaacttagtaacggtaactttaacggtttacttacccttaccggtaacttaccgttacgggtccggtaacgggtacgtaacgggtaggacgtagtacgagtacggtactagggcgatacggcctactcg

SEQ ID NO: 291182 - DNA, 638 bp, Homo sapiens
  misc_feature: GYAE6OF01B5Q4N.40.77.G11.1.454.CMB.1.raw
tcagtctagcgactcacgaccggtgctcgatttagctagtcactcaaggggaaagggggagtcagacccagtcaggacacagcatggacatgagggtccccgctcagctcctggggctcctgctgctctggctcccaggtgaccaaatgtgacatccagatgacccagtcctccttccaccctgtctgcatctgtaggagacagactcaccatcacgttcggccggccagtcagagtattacgtacgtggttcgccgttggtatcagaccaacgaaaccggaggggaaccacccctaagcctcgtagtactacgtaagtaggactagttacgttaaggttaaggaacggtcgggtacccagttccgtaggttacgaggccggacgtaggtggacgtcggtacggacgtaagtacgttcgtctactaccgactactacgacgacacgtctacgcgacgtcgtagtacttgttaactttcgaacgttaaactttactacgtacgtaaccctaacgtacttaagtagtaacgtttacgttacttaccgtaccgttaccttccggttacggaccggtaagggtaaccgtagggtagaacgtagtacgaacgtacgacgttggtacgcgtacgacctcgtacg

SEQ ID NO: 291183 - DNA, 735 bp, Homo sapiens
  misc_feature: GYAE6OF01D0B3P.40.77.G11.1.454.CMB.1.raw
  modified_base (101)..(101): a, c, t, g, unknown or other
  misc_feature (101)..(101): n is a, c, g, or t
  modified_base (138)..(138): a, c, t, g, unknown or other
  misc_feature (138)..(138): n is a, c, g, or t
  modified_base (722)..(722): a, c, t, g, unknown or other
  misc_feature (722)..(722): n is a, c, g, or t
tcagtctagcgactcacgaccggtgctcgatttagctagtcactcaagggaaagggggagtcagacccagtcaggacacagcatggacatgagggtccccntcagctcctgggctcctgctgctctggctcccaggtnccaaatgtgacatccagatgacccagtcctccttccacctgtctgcctatcgtagtaggagacaggatacacagtcacgttcgccggccagtacagtagttattagaccgttggttggcctaggtatcagacaacaaacgagggaacctaccctaagtcctacgtagacttaacgtataaggtcaagttacgtagttttaacggaaaagggttcgggtacccctaagttacccggaaggtttaccgaacggtaccggactaagggttcggaacgtttccggaaggggtaacaagggttaaacctttccggacttacccttaccaaccgtaattaccggaacgccgtaaacgcccgttaagacccgacggtaccctaagggtattacggtttaacttttcgaaactttaaactttaattacggtacctaaaccttaactaaacttcgttaaagttaagtttaacgttttaaccgttacctacccgttaaccgttaccgggtttcggaaacccgggttaacgggaaccggtaaggttaggaacgtactaacaaacgggtcgtaaacgtcggttacggaccgttacncccgtaacgtacg

SEQ ID NO: 291184 - DNA, 899 bp, Homo sapiens
  misc_feature: GYAE6OF01CKQNK.40.77.G11.1.454.CMB.1.raw
  modified_base (105)..(105): a, c, t, g, unknown or other
  misc_feature (105)..(105): n is a, c, g, or t
tcagtctagcgactcacgaccggtgctcgatttagctagtcactcaaggggaaagggggagtcagacccagtcaggacacagcatggacatggacgggtccccgntcagcctccgtgggctcctgctgctcgtcggcctcccgaggtcgacctaaatgtacgactactaccgagactccgaaccctacgttcccttaccccttcccctacccttgtcctgactacgtcgtaggtaggaacacaggtactaccaacctactaccgtcggttaccggcccggtaccagttacgtaaggtacgttaagttacgtacggttggttaccggtcgttagactaacgactacccgaaaacgaaccggtaaccgggtaaccccgtacccgtaagcccgttcgtaactaacgttacctaaaggtacggacttaacggtttaagttacggtttaaagggtacgggtcccgtacgtacgtaccggtaggtacgaacggtcggaggttacggtacggtacgtagggtacggtaacgtacgtaccgtcgtccttaaccgtacacgtacgtacgaccgtacgtaccgctaccgacgttacggtaaccgttagtttacgttacgtttacggtttaacccttaaccgtttaaccggtttaacctacccggtttaactaacccgtttaacttaacgggttttaaactacggtttttaaacccttacccggttttaccgtttaacccccggttaaccggttacccgtttaaaccggggtaaaccgggttaacccccgggggttaaaggttacggggaaaccgggtttacggtaaaccaacgggtttcccgggtaaacgttaacccggttaggttaccccgggacgttacgaaaccccgttcgtaaacccgttttcgg

SEQ ID NO: 291185 - DNA, 810 bp, Homo sapiens
  misc_feature: GYAE6OF01AKDEN.40.77.G11.1.454.CMB.1.raw
tcagtctagcgactcacgaccggtgctcgatttagctagtcactcaaggggaaagggggagtcagacccagtcaggacacagcatggacatgagggtccccgctcagctccgtggggctcctgctgctctggcctcccgaggtgccaaagtgtgactatccagatcgaccccagtcctccgttccacctgtctgcatcgtaggaggagacagtagtccaacctctaccgacgttccggccgggtacctaaggtccgaaggttaacgtttagtttaaccggttccggttcgggttaccgggtccgttagggttaacgttaccacggtaacccaaaaccggaaaacccggggaaccggggtaaacccgtaccccccggttaaagtccccgttaccgtacgtaacgtaccgttaaaggtaacggtaccttaagtttaccgttttaaagggtttaaacgggaaccgggtttccgggtaccctacgttacggttaacgggttcgacggtcggtaccgtggtaggtacgtcgtacgggtaactaaggttaccgtcgtactcccgtaccgacctagtaccgcgtacgtccgacgttacgacccgtacggttacctacggttagttacgtttacgtttaaccgacttaacgtttacgtaccgtacgtacccaagttacttaagttcgttaagttaccgtttacttccgttaacccgttaccgtacggttaccggacgggtaacccgggtaggaacgggttcgaagtacgaccgaacggttaccgacggttcggaccgtacgccgaccgtcggttaacg

SEQ ID NO: 291186 - DNA, 646 bp, Homo sapiens
  misc_feature: GYAE6OF01C4Q29.40.77.G11.1.454.CMB.1.raw
  modified_base (104)..(104): a, c, t, g, unknown or other
  misc_feature (104)..(104): n is a, c, g, or t
  modified_base (219)..(219): a, c, t, g, unknown or other
  misc_feature (219)..(219): n is a, c, g, or t
  modified_base (441)..(441): a, c, t, g, unknown or other
  misc_feature (441)..(441): n is a, c, g, or t
  modified_base (486)..(486): a, c, t, g, unknown or other
  misc_feature (486)..(486): n is a, c, g, or t
  modified_base (555)..(555): a, c, t, g, unknown or other
  misc_feature (555)..(555): n is a, c, g, or t
  modified_base (563)..(563): a, c, t, g, unknown or other
  misc_feature (563)..(563): n is a, c, g, or t
  modified_base (620)..(620): a, c, t, g, unknown or other
  misc_feature (620)..(620): n is a, c, g, or t
  modified_base (638)..(638): a, c, t, g, unknown or other
  misc_feature (638)..(638): n is a, c, g, or t
  modified_base (643)..(643): a, c, t, g, unknown or other
  misc_feature (643)..(643): n is a, c, g, or t
  modified_base (646)..(646): a, c, t, g, unknown or other
  misc_feature (646)..(646): n is a, c, g, or t
tcagtctagcgactcacgaccggtgctcgatttagctagtcactcaaggggaaagggggagtcagacccagtcaggacacagcatggacatgacgggtccccgntcagctccgtggggctcctgctgctctggctcccgaggtcgaccaaatggtcgactatccagactacgacccagttcctacccttcccacccgtgtcctgctatcgtggtaaggnactagacgtccactatcgtacgtcggcccggactagtcaggtagttacgttacggtacctgggttcgcgttagtactacgaagccgaaaacgaaaccgggaacggggtaaccgaccccttaaaggtccgttacccaggtaactttacgtaagaacggtcctaagttacgtttaagggttaacgaacgggtccggtacctagtaccgtaggttcgacggcganaggtcgtactacggtacggaactagtctcgctacgcactatcganacgtaccgctacgctagtcgaagtcgtacttagtttacgactttaacgttattacgaagtaaccctaanacgtttanccgtaatttaacgtactccttaacgtccgtagttcggacggacggtactaggcgtanatcgagtcgatcggatcngaccnttn

SEQ ID NO: 291187 - DNA, 493 bp, Homo sapiens
  misc_feature: GYAE6OF02FX7DB.40.77.G11.1.454.CMB.1.raw
tcagtctagcgactcacgaccggtgctcgatttagctagtcactcaagggaaaggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtacctggttggcctggtatcagcacaaaccaggggaagcccctaagctcctgatctataaggcatctagtttagaaagtgggtcccatccaggttcagcggcagtggatctgggacagaattcgctctcaccatcagcagcctgcagcctgatgattttgctaacttattactgccaacactatgattagttattctccgtactacctttggccaggggaccaaggtggagatcaagcgaactggtggctgcactac

SEQ ID NO: 291188 - DNA, 504 bp, Homo sapiens
  misc_feature: GYAE6OF02IM3SP.40.77.G11.1.454.CMB.1.raw
  modified_base (275)..(275): a, c, t, g, unknown or other
  misc_feature (275)..(275): n is a, c, g, or t
  modified_base (347)..(347): a, c, t, g, unknown or other
  misc_feature (347)..(347): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtacctggttggcctggtatcagcacaaaccaggggaancccctaagctcctgatctataaggcatctagttagaaagtgggtccatccaggttcagcggcagtggatcgngggacagaattcgctctcaccatcagcagcctgcagcctgatgtattttgctaactttattactcgacctaacactatgtatagttattcttccgtactacctttgaccgagggaccaaggtggaagatacaagcgaactggtaggctcgctactac

SEQ ID NO: 291189 - DNA, 489 bp, Homo sapiens
  misc_feature: GYAE6OF02G6IFX.40.77.G11.1.454.CMB.1.raw
  modified_base (275)..(275): a, c, t, g, unknown or other
  misc_feature (275)..(275): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtacctggttggcctggtatcagcacaaaccaggggaancccctaagctcctgatctataaggcatctagtttagaaagtgggtcccatccaggttcagcggcagtggatctgggacagaattcgctctcaccatcagcagcctgcagcctgatgattttgctaacttattactgccaacactatgatagttattctccgtactacctttgccagggaccaaggtggagatcaagcgaactgtgctgcactac

SEQ ID NO: 291190 - DNA, 512 bp, Homo sapiens
  misc_feature: GYAE6OF02GDWAT.40.77.G11.1.454.CMB.1.raw
  modified_base (365)..(365): a, c, t, g, unknown or other
  misc_feature (365)..(365): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtacctggttggcctggtatcagcacaaaccaggggaagcccctaagctcctgatctataaggcatctagtttagaaagtgggtcccatccaggttcagcgcagtggatcgtgggacagaattcgctcncaccatcagcagcctgcagcctgatgtattttgactaacttattactgtaccaactactaatgtaattagttattcttaccgtactaccgtttggaccgagggacctaagggtggagatacaagcgtacgtggtggctgccactacg

SEQ ID NO: 291191 - DNA, 507 bp, Homo sapiens
  misc_feature: GYAE6OF02IJMO5.40.77.G11.1.454.CMB.1.raw
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtccagagtattagtacctggttggcctggtatcagcacaaaccaggggaagcccctaagctcctgatctataaggcatctagtttagaaagtggggtccatccaggttcagcgcagtggatctgggacagaattcgctctcacatcagcagcctgcagcctgatgattttgctaactttattactgaccaacacttatgtaattagttattccttaccgtactaccctttgggcctaggggaccaagggtggagatacaagcgaactgtggctgccacctag

SEQ ID NO: 291192 - DNA, 564 bp, Homo sapiens
  misc_feature: GYAE6OF02IJDJV.40.77.G11.1.454.CMB.1.raw
  modified_base (327)..(327): a, c, t, g, unknown or other
  misc_feature (327)..(327): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagacctggttggcctggtatcagcacaaacgagggaagccctaagctcctgatctataaggcatctagtttagaaagtgggtccatcagttnagcgcagtggatcgtgggacagaattcgactctcacagtcacgacagcctgcagcctggaatgtattttgactaactttacttacgtcgaccaaactacttaagtgtaattagtttaacttccgttacccgtaactaccgttttcggacccgtacggggtaaccgaaagggttgggaacgtagttaacccaaaggtacgtaaaccggtggtacgggtccgtacgaccgtaacctacg

SEQ ID NO: 291193 - DNA, 496 bp, Homo sapiens
  misc_feature: GYAE6OF02FYLQI.40.77.G11.1.454.CMB.1.raw
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtacctggttggcctggtatcagcacaaaccaggggaagcccctaagctcctgatctataaggcatctagtttagaaagtggggtcccatccaggttcagcggcagtggatctgggacagaattcgctctcaccatcagcagcctgcagcctgatgattttgctaacttattactgcctaacactatgattagttatttctcctacacctttgcctagggaccaggggtggagatcaagcgaactgtaggctgcactacg

SEQ ID NO: 291194 - DNA, 511 bp, Homo sapiens
  misc_feature: GYAE6OF02IRQFQ.40.77.G11.1.454.CMB.1.raw
  modified_base (275)..(275): a, c, t, g, unknown or other
  misc_feature (275)..(275): n is a, c, g, or t
  modified_base (410)..(410): a, c, t, g, unknown or other
  misc_feature (410)..(410): n is a, c, g, or t
tcagtctagcgactcacgaccggtgctcgatttagctagtcactcaagggaaagggggagtcagacccagtcaggacacagcatggacatgagggtcctcgctcagctcctggggctcctgctgctctggctcccaggtgccaaatgtgacatccagatgacccagtctccttccaccctgtctgcatctgtaggagacagagtcaccatcacttgccgggccagtcagagtattagtacctggttggcctggtatcagcacaaaccaggggaancccctaagcctcctgatctataaggcatctagttagaaagtgggtccatccaggttcagcggcagtggatcgtgggacagaattcgctctcacatcagcagcctgcagcctgatgtatttgactaacttattacncgaccaacactatagattagttattcctccgtactaccgtttggccgtacggggaccgtaagggtcggagtactacgaagacggaactgtggctgactacg

SEQ ID NO: 291195 - DNA, 562 bp, Homo sapiens
  misc_feature: GYAE6OF02HM2W2.40.77.G11.1.454.CMB.1.raw
  modified_base (274)..(274): a, c, t, g, unknown or other
  misc_feature (274)..(274): n is a, c, g, or t
  modified_base (293)..(293): a, c, t, g, unknown or other
  misc_feature (293)..(293): n is a, c, g, or t
  modified_base (343)..(343): a, c, t, g, unknown or other
  misc_feature (343)..(343): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtacctggttggcctggtatcagcacaaacaggggacnccctaagctcctgatctanaaggcatctagttagaagtgggtccatccagttcagcggcagtggatcgngggacagaattcgctctcaccatcagcagcctgcagcctgacttgtatttgactaaactttattactgaccaaactacttaatgtaattagttactttccgtaccgttaacttaccgtttacgggacccgtacgggggaaccctaaggggtacggaagtaacgtacggtaaaccggcggtaaccgttcgggtacggtccttaggaccctaacccgtacg

SEQ ID NO: 291196 - DNA, 526 bp, Homo sapiens
  misc_feature: GYAE6OF02HJ7JT.40.77.G11.1.454.CMB.1.raw
  modified_base (275)..(275): a, c, t, g, unknown or other
  misc_feature (275)..(275): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtacctggttggcctggtatcagcacaaaccaggggaancccctaagctcctgatctataaggcatctagtttagaaagtgggtccatccagttcagcgcagtggatctggacagaattcgctctcaccatcagcagcctgcagcctgatgtatttgactaactttattactgacctaactactatgtattagttattcctaccgtactaccgtttggaccgtaggggtacctaagggtggaagtatacgaaggtccgaacgttggtacggctacggtacctaccgttag

SEQ ID NO: 291197 - DNA, 499 bp, Homo sapiens
  misc_feature: GYAE6OF02IBGDJ.40.77.G11.1.454.CMB.1.raw
  modified_base (341)..(341): a, c, t, g, unknown or other
  misc_feature (341)..(341): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtacctggttggcctggtatcagcacaaaccaggggaagcccctaaagctccctgatctataaggcatctagtttagaaagtggggtccatccaggttcagcggnagtggatctgggacagaattcgctctcaccatcagcagcctgcagcctagatgtattttgactaacttattactgaccaacactatgattagttattctctactaccttgccaggggaccaaggtggagatcgaagcgaacgtgtggctgacactacg

SEQ ID NO: 291198 - DNA, 507 bp, Homo sapiens
  misc_feature: GYAE6OF02FRCRS.40.77.G11.1.454.CMB.1.raw
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtacctggttggcctggtatcagcacaaaccaggggaagccccctaagcctcctgatctataaggcatctagttagaaagtgggtcccatccaggttcagcggcagtggatcgtgggacagaattcgctctcaccatcagcagcctgcagcctgatgtattttgctaacttattactgaccaacactatgattagttacttctccgtactaccgtttgaccgtagggaccaagggtggagacgtacgaagcgaacgtgtaggctgcactac

SEQ ID NO: 291199 - DNA, 540 bp, Homo sapiens
  misc_feature: GYAE6OF02HRHP5.40.77.G11.1.454.CMB.1.raw
  modified_base (423)..(423): a, c, t, g, unknown or other
  misc_feature (423)..(423): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtacctggttggcctggtatcagcacaaaccaggggaacgcccctaagcctcctgatctataaggcatctagtttagaaagtgggtccatccaggttcagcggcagtgatcgtgggacagtaattcgctctacaccatcagcagcctgcagcctgatgtatttgactaactttattactcgaccaanacttatgtattagttattccttccgtactaccgtttcggaccgtaggggacctaaaggggtggaacgtagtaccgaaggtaccgaacggttggacgggtactcggacctaccgtacg

SEQ ID NO: 291200 - DNA, 516 bp, Homo sapiens
  misc_feature: GYAE6OF02FHTYM.40.77.G11.1.454.CMB.1.raw
  modified_base (275)..(275): a, c, t, g, unknown or other
  misc_feature (275)..(275): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtacctggttggcctggtatcagcacaaaccaggggaancccctaagctcctgatctataaggcatctagttagaaagtgggtcccatccaggttcagcggcaggtggatcgtgggacagaattcgctctcaccatcagcagcctgcagcctgatgtattttgactaacttattactgacctaacactatagtattagttattctaccgtactacctttcggaccgtaggggaccaagggtggaagtacgtacgaagcgaacgtggtggctcgcactacg

SEQ ID NO: 291201 - DNA, 524 bp, Homo sapiens
  misc_feature: GYAE6OF02GO6QS.40.77.G11.1.454.CMB.1.raw
  modified_base (384)..(384): a, c, t, g, unknown or other
  misc_feature (384)..(384): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtacctggttggcctggtatcagcacaaaccaggggaacgcccctaagcctcctgatctaataaggcatctagtttagaaagtgggtccatccagttcagcggcagtggatcgtgggacagaattcgctctcaccatcagcagccctncagcctagatgtatttgactaacttattactgtaccaacactatgtaattagttacttctaccgtactaccgtttggaccctaggggacctaagggtcggaagacgtacgaacgtcgaacgtggtacggctacgcaccta

SEQ ID NO: 291202 - DNA, 542 bp, Homo sapiens
  misc_feature: GYAE6OF02HGBJ4.40.77.G11.1.454.CMB.1.raw
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtacctggttggcctggtatcagcacaaaccaggggaagcccctaagctcctgatctataaggcatctagttagaaagtgggtcccatccaggttcagcggacagtgatcgtgggacagaattcgctctcacatcagcagcctgcagcctgatgtattttgactaactttattactgaccaaactacctatgattagtttaacttcttacccgtactaccgtttggacccgtagggggaccctaagggtcggaaggtattacgaaacggcggtaacttcgggtacggtcgtacggtccaacctacg

SEQ ID NO: 291203 - DNA, 561 bp, Homo sapiens
  misc_feature: GYAE6OF02IPTP0.40.77.G11.1.454.CMB.1.raw
  modified_base (389)..(389): a, c, t, g, unknown or other
  misc_feature (389)..(389): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccacccctgtctgcatctgtaggagacagagtcaccatcacttcggccgggccagtcagagtattagtacctggttggcctggtatcagcaacaaaccgaggggaacgcccctaagcctcctgatctataagcatctagtttagaagtgggtccagtcaggtcacgcgcgagtgatcgtgggacagtaacttcgctctcaccatacagcagctgcngcctgatgtatttagctaaactttattactcacccaactaactagtagtattaagtttacttacgttaccttactaaccgtttcgggaccgtacgggggacctaacggggttaggaacggtacgtaccgaagtaccggaacgttcggtggtacctcggtaccctacctaccg

SEQ ID NO: 291204 - DNA, 825 bp, Homo sapiens
  misc_feature: GYAE6OF02GNPN5.40.77.G11.1.454.CMB.1.raw
  modified_base (102)..(102): a, c, t, g, unknown or other
  misc_feature (102)..(102): n is a, c, g, or t
  modified_base (123)..(123): a, c, t, g, unknown or other
  misc_feature (123)..(123): n is a, c, g, or t
  modified_base (814)..(814): a, c, t, g, unknown or other
  misc_feature (814)..(814): n is a, c, g, or t
tcagtctagcgactcacgaccggtgctcgatttagctagtcactcaagggaaagggggagtcagacccagtcaggacacagcatggacatgagggtccccgntcagctcctgggactcctcgngctcgtctcgcgccctaccggaggtccaactaagttggacaactacctacgaagtgtacccgaacccgtacgttcccctttaccccttaccccctaccgttcgttctcgacttacttcggttaagggaacggaacaacgaaggtaccgtaacccaaccttactaccttacggtcccggggaccccggacgtacgtacgaaggttaacgtttaacgtttaaccgttccgggttgggtccgtacggttagtactacgacgaaccaaaccgaaacggggagggacccctaaccgacgtcctacgtagtacttaacgtaaggtacgacttactttacggttttaaaggtaaacgggtaacgggttcccggtaacctacggtacggttacggtacgacggggccgtaaggttacgggtacggttacttacggggacggtaaacgtaagtttacgttcccgtactttcccaaccgtaactcgtaacgacggtaccgaccgtccgtacgaccgtccgtacgtaagttgtacgttttacgttacaacctttaacgtttactccgaaccgtaaaccctaagttaacttagtattaacgtttttacgttccttacccgtacccgttaacgtttccggttaccgggacggtaacgggtaacgtgggtagaactacgaacgacggtaacgtggtacggtccgngtaccactacg

SEQ ID NO: 291205 - DNA, 552 bp, Homo sapiens
  misc_feature: GYAE6OF02GNT6Y.40.77.G11.1.454.CMB.1.raw
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtacctggttggcctggtatcagcacaaaccaggggaagcccctaagctcctgatctataaggcatctagtttagaaagtgggtcccatccaggttcagcggcagtggatctgggacagaattcgctctcacatcagcagcctgcagcctgatgtattttgacttaactttattactgaccaactactatagtattagtttattccttaccgttacctaccgtttgggacccgtagggggtaacccgtaaggggttcggaagtacgtacgtaacggaccgtaacgttcggttacgggtcctcggtaccaccgtacg

SEQ ID NO: 291206 - DNA, 520 bp, Homo sapiens
  misc_feature: GYAE6OF02IRR2S.40.77.G11.1.454.CMB.1.raw
  modified_base (276)..(276): a, c, t, g, unknown or other
  misc_feature (276)..(276): n is a, c, g, or t
  modified_base (338)..(338): a, c, t, g, unknown or other
  misc_feature (338)..(338): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtacctggttggcctggtatcagcacaaaccaggggaacncccctaagctcctgatctataaggcatctagttagaaagtgggtccatccaggttcagcggnagtggatgtgggacagtaatcgctctcaccatcagacagcctgcagcctgatgtattttgactaacttattactcgaccaacactatagtatagttacttcttccgtactacgtttcggaccgtaggggacctaaggtggaacgagtacgaagaccgtaacgtggtaggctacgccactacg

SEQ ID NO: 291207 - DNA, 620 bp, Homo sapiens
  misc_feature: GYAE6OF02HZCYZ.40.77.G11.1.454.CMB.1.raw
  modified_base (249)..(249): a, c, t, g, unknown or other
  misc_feature (249)..(249): n is a, c, g, or t
  modified_base (584)..(584): a, c, t, g, unknown or other
  misc_feature (584)..(584): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatcgtgacatccagatgacccagtctccttccaccctgtctgcatctgtaggagcagatcaccatcacttgccggcagtcagatatagtacctggttgcctggtntcagcaacgaacgagggacgaccaagctcctagatacctataagctactcgtaagttttaagaaaggttcgggtaccctagtaccgtacggttacaacggccgggtacgaagggtcggtacgtttccggtagggtaacgtacggtaaagtttcccggcctttaccgaccgtaacccgtacgtacgaccgtacgaaccgtcccgtgaccgacgtccgtagtagttcgttaacgttttacgaccttaaacgtttactttaacgcgaaccttaacacgtttagctaagtttacttacttacttccgtaactacgtttcgacgtaacgggactaagggngtaacagtcaagcgtagacggtgacgtgcctatacg

SEQ ID NO: 291208 - DNA, 570 bp, Homo sapiens
  misc_feature: GYAE6OF02GYBYV.40.77.G11.1.454.CMB.1.raw
  modified_base (278)..(278): a, c, t, g, unknown or other
  misc_feature (278)..(278): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtacctggttggcctggtatcagcaacaaaccgaggggaacncccctaagcctacctgatctataaggcatctagttagaagtgggtaccatccaggttcagcggcagtggatcgtgggacagtaattcgctctcacatcagcagcctgcagcctgattgtattttcgaccttaaactttacttacctacgtaccctaaactacttaagttacgtaatttagtttaactttccgttaccgttaactaccgtttacgggaccgtacggggaaccgtaagggtcggtaacgagtacgaacggacgtaacgtcggtaggtcctaggaccaccgtacg

SEQ ID NO: 291209 - DNA, 603 bp, Homo sapiens
  misc_feature: GYAE6OF02GAZ4U.40.77.G11.1.454.CMB.1.raw
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtcctccttccaccctgtctgcatctgtaggagacagagtccaccgtcacttcgccgggccagtcagagtattagtaccgtggttggcctgtatcagcacaaacgagggaacgccctaagctcctgatctatagcatacttagttaagaaggtcgggtccactccgtaggttacgacgcggcagtggatcgtgggactagtatcgctctcaccatcacgcagcctgcacgcctagattgtacttttagacttaactttacttactcgacctaaacctattaagtgtaatttacgtttactttcccgtaccgttaaccctaccggttttcgggacccgaagggggtacccgtaaaggggtcgggtaacgtaacttaaccggaaacggtaccggtaaacgttcgggtcgggtcctacggacccttaacctcgtttacccg

SEQ ID NO: 291210 - DNA, 591 bp, Homo sapiens
  misc_feature: GYAE6OF02J007H.40.77.G11.1.454.CMB.1.raw
  modified_base (231)..(231): a, c, t, g, unknown or other
  misc_feature (231)..(231): n is a, c, g, or t
  modified_base (283)..(283): a, c, t, g, unknown or other
  misc_feature (283)..(283): n is a, c, g, or t
  modified_base (561)..(561): a, c, t, g, unknown or other
  misc_feature (561)..(561): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatccacttgccgggccagtcagngtattagtacctggttggcctggtatcgagcaacaaacccgagggggtaacnccccgttaaagcctacctggactctataaggcatctagtttagaaaggtcgggtacctagtaccaggtttcacgtcggactaggtggaactcgtcgggacagtaacttcgacgtctacgacaactcgagcagtccgtgctacgccttgattaggtctttagccgtaactttagttactaccgtacctaaacacttactgtaaactttacgtttaactttccgtaccgttaacaccgtttcgaccgtaggggacctaagggtcgaagtacaagtaacgngtaacgtggtacgcgtacgtaccaacttcg

SEQ ID NO: 291211 - DNA, 586 bp, Homo sapiens
  misc_feature: GYAE6OF02IFCWE.40.77.G11.1.454.CMB.1.raw
  modified_base (197)..(197): a, c, t, g, unknown or other
  misc_feature (197)..(197): n is a, c, g, or t
  modified_base (275)..(275): a, c, t, g, unknown or other
  misc_feature (275)..(275): n is a, c, g, or t
  modified_base (296)..(296): a, c, t, g, unknown or other
  misc_feature (296)..(296): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtagganacagacgtcaccatcacttggccgggccagtcagagtattagtactggttggctggtatcagcacaacgaggggaacnccctaagctcctgactctaanaggctatcttaagttagaaagtcgggtaccagtcgaggttcagtcggcagtgatcgtaggacagtaattcgctctcacatcgagtcagtcctgcagcctgtatgttatttcgacttaactttacttactagaccctaagacctttaatagtaatttagtttacttccgttacccgttactaccggtttacgggacccggtaacggggtaaccgtaggggtacggtaacggtacgtaacgaacgggtaccgtaacgttacgggtccggtactacgggtccctaacgttacg

SEQ ID NO: 291212 - DNA, 687 bp, Homo sapiens
  misc_feature: GYAE6OF02IN02V.40.77.G11.1.454.CMB.1.raw
  modified_base (450)..(450): a, c, t, g, unknown or other
  misc_feature (450)..(450): n is a, c, g, or t
  modified_base (479)..(479): a, c, t, g, unknown or other
  misc_feature (479)..(479): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtccaccatctacttcggccgggtaccagtcagtagtattacgtaccgtggttcggccttggtatcagacaacgaaaccgaggggaacgcccctaaggccctcctagacttacgtaacgtaaggcctaagtttaccgttaaaggttttaaggaaacgggttccggggtaaccctagttaccgtaggttacacggtcggtacgtacggtgtaacgtcgtagggactagtaacttcgcttacgacactanctacgcaacgtcctagacacgtctacgtntacgttacttacgaacttaacgtttacttacgtacgtacccgtaaacttagttaacgtactaagtttaactttacgtttaccttaacccggttaacctttacggttaacgggacccggttaacggggaacccgttaaggggtacgaggttaacttaccggaacgtaacggtaacggtggtaccggtactaccgtaccgtaccgtaccg

SEQ ID NO: 291213 - DNA, 668 bp, Homo sapiens
  misc_feature: GYAE6OF02JFOS0.40.77.G11.1.454.CMB.1.raw
  modified_base (186)..(186): a, c, t, g, unknown or other
  misc_feature (186)..(186): n is a, c, g, or t
  modified_base (294)..(294): a, c, t, g, unknown or other
  misc_feature (294)..(294): n is a, c, g, or t
tcagtctagcgactcacgaccggtgctcgatttagctagtcactcaagggaaagggggagtcagacccagtcaggacacagcatggacatgaggtccccgctcagctcctgggctcctgctgctctggctccaggtgccaaatgtgacatccagatgacccagtctccttccacctgtctgcatcngtagagacagagtcacatcactcgccgggcagtcagtatattacgtacctggttcgcctggtactcacgcaacgaaccgagggaacgccctaagctcgtagactctanaacgctatacgttagttaaggaaacggtcgggtacccagtaccgtaggttacgacggtcggacgtaggtacggatacgacggtacaagtaacgttcgacctactacaaccgtatacaggcctaggtacccgtagacccgtagtaccgtagtacgttacgttacgtttcggtaaccttaacgtttaacgttaccgtacgtaacccgtaacgttaacttaacgtacgtaacgtttaacggttaacctttcccgttaacccggttaactaaccggttacggacccggttaacggggtaacctaagggtacggtaacggtacgtaaccggaacgttacggtaacgttacggcgggttataccggtacgtaccttacgg

SEQ ID NO: 291214 - DNA, 555 bp, Homo sapiens
  misc_feature: GYAE6OF02FQ271.40.77.G11.1.454.CMB.1.raw
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggcagtcagagtattagtacctggttgcctggtatcagacacaaaccgaggggaacgcccctaagctacctgatcgtataagcatctagtttagaagtgggtaccatccgaggttcaggcggcaggtgatcgtggacagtaattcgctctcacctatcagcagcctgcacgtcctagatgtagttttagacttaactttattaactcgaacctaactactaagtacgtattagttactaccgttacctacgttaccgttacgacccggtagggaacccgaaggttcgggaagtactacgaagaccgtaacgtcggtacggtcgtcgacctacgtacg

SEQ ID NO: 291215 - DNA, 569 bp, Homo sapiens
  misc_feature: GYAE6OF02GL7H3.40.77.G11.1.454.CMB.1.raw
  modified_base (356)..(356): a, c, t, g, unknown or other
  misc_feature (356)..(356): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggcagtcagagtattagtacctggttggcctggtatcagcaacaaaccgaggggaacgcccctaagcctcctgatctataaggcatctagttagaaaggtcgggtaccatccaggttcagcggcagtgatcgtgganagtatcgactctcacatcacgcagcctgcacgctgatgttatttgacttaatttattaccgcgtaaccaatactattcgtaatttacgtttacttaccttccttaaccgttaccgtttcggaccgtacggggtaacccgtaagggtacgggtaacgtacgtactaaacggcgttaacggttcggtacggttacggtactacccgaaccttacg

SEQ ID NO: 291216 - DNA, 585 bp, Homo sapiens
  misc_feature: GYAE6OF02IXFG9.40.77.G11.1.454.CMB.1.raw
  modified_base (276)..(276): a, c, t, g, unknown or other
  misc_feature (276)..(276): n is a, c, g, or t
  modified_base (291)..(291): a, c, t, g, unknown or other
  misc_feature (291)..(291): n is a, c, g, or t
  modified_base (414)..(414): a, c, t, g, unknown or other
  misc_feature (414)..(414): n is a, c, g, or t
tcagtctagcgactcacgaccggtgctcgatttagctagtcactcaagggaaaggggagtcagacccagtcaggacacagcatggacatgagggtccccgctcagctcctgggctcctgctgctctggctcccaggtgccaaatgtgacatccagatgacccagtctccttccaccctgtctgccatcgtgtaggagacagagtcaaccatcacttgccgggccagtcagagtattagtacctggttggcctggtactcagcacaaacagggaacnccctaagctcctagntctataagcatctagttagaaagtgggtaccagtccgagttcagtcgctagtcgatcgtggacagaattcgctctcgacatcagcagcctgcagcctgtatgtatttagactaacttattacncgtaccaaactactacgttacgtaactttaaggttactttaccgttaccgtaccttaaaccgttttcgggacccgtaggggtaaccctagggttacgggaacgtacgttaaccgaaacggtccggtaaacttcgggttaaccggccgtttacggaccctaccgttaaccgg

SEQ ID NO: 291217 - DNA, 536 bp, Homo sapiens
  misc_feature: GYAE6OF02HNKD2.40.77.G11.1.454.CMB.1.raw
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattacgtacctggttggcctggtatcagcacaaaccaggggaacgcccctaagctccctgatctaataggcatctagtttagaaagtgggtccatccaggttcagcggcagtgatcgtgggacagaattccgcttctacacccatcagcagcctgcacgctgatgtatttgactaactttattactgaccctaactacgtatagtattatttattcctaccgttactaccgtttggccgtaggggaccgtagggtggagtacgtacgaaggtaccgaacgttggacggtccgtagcctacctac

SEQ ID NO: 291218 - DNA, 527 bp, Homo sapiens
  misc_feature: GYAE6OF02FV12Q.40.77.G11.1.454.CMB.1.raw
  modified_base (273)..(273): a, c, t, g, unknown or other
  misc_feature (273)..(273): n is a, c, g, or t
  modified_base (338)..(338): a, c, t, g, unknown or other
  misc_feature (338)..(338): n is a, c, g, or t
  modified_base (368)..(368): a, c, t, g, unknown or other
  misc_feature (368)..(368): n is a, c, g, or t
  modified_base (404)..(404): a, c, t, g, unknown or other
  misc_feature (404)..(404): n is a, c, g, or t
tcagtctagcgactcacgaccggtgctcgatttagctagtcactcaagggaaagggggagtcagacccagtcaggacacagcatggacatgagggtccccgctcagctcctgggctcctgctgctctggctcccaggtgccaaatgtgacatccagatgacccagtctccttccaccctgtctgcatctgtagagacagagtcaccatcacttgccggccagtcagagtattagtacctggttggcctggtatcagcacaaaccaggggaacncccctaagcctcctgactctataaggcatctagtttagaaagtgggtcccatccaggttcagcgnagtgatcgtgggacagaattcgctctcacntcagcagcctgcacgcctgatgtatttgctaacttnttactgaccaactactatgtaattagttacttcctaccgtacttaccgtttgacccgtaggggtaccaagggttcggaagtacgtacgaagtaccgtaacgtcggtcggctacggccacctcg

SEQ ID NO: 291219 - DNA, 578 bp, Homo sapiens
  misc_feature: GYAE6OF02HVQER.40.77.G11.1.454.CMB.1.raw
tcagtctagcgactcacgaccggtgctcgatttagctagtcactcaagggaaagggggagtcagacccagtcaggacacagcatggacaatgagggtcctcgctcagctcctgggctcctgctgctctggctcccaggtcgccaaatgtgacatccagatgaccagtctccttccacctgtctgcatctgtaggagacagatcacctatctactgccgggcagtcagagtattagtacgtggttcggctggtatcagcaacaaaccgaggggaacgaccccgtaagcctccgagtactactaagtaaggcatcgttaagttaagaaaggtcgggtaccataccgtaggttcaggcggacaggtggtatcgtggactagtaatcgctactacacactcgagcacgccgtgacacgctgatgtagttttcgacttaacttattaccgtactacctaactactagtagtaattacgtttacttccgtaccttaactccggtttcggaccggtaagggtaacgtaagggttggaatacggttacgtaaggcgtaacggttggtaggtacgtacgtactaccg

SEQ ID NO: 291220 - DNA, 566 bp, Homo sapiens
  misc_feature: GYAE6OF02I9R9X.40.77.G11.1.454.CMB.1.raw
  modified_base (339)..(339): a, c, t, g, unknown or other
  misc_feature (339)..(339): n is a, c, g, or t
tcagtctagcgactcacgaccggtgctcgatttagctagtcactcaagggaaagggggagtcagacccagtcaggacacagcatggacatgagggtcccgctcagctcctggggctcctgctgctctggctcccaggtgccaaatgtgacatccagatgacccagtctccttccaccctgtctgcatctgtaggagacagagtcaccatcacttgccgggccagtcagagtatagtacctggttggcctggtatcagcacaaccgaggggaacgcccctaagctcctgatctataaggcatctagtttagaaggtcgggtccatccaggttcaggcggnagtggatcgtggggaacagtaagttcgactcctacaccactacagcacgcccgtgccgcgctgtatgttactttgacctaacttattaccgtcaccaaacacgttactagtaattagttattccgtaccgttacctaccgtttacgacccggtaggggtaacctaagggtcggaagtactacgtaacggtaggtacgttacggtcggtacgtcggactaccttaacg

SEQ ID NO: 291221 - DNA, 747 bp, Homo sapiens
  misc_feature: GYAE6OF02J1BGP.40.77.G11.1.454.CMB.1.raw
  modified_base (196)..(196): a, c, t, g, unknown or other
  misc_feature (196)..(196): n is a, c, g, or t
tcagtctagcgactcacgaccggtgctcgatttagctagtcactcaagggaaagggggagtcagacccagtcaggacacagcatggacatgagggtccccgctcagctcctgggctcctgctgctctggctcccaggtgccaaatgtgacatccagatgacccagtctccttccaccctgtctgcatctgtagganacagagtcaccatcacttgccggtccagtcagagtattagtacctggttgcctggtatcagcaacaaaccgagggaacgccccgtaagcctcctgactactaagtaaggctatacttaggtttaagaaaggttcggggtacccagttaccgaggttacacgcggactaggttggatcgtagggactaaggtaacttccgacttcctaccgaaccctagtaccgtaagccaacggtcccgtacggaccacggtcccttaggtacgttcggttaactttttacggaacctttaaacttttacgtttaacgtaccgtaaccctaaaaccgtacccttaagttacggttaaactttaacgttttaaccgtttaccgtttaaccccggtttaaaccgtttaacccgggtttacgggttaacccccgggtaaggggggttaaaccccgttaaggggttaaccggggtaaacggttaacgtaaccggtaaaaccggtaccggttaacggttcgggttaaccgggaccgttaccggtaaccctacccgtttaaacccgg

SEQ ID NO: 291222 - DNA, 586 bp, Homo sapiens
  misc_feature: GYAE6OF02GOXD3.40.77.G11.1.454.CMB.1.raw
  modified_base (385)..(385): a, c, t, g, unknown or other
  misc_feature (385)..(385): n is a, c, g, or t
  modified_base (422)..(422): a, c, t, g, unknown or other
  misc_feature (422)..(422): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggcagtcagatattagtacctggtgcgtggtatcagcaacgaaaccgaggggaacgaccccgtaagcctcgtgatctagtaagcatctaagttagaaaggtcgggtacctagtaccgaggttcgacgcggcgtagtgagtcgtggacagattcgctactacacctanacgagcacgtccgtagacagtcctgatgttacgtttnaccgttaatttacttactcgaacctaactaaccgtattacgtaatttacgtttacttaccttaccgttaccttaccgtttacgggaccgtaacgggtaccgtaagggtaggaacgtaagtaccgtaagtaccgtacggttaggtggtccgtacgaccacgtacg

SEQ ID NO: 291223 - DNA, 532 bp, Homo sapiens
  misc_feature: GYAE6OF02G9YHR.40.77.G11.1.454.CMB.1.raw
  modified_base (297)..(297): a, c, t, g, unknown or other
  misc_feature (297)..(297): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgcccagtctccttccaccctgtctgcatctgtaggagacagagtcaccatcacttgccgggccagtcagagtattagtacctggttggcctggtatcagcaacaaaccgaggggaacgcccctaagctcctgatctanaaggcatctagtttagaaagtgggtccatccaggttcagcggcagtggatcgtgggacagaattcgctctcaccatcagcagcctgcagcctgatgtattttgacttaacttattactcgaccaactacttatgtaattagttattcctaccgttaactaccgtttagggaccgtaggggtaccaaggggtgaacgtactacgaagcgtaacgtggtagtcgtacgacacctacg

SEQ ID NO: 291224 - DNA, 542 bp, Homo sapiens
  misc_feature: GYAE6OF02G04Y4.40.77.G11.1.454.CMB.1.raw
  modified_base (403)..(403): a, c, t, g, unknown or other
  misc_feature (403)..(403): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtacctggtggcctggtatcagcaacaacgagggaacgccctaagcctactgactactaagtaaggcatctaagtttaaggaaggtcgggtacccatccgaggttcaggcggacagtggatgaggacaagagttcgctctcacagtcagcagcctgcagcctagatntatttcgactaactttatactacgaacctaactactatgtaattagttaccttccgtaccgttactaccggtttcgaccggtacggggtactaagggtcggagtacgacgaagccgtaagtggtacggctacgacactg

SEQ ID NO: 291225 - DNA, 740 bp, Homo sapiens
  misc_feature: GYAE6OF02ILXFK.40.77.G11.1.454.CMB.1.raw
tcagtctagcgactcacgaccggtgctcgatttagctagtcactcaaggggaaagggggagtcagacccagtcaggacacagcatggacatgagggtccccgctcagctcctgggctcctgctgctctggctcccaggtgccaaatgtgacatccagatgacccagtcctccttccaccctgtctgcatcgtggtaggagacagagtcacatcacttcggccgggccaggtcagagtattagtaccgtggttacggctggtatgtagctaacaaacgaggggacacccgtaagcctccgtagactactaagtaaggctacgtacgttaaggtttaagaaggtcggtacccagtacctacgggttacacggtcggacgtaggtaggacttcggtacgggaactaacggtaactttccggaccttaccgtactacccgtacttaccgacggtaccgaacggtccctacggacctacggtacccttaggtaacgttaggtttaactttacggtaaactttaaaccttttaaacgtacccgttaacggtaacccttaaaccgtaaccgttaagttacgtaaacgtttacgtttaacgtttaccgttaacccgttaaccgttccgttttaacgggacccggtacgggggtaacccgtaaggggtacgggtaaacggtacggttaaccgtaaacggtaccggtaacgtcgggttacgtccggtaacgtaccggaaccctttaccgg

SEQ ID NO: 291226 - DNA, 666 bp, Homo sapiens
  misc_feature: GYAE6OF02JMWB0.40.77.G11.1.454.CMB.1.raw
  modified_base (102)..(102): a, c, t, g, unknown or other
  misc_feature (102)..(102): n is a, c, g, or t
  modified_base (195)..(195): a, c, t, g, unknown or other
  misc_feature (195)..(195): n is a, c, g, or t
  modified_base (198)..(198): a, c, t, g, unknown or other
  misc_feature (198)..(198): n is a, c, g, or t
tcagtctagcgactcacgaccggtgctcgatttagctagtcactcaagggaaagggggagtcagacccagtcaggacacagcatggacatgagggtccccgntcagctcctgggctcctgctgctctggctcccaggtgccaaatgtgacatccagatgacccagtctccttccaccctgtctgcatctgtaggnacngatcaccatcacttcggccggctagtccaaggtagtattacgtaccgtggttcggcctggtatccagtccaacgaaaccgtaggggaactcccccgtaaaggtcccttaccgtggtactacgtagtaaacggctattacgttagtttaaggaaacggttcgggtaccccattaccgtaggttccaaggtccggactaggtgagttcgtagggaactagtaactttccgacgtcctacgaaccctagtccacgtacgacgtccgttacgcgtacgtctacggatttcggtattttccggactttaaaccgttatttaaccgcgtaacccgtaaacctactagttacgttaaacgttacgtttacttaccgttacccgtacttacgttttcgaaccgtacgggaactaagggtcgaagtacgttaccgaacgtacggtaacgtcgtacggtacgtacgtaccgaacttcg

SEQ ID NO: 291227 - DNA, 583 bp, Homo sapiens
  misc_feature: GYAE6OF02IDYWQ.40.77.G11.1.454.CMB.1.raw
  modified_base (533)..(533): a, c, t, g, unknown or other
  misc_feature (533)..(533): n is a, c, g, or t
tcagtctagcgactcacgaccggtgctcgatttagctagtcactcaaggggaaagggggagtcagacccagtcaggacacagcatggacatgagggtccccgctcagctcctggggctcctgctgctctggctcccaggtgccaaatgtgacatccagatgacccagtcctccttccaccctgtctgcatctgtaggagacagagtcaccatcacttgccggcagtcagagtatagtacctggtcgctggtatcagcaacaaaccgaggggacacccctaagctcctgatctaagtagctattcgttaaggtttaagaaaggttcggggtaccctagtccgtaggttcacggtcgggacaggtggatcgtagggaactaggtaacttccgcttcctacaccctatccagtccacgcctgactacgcctgattgtacttttgacttaactttacttctacgaccaactacttaatgtaattagttacttccgtaccttaactccgttacggaccgtacgggtaaccgtaagggnggaagacgtaccgaaggtcgtaacgtgggtacggtctacgacctactacg

SEQ ID NO: 291228 - DNA, 773 bp, Homo sapiens
  misc_feature: GYAE6OF02GTA8H.40.77.G11.1.454.CMB.1.raw
  modified_base (197)..(197): a, c, t, g, unknown or other
  misc_feature (197)..(197): n is a, c, g, or t
  modified_base (289)..(289): a, c, t, g, unknown or other
  misc_feature (289)..(289): n is a, c, g, or t
tcagtctagcgactcacgaccggtgctcgatttagctagtcactcaagggaaagggggagtcagacccagtcaggacacagcatggacatgagggtccccgctcagctcctgggctcctgctgctctggctcccaggtgccaaatgtgacatccagatgacccagtcctccttccaccctgtctgcatctgtagganacagagtcaccatccacttcggccgggtccagtcagagtattacgtacctggttggccgttaggtatcagacaacgaaaccgaggggaaccnccccgtaagcctcctagtacttactaagtaacggctaagttacgttaacggtttaaggaaaagggttcggggtaccctacgttaccgtaagggttaccgaacggtcgggtaccgtagggttagggtacgttccggtaggggaacctaaggtaaactttccggaccttccgtaccctaacctacgtaccgtaacggtaccgaccggtaccccgtaggaccgacggtacccgttaggtaacgtttacggtttaactttttacggaacccttttaaacggttttactttaacgttacccgtaaccctaaaacgttaaccgttatttaacggttaaacttttaacgtttaaccgttttaccgttaacccgtttaacctttacccggtttacgggacccgggtaacgggggtaaccttaacgggggtggtaacgtacgtaacgttaaccggacgtaacgttcggtggtaccctaggtacccaacgttcg

SEQ ID NO: 291229 - DNA, 728 bp, Homo sapiens
  misc_feature: GYAE6OF02G9GLH.40.77.G11.1.454.CMB.1.raw
  modified_base (310)..(310): a, c, t, g, unknown or other
  misc_feature (310)..(310): n is a, c, g, or t
  modified_base (675)..(675): a, c, t, g, unknown or other
  misc_feature (675)..(675): n is a, c, g, or t
tcagtctagcgactcacgaccggtgctcgatttagctagtcactcaagggaaagggggagtcagacccagtcaggacacagcatggacatgagggtccccgctcagctcctggggctccgtgctgctcgtggctcccaggtcgccaaagtgtgacagtccagatcgacccagtcctccttccaccctgtctgcacgtctaggtaggacgacagagtacaccatcacttcggccgggcagtcgagagttatagtacctggttcggctaggtatcgagacaacaaacgagggaacgccctaaggcctcgtanacttacctaagtaacgctaactacttaagttaaaggaaaggttccgggtaccacgttacgtacggttacaacggtcgactaagggttggaactttcggacgggtaacgtaacgtaacgttccgtcgttaccacctaacgacttaccaggttaccaaccggccctaggacaccgtcaggttaatcgttaagtttcgtacttaacctttaacgttacacgaaccctaaactacgttacgtaacgttaagtttaacgtttacctttacccgttacggtaaaccctttaacccgggtttcgaacccgggttaacggggtaacccgtaaggggttaacgggtaacttaaacccgtaggttaaaccccggngtttaaaccggcgggttacgggtaccggtttaccaccggttaacccgttaacc

SEQ ID NO: 291230 - DNA, 597 bp, Homo sapiens
  misc_feature: GYAE6OF02IGCJB.40.77.G11.1.454.CMB.1.raw
  modified_base (198)..(198): a, c, t, g, unknown or other
  misc_feature (198)..(198): n is a, c, g, or t
  modified_base (281)..(281): a, c, t, g, unknown or other
  misc_feature (281)..(281): n is a, c, g, or t
  modified_base (292)..(292): a, c, t, g, unknown or other
  misc_feature (292)..(292): n is a, c, g, or t
  modified_base (300)..(300): a, c, t, g, unknown or other
  misc_feature (300)..(300): n is a, c, g, or t
  modified_base (341)..(341): a, c, t, g, unknown or other
  misc_feature (341)..(341): n is a, c, g, or t
  modified_base (362)..(362): a, c, t, g, unknown or other
  misc_feature (362)..(362): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtcctccttccaccctgtctgcatctgtagganacagagtcaccatccacttcggccggccagtcagagttagttacgtaccgttggttgcctggtatcagcaacaacgagggacnccctaagctcngatactanagctatcgtaagttagaaggtcggtaccatcgagtcagcgnagtgatcgtggacagtaatcnctctacacctatcgagccacgtcctcgacgtacgtcctgtagtgttaatttcgacttaactttacttacctacgaacccttaactaccttaaagtcgttaaacgtttacgtttaactttacccgttaccgttaaccgttaaccgtttacggggaccgttaaccggggtaccgtaagggcggtaacgtactaccgaagtaccggtagttcggtacggactacggacctaccgtacg

SEQ ID NO: 291231 - DNA, 546 bp, Homo sapiens
  misc_feature: GYAE6OF02H4FX1.40.77.G11.1.454.CMB.1.raw
  modified_base (380)..(380): a, c, t, g, unknown or other
  misc_feature (380)..(380): n is a, c, g, or t
  modified_base (391)..(391): a, c, t, g, unknown or other
  misc_feature (391)..(391): n is a, c, g, or t
  modified_base (401)..(401): a, c, t, g, unknown or other
  misc_feature (401)..(401): n is a, c, g, or t
  modified_base (421)..(421): a, c, t, g, unknown or other
  misc_feature (421)..(421): n is a, c, g, or t
  modified_base (433)..(433): a, c, t, g, unknown or other
  misc_feature (433)..(433): n is a, c, g, or t
  modified_base (539)..(539): a, c, t, g, unknown or other
  misc_feature (539)..(539): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccacctgtctgcatctgtaggagacagagtcaccatcacttggccgggccagtcagagtattagtacctggttgcctggtatcagcacaaaccgaggggaacgcccctaagcctaccgtgactctataacggctatacgttagtttaagaaaggtgggtacccagtccgaggttcaggcggcaggtgatcgtggacagtatcgctcncacatcagcanctgcagcctnactgtatttcgactaacttntactgacctaanacttatagtattagtttacttccttacgtacgtcgtttcggacgtagggtaaccgaggtaggacctagtaacgaagtaccgtacgttcgggtagtccgtacgtacnccctacg

SEQ ID NO: 291232 - DNA, 709 bp, Homo sapiens
  misc_feature: GYAE6OF02I1G1U.40.77.G11.1.454.CMB.1.raw
  modified_base (283)..(283): a, c, t, g, unknown or other
  misc_feature (283)..(283): n is a, c, g, or t
tcagtctagcgactcacgaccggtgctcgatttagctagtcactcaagggaaagggggaggtcagacccagtcaggacacagcatggacatgagggtccccgctcagctcctggggctcctgctgctctggctcccaggtgccaaatgtgacatccagatcgacccagtcctccttccaccctgtctgcatctgtaggagacagagtccaccatcacttcggccggccagtcagacgtattacgtaccgtggttcggcctggtatcagcaacaacgagggacncccagcctccgtgactactagtaaggctagtacttaaggttaacgaaacggtcgggtaccctaagtccgtaggttacgacggcggacgtagtggactcgggtacggaactacggtaagttccgacctaccgttaccaaccgtagtaccgacgtaccgtacgtaccccgtgaccgtacgtacccgttagtaccgttacttacggttttacgtactttaaccgtttaactttaacgtaccgtaaccaaacccttagttaacgttacgtaacgtttaaccgtttaaccgttaccttaaccccggtttactaacccgggttttaccgaccgggttaccgggtaacccggttaaggggtacggtaacggtaccgtaacgaaaccggttacggtacgttacggttacggaccgtacgtacccgtacttacgg

SEQ ID NO: 291233 - DNA, 563 bp, Homo sapiens
  misc_feature: GYAE6OF02FVQ7Z.40.77.G11.1.454.CMB.1.raw
  modified_base (278)..(278): a, c, t, g, unknown or other
  misc_feature (278)..(278): n is a, c, g, or t
  modified_base (298)..(298): a, c, t, g, unknown or other
  misc_feature (298)..(298): n is a, c, g, or t
  modified_base (335)..(335): a, c, t, g, unknown or other
  misc_feature (335)..(335): n is a, c, g, or t
  modified_base (344)..(344): a, c, t, g, unknown or other
  misc_feature (344)..(344): n is a, c, g, or t
tcagtctagcgactcacgaccggtgctcgatttagctagtcactcaagggaaagggggagtcagacccagtcaggacacagcatggacatgagggtccccgctcagctcctggggctcctgctcgctctggctcccaggtgccaaatgtgacatccagatgacccagtctccttccacctgtctgcatctagtaggagacagagtcaccatcacttggccggccagtcagagtattagtacctggttggcctggtatcagcaacaaaccgaggggaancccctaagcctctgatctanaggcatctagttagaagtgggtccatcagttcagcgnagtgatcgnggacagaattcgctctcacatcagcagcctgcagcctagatagtattttgaccttaaactttacgttactcgtaacccaaataacgttagtagtaagtttacgtttaatttaccttacccgttaaacttcccgtttaggacccgtaggggaccctaaaggggttcgaagtactacgtaacggacgtacgttggtcggacgtacgtaccgtaccttacgg

SEQ ID NO: 291234 - DNA, 576 bp, Homo sapiens
  misc_feature: GYAE6OF02JCEY2.40.77.G11.1.454.CMB.1.raw
  modified_base (257)..(257): a, c, t, g, unknown or other
  misc_feature (257)..(257): n is a, c, g, or t
  modified_base (272)..(272): a, c, t, g, unknown or other
  misc_feature (272)..(272): n is a, c, g, or t
  modified_base (284)..(284): a, c, t, g, unknown or other
  misc_feature (284)..(284): n is a, c, g, or t
  modified_base (342)..(342): a, c, t, g, unknown or other
  misc_feature (342)..(342): n is a, c, g, or t
  modified_base (346)..(346): a, c, t, g, unknown or other
  misc_feature (346)..(346): n is a, c, g, or t
  modified_base (377)..(378): a, c, t, g, unknown or other
  misc_feature (377)..(378): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggcagtcagtagtattagtacctggttgcctggtatcancacaaccgagggacnccctaagctccngactctataggcatctagttagaaaggtgggtccatccgagttcagcgcagtgatcgngganagtattcgctctacacatcagcacgcctgcnncgtagatgtatttgactaactttatactacgaccaactacttagtacgtattacgtttaactttccgttaccgttaccgttaccgtttacgggacccgtaacggggtaccgtaaggggttcggtaaacgtacggttaaccgaacgggtaaccgtaccgtttagggtaccgtaccgtttacggacccttaacccgtacg

SEQ ID NO: 291235 - DNA, 591 bp, Homo sapiens
  misc_feature: GYAE6OF02F5VJ4.40.77.G11.1.454.CMB.1.raw
  modified_base (367)..(367): a, c, t, g, unknown or other
  misc_feature (367)..(367): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcacatcacttggccggcagtcagagtattacgtacctggttggccttggtatcagcacaaaccgaggggaacgcccctaagctcctgatctataaggcatctagttagaaagtcgggtccatccaggttcagcggcagtggatcgtggacagtaattcgactntccacatcaagcacgctgccagtcctgtactgtatttcgactaactttataactcgacctaaacacttaagtagtaattaagtttacttaccgtttacccgtacttaaccgtttcgggtaacccggtaggggtaacccgaaaggggttcggggaaacttaacgtaccgtaaacggtacgtaacggttacggttaccgggcttaaccgggtaccaacccgttacg

SEQ ID NO: 291236 - DNA, 725 bp, Homo sapiens
  misc_feature: GYAE6OF02HGCQD.40.77.G11.1.454.CMB.1.raw
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtcttcttccaccctgtctgcatctgtaggagacagagtcaccatccacttcggccggccagtcagagttattacgtaccgttggttcggccgttggtactcgacgaccaaaccgaaaaccggaacgggggaaacctacccccgtaaggtacccttcccgtagtacttacgtaagtaaacggtcctaatttacgttaaggttttaaaggaaacgggttcggggtaccctaacgttacccgtaaggtttccgaacggtccgggtacgtaacgggttggaacgttcggtacgggaactaacgtaacgttccgaccttctaccaaccttactaccgacgtccgtaacgtcccgtacggtacctacgtaccctggtaacttacggttattttacgaccttaacttttacgtacctacgtaccctaactaacgttacgttacgttaatttacgtttacttaccgttacccgtaccgttaccgtttacggaccggtacgggtaaccgtagggtacggacgtacgtacgacgtaccgaaggttcggaccggtagccgtacaccgttc

SEQ ID NO: 291237 - DNA, 656 bp, Homo sapiens
  misc_feature: GYAE6OF02JF4UW.40.77.G11.1.454.CMB.1.raw
  modified_base (198)..(198): a, c, t, g, unknown or other
  misc_feature (198)..(198): n is a, c, g, or t
  modified_base (288)..(288): a, c, t, g, unknown or other
  misc_feature (288)..(288): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatcgtgtagganacagtacgtccaccatccacgttcggcccgggccagtcagagttattagtaccgtggttcggcctggtatcagcacaaaccgagggaacnccctaagctcctgatcgtataggctattacgtagtttaagaacggttcgggtaccctagtccgaggttcaggtccggacgtagtggtagtcggtagggaccagtaacttccgcttcctaccaccgtacttacgacgtccgacgtcccgttagacctacgtccgttgaacgtttgttacgtttacgtacttaacgtttaactaccgtaccgaaccctaaacgttacgttaattacgtaatttaacggtttaccttacccgttaccggtttaacctacccgggttttacggacccgggtaagggtacccgtaagggttcggaacgtacgtaaccaaggtaccgtacgtggtacgctacggcctacgtacg

SEQ ID NO: 291238 - DNA, 651 bp, Homo sapiens
  misc_feature: GYAE6OF02IAY1J.40.77.G11.1.454.CMB.1.raw
  modified_base (279)..(279): a, c, t, g, unknown or other
  misc_feature (279)..(279): n is a, c, g, or t
  modified_base (356)..(356): a, c, t, g, unknown or other
  misc_feature (356)..(356): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttggccggccagtcagagtattagtaccgtggttcggcctggtatcagcaacgaaaccgagggacnccccgtaagctcctgatctaataaggctatacgttagtttagaaggtcgggtacccagtccgtaggttcacggcggngaggtggtactcgtagggactagtaacttccgtccttcctaccaacctatacgacgtccgacgtcctcggacacgtccgtagtacgttagttacttttacgacctttaacgtttaacgttaccgtacgaccctaaacttaacgttagttagtaaacgtttacgtttacctttacccgttacccgttaacgttacccggtttacgggacccggtaacggggtaccgtaaggggtacggtaagtacgtaaccgaacggtacggtaacgtcggtaccggtacgtcgaccctaccgtcg

SEQ ID NO: 291239 - DNA, 789 bp, Homo sapiens
  misc_feature: GYAE6OF02JJ03J.40.77.G11.1.454.CMB.1.raw
  modified_base (183)..(183): a, c, t, g, unknown or other
  misc_feature (183)..(183): n is a, c, g, or t
tcagtctagcgactcacgaccggtgctcgatttagctagtcactcaagggaaagggggagtcagacccagtcaggacacagcatggacatgagggtcccgctcagctcctggggctcctgctgctctggctcccgaggtcgccaaatgtgacatccagatcgacccagtcctccctccacctntcctgcatctggtaggagacagagtcacatcacgttcgccgggccagtcgagtatattacgtaccgtggttcggcctggtagtcaagcaacaaaccgaggggaaccgacccctaaagccttacctagtactacgtaagtaacggtacctaagttacgtttaaggtttaaacgggtaaacgggttaccggggtacccctaagttaacccgtagggttccgacggccgggtaccgtaaggttcgggaacgtttcggtacggggtaaactaacggtaactttacggtccttaccgtacctaaaccgtacttaccgaacggactacggtacccgagtaccggacgttaccggtaagtacggtttacgttaacgttttacgaaccgttttaaacgtttccttaacgtaccgtaaaccccgtaaataaccgtttattaacgtttaagttttaccgttaacgtttacccgttaaccggttaaacccgtttaccggtaacgggtacccggggtaaacgggtaaccggaaggggtttacgggaaaccttacggttaccggaaacggttaacgttaccggttcgggtggtaacccgttccgaacgtaaccgttcgg

SEQ ID NO: 291240 - DNA, 586 bp, Homo sapiens
  misc_feature: GYAE6OF02JKP5Q.40.77.G11.1.454.CMB.1.raw
  modified_base (279)..(279): a, c, t, g, unknown or other
  misc_feature (279)..(279): n is a, c, g, or t
  modified_base (389)..(389): a, c, t, g, unknown or other
  misc_feature (389)..(389): n is a, c, g, or t
tcagtctagcgactcacgaccggtgctcgatttagctagtcactcaagggaaagggggaggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccaggtcagagtattagtacctggttggcctggtatcagcaacaaaccaggggaacnccccgtaagcctcctagactctataaggcatctagtttagaaagttcgggtccatccaggttcagcgcaggtgatcgtgggacagaacttcgctctcacctatcacgcancccgtgaccagcctgattgttattttgacttaactttacttacttacgacccaaactaccgtatacgtaatttaacgtttacgttccttaacccgttactaccgttttacggcccggtaaggggtaaccgaagggttgggaacttacgtaacgaacggtacgtaaacgttcggtacggactcggtacctaccgtacg

SEQ ID NO: 291241 - DNA, 840 bp, Homo sapiens
  misc_feature: GYAE6OF02HYEHQ.40.77.G11.1.454.CMB.1.raw
  modified_base (158)..(158): a, c, t, g, unknown or other
  misc_feature (158)..(158): n is a, c, g, or t
  modified_base (193)..(193): a, c, t, g, unknown or other
  misc_feature (193)..(193): n is a, c, g, or t
  modified_base (213)..(213): a, c, t, g, unknown or other
  misc_feature (213)..(213): n is a, c, g, or t
tcagtctagcgactcacgaccggtgctcgatttagctagtcactcaagggaaagggggagtcagacccagtcaggacacagcatggacatgagggtccccgctcagctcctgggctcctgctgctgtggcctacccgaggtcgaccaaatcgtagacntccagatcgacccagtcctccttccaccctgtccngcattcgtggtagagacagngtacacgtatctacgtggccggacagtcaggtattacttaacgtcgtggttcggccttaggtactcgagccgaaacgtaaaccgggaggggtacctacccgtaagtcctaccgtagacttacctaagacgtctacttacgttaaaggttagaaacgggttcggtaccctagttccggaaggttccaacggttccgacgtaggtaggtaccgtcggtaacggtaacgtaagtaacgtttccggaactttcccgaccgaaccgttagtaccgtaaaccgtcgaaccgttccggacgtaccgtaacggtcccggttaagtaccgggtttacttaagggttttaaccctaaccgtttaacccggtttattaaaccccgacggttaacccctaaaaggtttcccggttaaaatttaccgggtttaacttttaaccgtttttacccggtttaaccccggttaccccgtttaaaccgggtttaccgggtttaaaccccgggcgggggttaaaaacccggggtttacccgttaaagggggtacggttaaaccggttacttaaaccgggtaaaacccggccgttttaacggggttccgacgggttacccgttaaactcccgtaaacccgtttttgg

SEQ ID NO: 291242 - DNA, 732 bp, Homo sapiens
  misc_feature: GYAE6OF02HXZSY.40.77.G11.1.454.CMB.1.raw
tcagtctagcgactcacgaccggtgctcgatttagctagtcactcaagggaaagggggagtcagacccagtcaggacacagcatggacatgagggtccccgctcagctcctggggcctcctgctgctctggctcccaggtgccaaatgtgacatccagatgacccagtcctccttcccaccctgtctgcatctaggtaggacgacagagtccacctatcacgttgccgggtaccagtcagagtatacgtacgtggttcgcgtagtatcagacacgaaaaccgagggaacgacccctaagcctacgtagtatacgtaagtaacggctacgttagttaagtttaacggaaacggttcgggtaccctaacgtccgtaaggttccgaaggtccggtatacggtaggtaactcggtaaggggaactacgtaaacgttccgccttacgtaccgaacctaagtccgaacggacgtaaccgtccgttagaccgtacgtccgttacggtacgttacgttaagttttaccgaaacgtttaacttttaaccgtttaacgaaccggtaaaccctaaacgtaaccttaggttacgtaaacgttttaacggtttaacttacccgttaaccgtttaacccgttaaccggttttacgggaacccgtacggggtaaccgtaagggtaggtaacgtacgtaacgaaacggtcgtaacggttcggtacgtccgtacggacctaccgttacg

SEQ ID NO: 291243 - DNA, 556 bp, Homo sapiens
  misc_feature: GYAE6OF02HIZ6X.40.77.G11.1.454.CMB.1.raw
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtaccgtggttggcctggtatcagcacaaaccgaggggaacgcccctaaagctcctgatctaataaggcatctagttagaagtgggtcccatccaggttcagcggcaggtggatcgtgggacagtaattcgtctctcacctatcagcagccctgcagcctgatgtattttgactaactttattactcgtaccaactacttatagtaattagttactttccgttaccgttactacccgtttcggaccgtacgggtaaccgtaagggtggaacgtataaccgaacggtacgtaacgtggtacggtcgtacgccgtaactacg

SEQ ID NO: 291244 - DNA, 893 bp, Homo sapiens
  misc_feature: GYAE6OF02GQ2FS.40.77.G11.1.454.CMB.1.raw
tcagtctagcgactcacgaccggtgctcgatttagctagtcactcaagggaaagggggagtcagacccagtcaggacacagcatggacatgaggtccccgctcagctcctggggctcctgctgctctggctcccaggtgccaaatgtgacatccagatgacccagtcctccttccaccctgtctgcactctgtaggagacagatccaccatcctacgttcggcccgggccagtaccaagtaacgtaatttacggttaccgttgggttacggtcccgttaggttaactccgtaacggtaccaaaccgtaaaaccccggaacggggggaaacccgtaccccccgtaaaggtcccgttacccgtaggtaacgttaccttaaacggttaacggacctaacgttacgtttaaggttttaaacggtaaacggttccggggtaacccctagttacccggttaaggttccgaacggtaccgggtacgtagggttacggtacgtttccggtacggggaaacgtaacgttaacgttcccgtacttacccgttacccacccgttaagtacctaacggccgaaccggtcccgttcgaacccggtacgtacccggttaagtacgtttacggtttaaccttttacggaaacctttaacgttttaacctttaaccgtaccgtaaaccctaaaccgtaccgtttaagtaacgttttaacgttttaacgttttaccgttttaacccgttaaccgttaaccccgtttaccgggtttaccggggtaacccggtaacggggttaaccgggtaaaacggggttcgggtaaaccgttacggtaacccggtaaacggttacccgggtaaccgttttcgggtaaccggttaccgtacggacccttaccggtaaccgg

SEQ ID NO: 291245 - DNA, 536 bp, Homo sapiens
  misc_feature: GYAE6OF02G2RP5.40.77.G11.1.454.CMB.1.raw
  modified_base (196)..(196): a, c, t, g, unknown or other
  misc_feature (196)..(196): n is a, c, g, or t
  modified_base (277)..(277): a, c, t, g, unknown or other
  misc_feature (277)..(277): n is a, c, g, or t
  modified_base (298)..(298): a, c, t, g, unknown or other
  misc_feature (298)..(298): n is a, c, g, or t
  modified_base (340)..(340): a, c, t, g, unknown or other
  misc_feature (340)..(340): n is a, c, g, or t
  modified_base (365)..(365): a, c, t, g, unknown or other
  misc_feature (365)..(365): n is a, c, g, or t
  modified_base (376)..(376): a, c, t, g, unknown or other
  misc_feature (376)..(376): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctcctccaccctgtctgcatctgtagganacagagtcaccatcacttcgccggccagtcagtatattacgtactggttggcctggtatcagcaacaaaccgaggggaacncccctaagcctcctgatctanaggcatactagttagaagtcgggtaccatccgagttcagcgnagtgatcgaggacagaactcgctcncacatcagcancctgccagctgatgtatttgacttaattctactcaccaactacttatagttaattactttacttaccttacgtacttaccgtttcgaccggtagggaacgtaacgggtggaacgtataacgaaggtacgtaacgttggtacggcgtcgaccgtactaacg

SEQ ID NO: 291246 - DNA, 656 bp, Homo sapiens
  misc_feature: GYAE6OF02HINL9.40.77.G11.1.454.CMB.1.raw
  modified_base (260)..(260): a, c, t, g, unknown or other
  misc_feature (260)..(260): n is a, c, g, or t
  modified_base (392)..(392): a, c, t, g, unknown or other
  misc_feature (392)..(392): n is a, c, g, or t
  modified_base (396)..(396): a, c, t, g, unknown or other
  misc_feature (396)..(396): n is a, c, g, or t
  modified_base (416)..(416): a, c, t, g, unknown or other
  misc_feature (416)..(416): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcacctatcacttcgccgggcagtcagagtacttagtacctggttggcctggtactnagcaacgaaacgagggaacgccctaagcctcgagatactagaaggcattactagtttaagaaggtcggtccagtccgtaggttcacggcgtagaggtagactcgtaggacgtagtaacttcgcttcactacntacncgaccacgtcctgacgtacnccgttagagtttacgtagttttcgaaccgttaactttaacgtacttaccgaaccttaaacgaacctttagtaacgttaagtttaagtttaccctttaccgttaacccgttaccgttaacccggtttacgggaccccggaacggggttaaccgtaaggggtacggtaaggttaccttaacggaaccgtacggtaaaccgggtttcgaacgggttacccgtacggtaccctaccgttaaccg

SEQ ID NO: 291247 - DNA, 773 bp, Homo sapiens
  misc_feature: GYAE6OF02IPL7M.40.77.G11.1.454.CMB.1.raw
tcagtctagcgactcacgaccggtgctcgatttagctagtcactcaaggggaaagggggagtcagacccagtcaggacacagcatggacatgagggtccccgctcagctccgtggggctcctgctgctcgtggctcccgaggtcgaccaaatggtagacatccagatcgacccagtcctccttccacctgtctgctatcgtaggtaggagacagacgtaccacctataccgtacgttccggccgggtaccacggtacaacggtaagttacgttacgttacggttgggttcggtccgttaggtactacgacggtaccgaaaccggaaaccggaacggggtaaccgtaccccgtaacgtcccgttaccgtagtaaccgttacgtaacgtaacggtacctacgttacgttaaggttaaacggtaacggtccgggttacctagtccgtacggtacgacggtcggtacgtagggttacggtactacgggtacggtacgtacgttaacggtcctacctcgtaaccacgtacgtacgaccgacgccgtccgtcgaccgtacgtccgtatacgttacgttacgtttacgaacttttaaccgtaccgttacgccgtaacctaacttaccgttaagtacgtttaacttacggtttacctttacccgtaccggttaacccttccgggttacccgaccggtagggtaaccgtagggtaacggttacacgttaaccgaacggttaccgtacggttacgggtcgtcccgtacgtaccgtacctacgg

SEQ ID NO: 291248 - DNA, 706 bp, Homo sapiens
  misc_feature: GYAE6OF02IKAXQ.40.77.G11.1.454.CMB.1.raw
  modified_base (278)..(278): a, c, t, g, unknown or other
  misc_feature (278)..(278): n is a, c, g, or t
tcagtctagcgactcacgaccggtgctcgatttagctagtcactcaaggggaaagggggagtcagacccagtcaggacacagcatggacatgagggtccccgctcagctcctgggctcctgctgctctggctcccaggtgccaaatgtgacatccagatgacccagtcctccttccaccctgtctgcatctgtaggagacagagtcacatcacttggccgggccagtcagtagtattcgtacctggtcgcctggtatcagcaacaaacgaggggaacnccccctaagcctcctagactctaagaacggcctattcgttaagtttaagaaacggtcgggtacctagtccgtaggtcgacggcggactagggtagtacgtcggtacgggaactaaggtaacgttccgtaccgtaccgtaccaacctaagtcgtaacgcctacggtaccgtacgccgtaacgcccgtaggtaactttgggttaacttttacggaaccttaaacgttttacgttacctaccgtaacccgaaacttaaccgtaatcggttaaatttacgtttacgttcccgttacccggtaacctttaccggttaccgggaaccggtacgggggtaacccgtaaacggggttgtaaacggtacgtaacccggaaacggtaaccggtaacggtcgggttaccggtaccgtaacgtcccggtaacccttacgg

SEQ ID NO: 291249 - DNA, 710 bp, Homo sapiens
  misc_feature: GYAE6OF02G4UCP.40.77.G11.1.454.CMB.1.raw
  modified_base (188)..(188): a, c, t, g, unknown or other
  misc_feature (188)..(188): n is a, c, g, or t
  modified_base (204)..(204): a, c, t, g, unknown or other
  misc_feature (204)..(204): n is a, c, g, or t
tcagtctagcgactcacgaccggtgctcgatttagctagtcactcaagggaaagggggagtcagacccagtcaggacacagcatggacatgaggtccccgctcagctccgtgggctcctgctgctctggctcccgaggtcgccaaatgtagactatccagatcgacctagttctcccttccacctgtntgcatcgtagtagganacgagacgtctaccgatccacgttcggacccgggcacgtacgagtacggttaacttacggtaccgttgggttaccggtccgttagggtactacgacgtacctaaaccgaacggaacggggtaaccaccccgtaagtcctacgtacgtactacgtaacgtaagacttatacgttaaggttaacggaacggtcgggtacctacgtaccgtgtaccggacgtacggcgtaggcgttacgtcggaggtaactacgttacgtcctacctaccgtaccaaccttgaccggacttcgacgggtaccacgacgtccgtacgtacgtgttaacgttacgttaacgtacttaacttacggtaacctcctaacaaccgttatacgttaactttaacgttccttaacgttaccgttaccggttacttaaccgggtacgacgggtaaccgaacggtaggtcgaaacgtacgtaaccgtaggttacacggttacgccgtagtacgtaccccgtattaccg

SEQ ID NO: 291250 - DNA, 580 bp, Homo sapiens
  misc_feature: GYAE6OF02FNGE8.40.77.G11.1.454.CMB.1.raw
  modified_base (258)..(258): a, c, t, g, unknown or other
  misc_feature (258)..(258): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtacctggttgcctggtatcancacaaaccgaggggaacgcccctaagcctccgtgactcgtaataaggcatcttagtttagaaaggtcggggtacccatccaggttcaggcggcagtggatcgtgggacagtaattcgctctaccacatcagcagcctgcagtcctagagtgtattttcgacttaacttattactcgacctaactactagtagtaagttactttacttaccgttccgttaacgttaccgtttcggacccgtacggggtaaccgtaacgggtacgggtaacgacgttaacgaacgtacggtaacgtcggtacggaccgtagacctaccgttacg

SEQ ID NO: 291251 - DNA, 718 bp, Homo sapiens
  misc_feature: GYAE6OF02I25MC.40.77.G11.1.454.CMB.1.raw
  modified_base (197)..(197): a, c, t, g, unknown or other
  misc_feature (197)..(197): n is a, c, g, or t
  modified_base (202)..(202): a, c, t, g, unknown or other
  misc_feature (202)..(202): n is a, c, g, or t
  modified_base (275)..(275): a, c, t, g, unknown or other
  misc_feature (275)..(275): n is a, c, g, or t
tcagtctagcgactcacgaccggtgctcgatttagctagtcactcaaggggaaggggagtcagacccagtcaggacacagcatggacatgagggtccccgctcagctcctgggctcctgctgctctggctcccaggtgccaaatgtgacatccagatgacccagtctccttccaccctgtacctgcatcctgtaggngaccngagtcacatcacttgcccgggccagtccagacgtattagtacctggttggcctggtattcagccacaaaccgnggggaagcccctaaggctccgtgatcgtataagcatctagtttagaaagtcggggtacctagtaccgaggttaccaggtcggaccgtaagtcggtaattcgttacggggaactacggtaacgtttccgcgttaccgttaccgtacccgtattacccgtaagtcgtaacggtccccgttaggaccttacgcccgttagaacgttacggtaactttttcggacttaacgtttacgttaccgttacggtaccctaaacgtaccttaaagttcgtaacgttacgggttttaactttaccgtacccggtttaacctaccttttaccggggaacccgtacggggtaacccggtaaacggggttcggaaccggaacgtttaccaaacgggtccgttaaacccgttcgggttacggtacccggttaacggtaccgtaccccgttaacccgg

SEQ ID NO: 291252 - DNA, 772 bp, Homo sapiens
  misc_feature: GYAE6OF02JT5KV.40.77.G11.1.454.CMB.1.raw
  modified_base (103)..(103): a, c, t, g, unknown or other
  misc_feature (103)..(103): n is a, c, g, or t
  modified_base (173)..(173): a, c, t, g, unknown or other
  misc_feature (173)..(173): n is a, c, g, or t
  modified_base (234)..(234): a, c, t, g, unknown or other
  misc_feature (234)..(234): n is a, c, g, or t
  modified_base (533)..(533): a, c, t, g, unknown or other
  misc_feature (533)..(533): n is a, c, g, or t
tcagtctagcgactcacgaccggtgctcgatttagctagtcactcaaggggaaagggggagtcagacccagtcaggacacagcatggacatgagggtccccgntcagctcctgggctcctgctgctctcggctcccaggttcacctaaatgtacgacatccagtactcgaccngttccgtccttaccgacccttgcgttgctatcgtaggtaacggactagacgtacgtccacnctactcggtcggaccggacaggtacgtaggtattacgtaacgttcggttaggtacggtccgtagtacttacgacgtaccgtaacaaccgggtagggtaaccgtccccaagtttccctaggtaactcgttaacgtaacggttactaaccgttatttaacgggttttaacggaaacggtttacggggtaccccgaacgttccgttaacggttggtaccgttaacggccgtagtacggaccgtttcggtacgggtacgtaacggttaaacgtcgtttaacccgccgttaccgaaacccgttnttaaccgacggtacgtaaacggtcccttaccggacgttacgtactaaccggtttgtacggttacttaggttaaaccgtttacccttaacgttcgtaacccgttaccgtaactaaccgtagtttacgacttaagtttccttaccgttcgttaacccttacgtacggtacgtaccgggacgttacggagggaactcggtaataaccggctaccggagttcggacttcgactacggtctagg

SEQ ID NO: 291253 - DNA, 892 bp, Homo sapiens
  misc_feature: GYAE6OF02FIGIW.40.77.G11.1.454.CMB.1.raw
  modified_base (184)..(184): a, c, t, g, unknown or other
  misc_feature (184)..(184): n is a, c, g, or t
  modified_base (207)..(207): a, c, t, g, unknown or other
  misc_feature (207)..(207): n is a, c, g, or t
  modified_base (382)..(382): a, c, t, g, unknown or other
  misc_feature (382)..(382): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatcgaccagtctccttccaccctgtcncgacactctggtaggacgtaacnggacgtaccacctaagtcctaaccgtttcgggaccccggggtaccaggtacccgaaggaacgttaacgtttaccggttaaccgttagggttcggtacccgttgggttacctaccgacggtaccaaccgtaaaaccgacgggggtaaaccgtcccccgtaaagtcccgttacccgnggtaaacctcgttaacgttaaacggccgtaacgttaccggttaaggtttaaaccggtaaagggttcccgggggttaaccccacggttaccctaagggtttaccgacggtaccggggtacccgtaagggtacggtacgtttaccggtaacgggtaacgtaacgttaacgtttccgtaacccggttacttaccccgtaaacgtaccgttacccgtaacgggtaaccgtacccggtaccgtttaagcccgaacggttacccgttacggttagttacgggtttaaccgtttacggaacctttaaaccggtttaaccttacgtaccgtaacccgttacgtaaccgttttaagtaaccgtaacgttttaacggttacccgttagttaaaccgacccgttttacgttaccggggtacccgtaggggtaaccgtaaggggtcgtaacgggttaacccagggttaaacccgtacggtaaccggtcgttaccgggacttacccgggtaccacccgttacg

SEQ ID NO: 291254 - DNA, 565 bp, Homo sapiens
  misc_feature: GYAE6OF02HBJD6.40.77.G11.1.454.CMB.1.raw
  modified_base (196)..(196): a, c, t, g, unknown or other
  misc_feature (196)..(196): n is a, c, g, or t
  modified_base (200)..(200): a, c, t, g, unknown or other
  misc_feature (200)..(200): n is a, c, g, or t
  modified_base (211)..(211): a, c, t, g, unknown or other
  misc_feature (211)..(211): n is a, c, g, or t
  modified_base (310)..(310): a, c, t, g, unknown or other
  misc_feature (310)..(310): n is a, c, g, or t
  modified_base (349)..(349): a, c, t, g, unknown or other
  misc_feature (349)..(349): n is a, c, g, or t
  modified_base (354)..(354): a, c, t, g, unknown or other
  misc_feature (354)..(354): n is a, c, g, or t
  modified_base (360)..(360): a, c, t, g, unknown or other
  misc_feature (360)..(360): n is a, c, g, or t
  modified_base (363)..(363): a, c, t, g, unknown or other
  misc_feature (363)..(363): n is a, c, g, or t
  modified_base (365)..(365): a, c, t, g, unknown or other
  misc_feature (365)..(365): n is a, c, g, or t
  modified_base (373)..(373): a, c, t, g, unknown or other
  misc_feature (373)..(373): n is a, c, g, or t
  modified_base (386)..(386): a, c, t, g, unknown or other
  misc_feature (386)..(386): n is a, c, g, or t
tcagtctagcgactcacgaccggtgctcgatttagctagtcactcaagggaaagggggagtcagacccagtcaggacacagcatggacatgagggtccccgctcagctcctgggctcctgctgctctggctcccaggtgccaaatggtgacatccagatgacccagtctcccttccaccctgtctgcatctgtagngacngacgtcaaccntcacttcggccgggccagtcagagtatagtacctggttacgctggtactcagacaacgtaaaccgaggggaaacgaccctaagcctctagatctagagntatcgtagttagaagtcgggaccagtacgaggtcagcgnaggtnagtcgngananagttccgntcacacgtacacngaccacgtccgagtccagcctagacttacggtagtttcaccgtttaacttacttacgtccgaacctacttaacgtataagttacttaagtttaccttccgttaccgttactacgttccggtacgacggtaacgtggtacgagctacggacacgtagtacggtagcttccgactactacg

SEQ ID NO: 291255 - DNA, 725 bp, Homo sapiens
  misc_feature: GYAE6OF02GJO7G.40.77.G11.1.454.CMB.1.raw
  modified_base (198)..(198): a, c, t, g, unknown or other
  misc_feature (198)..(198): n is a, c, g, or t
tcagtctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatcgacccagtctccttccaccctgtctgcatctgtagganacagagtcacatcacttcggccggcagtcagtagtattagtacctggttggcctggtactcgagacaacgaaaccgaggggaacgaccccgtaacgcctcctagactactaacgtaaggtactacttacgtaggtttaagaaacggttcgggtacccacgttaccgtacggttacgaggcggtacgtaggtcggtattcggtaggggaactaaggtaacttcggtaccttaccgtaccaacctcgttaaccgacgtacgtaccgccgttacgacgtacgtccgtagtaacgttgtttacgttttacgtaactttaaaccttttacgttaacttccgtaaccctaaacttacgttaacgttagttaattttacgttttaactttcccgtttaacccggttaccgttaaccgtttacgggacccggtaacgggggtacccggtaaggggttacggaacggttaactaaccggtaaaggtacccgtaaacggttcgggttaacggtaccgttacggtaccctacttaccg

SEQ ID NO: 291256 - DNA, 767 bp, Homo sapiens
  misc_feature: GYAE6OF02HA9B9.40.77.G11.1.454.CMB.1.raw
  modified_base (102)..(102): a, c, t, g, unknown or other
  misc_feature (102)..(102): n is a, c, g, or t
  modified_base (371)..(371): a, c, t, g, unknown or other
  misc_feature (371)..(371): n is a, c, g, or t
  modified_base (421)..(421): a, c, t, g, unknown or other
  misc_feature (421)..(421): n is a, c, g, or t
  modified_base (475)..(475): a, c, t, g, unknown or other
  misc_feature (475)..(475): n is a, c, g, or t
tcagtctagcgactcacgaccggtgctcgatttagctagtcactcaagggaaagggggagtcagacccagtcaggacacagcatggacatgagggtccccgntcagctcctggggctcctgctgctcgtggctccaggtgcaaatgtgacactccagatcgaccctagttcctccttccaccctgttcctgctattcgtacggtaggacgactaggagtccacctaagttccacgttcggcccgggacctagttaccgaagtacggtttaacttcgttaaccgttgggttcgtccgttaggtatcaagacctaaccgaaacggtaaggggaaccaccccgtaagccttcgacgtactacgtaagtacgtancgtttacgttagttaaggtaacggtccgggtacctagtccgtagggttcncggaccgtggtaaggcgtagttccgaggtacctaagtacgttcgtacgttaccnccgtaactcgtacgaacggactccgtccggtagtacctcggtaccgtaggttacgttacgttacgttttacgtaaacgtttaaccgtttaacgttacgtaccgtaaacttaacccgttacggttaactaagttttaacgttaaccttttccgtttaccgttaaccgttccccgtttaaacgttacccgggtaacgtaccgggggtaacttagggaaccggttaaggacggtaaccgtaaggtaacccgttggttaccgggtaccgttggtacccgttaccgtacgtacccgg

SEQ ID NO: 291257 - DNA, 976 bp, Homo sapiens
  misc_feature: GYAE6OF02JJOWI.40.77.G11.1.454.CMB.1.raw
  modified_base (100)..(100): a, c, t, g, unknown or other
  misc_feature (100)..(100): n is a, c, g, or t
tcagtctagcgactcacgaccggtgctcgatttagctagtcactcaagggaaagggggagtcagacccagtcaggacacagcatggacatgagggtcccnctcagctcgtgggctcctgctgctcgtcgcctcccgaggtcgaccaatcgtagacactccgagtactacggacccgtgttcccttcccgttacccgacccttggttcctcgacgtacttcggtacgggttacggaacgacgacggtacgttaccacctacgttaccgtaaccgtttccggggaccccggggtccttaacggttaccgtaaggggttaactttaaccgttttaaccggttaacccgggtttacggggtttccgggttaccggtttacggggttaaccttccggaaacggtaaccaaaaccccggtaaaccggtaacggggggtaaaccttacccccggtaaaacggttcctaacccggttacgtaaccgttaacgttaaaccgggaaacgtaccgttaacggtttaaccgttttaaaacggggttttaaacggtaaacggggttacccggggttaacccgtaaccggttaaccggtaagggttaccgaacgggtacccggtaggttaacgggtacggtaaccgtttagggttaaccggggaaacttaaaccggtaaaggtttcccgttaccgttacccgtaacgtttaaacccgccgttaaacccgtacgggtaaacccaccgggttaccggtcgtaaacccgtcgtaacccgtaggttaccgtacggtttaacgtttacgtaaccttaaacgtttaccgttaaccgtactaaccggaattaaccgttataaggttaaccgtttaacttacgtttaccgtaaccgttaacctttaccggtacgggtaaccgggtcgtaacgggtaccgttgggaaaccgtagtaaccgtaaggtaccgttagacggtcgtacgtcgtactactacgg

SEQ ID NO: 291258 - DNA, 678 bp, Homo sapiens
  misc_feature: GYAE6OF02II2VW.40.77.G11.1.454.CMB.1.raw
tcagtctagcgactcacgaccggtgctcgatttagctagtcactcaagggaaagggggagtcagacccagtcaggacacagcatggacatgagggtccccgctcagctcctgggctcctgctgctctggcctcccaggtcgaccaaatgtgacatccagatgacccagtccttccttcccaccctgtctgcattctgtaggagacagtagtcaccattccacttcggccgggcagtacagagttattagtaccgtggttcggtccgtggtactcgaagtccaacgtaaaccgacggggaacgaccccgtaaggtcctacctagtactcttaagaacggtactattacttaaggtttaaacgaacggttcgggtccctagtccgtaggtaccacggtcgacgtaaggtgtagttcggtagggactagtaacgttcgaccttctaccacgtataccgcgtacctacgccgttacgctaacgccgtagtacgttacgttatttacggaacctttaacgttaacgtttaccgtactaaccctaaccgttaagtacgttataacgtttaacctttcgttaacccgttaccgttaccgtttaacggttacccgtaacggaccgggtaacctaagggtacgagacttaaccgagacgtagtcgtacgtcgcgtaccccagtaccg

SEQ ID NO: 291259 - DNA, 453 bp, Homo sapiens
  misc_feature: GYAE6OF01BIRJH.25.62.F07.1.454.CMB.1.raw
  modified_base (359)..(359): a, c, t, g, unknown or other
  misc_feature (359)..(359): n is a, c, g, or t
  modified_base (444)..(453): a, c, t, g, unknown or other
  misc_feature (444)..(453): n is a, c, g, or t
tcagactgtacagtcacgaccggtgctcgatttagtagtcgcataaagggaaagggactggagtggattgggcgtctctatagtagtagggcgtcgaggtacaatccttccctcgagagccgagtcaccatgtcgctggacaggtcctccaatcagttctccctgaggctgacctctgtgaccgccgcagacacggccgtgtattattgtgcgagagaaaatggggggagcagagttttgacgaggaaagtggtggtaatgtcggctaccttgacctctggggccagggaatcctggtcaccgtctcctcagcttccaccaagggcccatcagtctcccctgccgccctgctccaggancacctctggggcacagcggccctgggctgcctggtcaaggctacttccactgtacagtctgagcgggctggcaaggcgcagtagnnnnnnnnnn

SEQ ID NO: 291260 - DNA, 465 bp, Homo sapiens
  misc_feature: GYAE6OF01DBGZQ.25.62.F07.1.454.CMB.1.raw
  modified_base (314)..(314): a, c, t, g, unknown or other
  misc_feature (314)..(314): n is a, c, g, or t
  modified_base (367)..(367): a, c, t, g, unknown or other
  misc_feature (367)..(367): n is a, c, g, or t
  modified_base (457)..(465): a, c, t, g, unknown or other
  misc_feature (457)..(465): n is a, c, g, or t
tcagactgtacagtcacgaccggtgctcgatttagtagtcgcataaagggaaagggactggagtggattgggcgtctctatagtagtagggcgtcgaggtacaatccttccctcgagagccgagtcaccatgtcgctggacaggtcctccaatcagttctccctgaggctgacctctgtgaccgccgcagacacggccgtgtattattgtgcgagagaaaaatgggggggagcagagttttgacgaggaaagtggtggtaatgtcggctaccttgacctcgtggggccaggggaatcctggtcaccgtctcctnagcttccaccaagggcccatcggtcttccccctggcgccctgcctccaggacncacctcgtgggggcacgagcggccctggggctgcctggtcaaggctacttccactgtacagtctgaggcgggctggcaaggcgcagtagnnnnnnnnn

SEQ ID NO: 291261 - DNA, 505 bp, Homo sapiens
  misc_feature: GYAE6OF01B13O6.25.62.F07.1.454.CMB.1.raw
  modified_base (484)..(485): a, c, t, g, unknown or other
  misc_feature (484)..(485): n is a, c, g, or t
  modified_base (488)..(505): a, c, t, g, unknown or other
  misc_feature (488)..(505): n is a, c, g, or t
tcagactgtacagtcacgaccggtgctcgatttagtagtcgcataaagggaaagggactggagtggattgtgcgtctctatagtagtagggcgtcgaggtacaatccttccctcgagagccgagtcaccatgtcgctggacaggtcctccaatcagttctccctgaggctgacctctgtgaccgccgcagacacggccgtgtattattgtgcgagagaaaatgggggggagcagagttttgacgaggaaagtggtggtaatgtcggctacctgacctctggggccagggaatcctggtcaccgtctcctcagctccaccgaagggcccatccggtcttccccctggccgccctgcctccaggagccaccgtcgtcgggggcacgacggccggcccgtggggcctggcccgttgggtcaagggtaccttaccgttcccacgtcgtacagtcgtcgaggccggggctgggcaagggccgcaatagnncgnnnnnnnnnnnnnnnnnn

SEQ ID NO: 291262 - DNA, 567 bp, Homo sapiens
  misc_feature: GYAE6OF01CKC2R.25.62.F07.1.454.CMB.1.raw
  modified_base (535)..(535): a, c, t, g, unknown or other
  misc_feature (535)..(535): n is a, c, g, or t
  modified_base (540)..(567): a, c, t, g, unknown or other
  misc_feature (540)..(567): n is a, c, g, or t
tcagactgtacagtcacgaccggtgctcgatttagtagtcgcataaagggaaagggactggagtggattgggcgtctctatagtagtagggcgtcgaggtacaatccttccctcgagagccgagtcaccatgtcgctggacaggtcctccaatcagttctccctgaggctgacctctgtgaccgccgcagacacggccgtgtattatgtgcgagagaaaagtgggggggagcagagttttgacgaggaaaggtggtggtaatggtcggctaccttgacctcgtggggccagggaatccgtggtccaccgtctcctcagccttccaccaacgggccccagtccggttcccttcccccgtggccgcccctgcctccgaggacgccaccgtcggtcgggggcacgacggcccggcccgtggggcctcggcccgttcgggtaccgaacgggtaccttacccgttccctacgttacggttacctacggttcgtaggacgggccggggtcgtcgggaccgtaaagggcccgacgagtaggnagcgnnnnnnnnnnnnnnnnnnnnnnnnnnnn

SEQ ID NO: 291263 - DNA, 492 bp, Homo sapiens
  misc_feature: GYAE6OF01CK7PD.25.62.F07.1.454.CMB.1.raw
  modified_base (481)..(492): a, c, t, g, unknown or other
  misc_feature (481)..(492): n is a, c, g, or t
tcagactgtacagtcacgaccggtgctcgatttagtagtcgcataaagggaaagggactggagtggattgggcgtctctatagtagtagggcgtcgaggtacaatccttccctcgagagccgagtcaccatgtcgctggacaggtcctccaatcagttctccctgaggctgacctctgtgaccgccgcagacacggccgtgtattattgtgcgagagaaaatgggggggagcagagttttgacgaggaaagtggtggtaatgtcggctaccttgacctctggggccaggggaatcctggtcaccgtctcctcagcttccaccaagggcccatccggtcttccccctggccgccctcggctccaggacgccaccgtcgtgggggcaccgagccgggccctggggcctggcccgtggtcaagggtaccttaccttcccactgtacacgttctggacggcggtcgtggcgaagggcgcagtagnnnnnnnnnnnn

SEQ ID NO: 291264 - DNA, 484 bp, Homo sapiens
  misc_feature: GYAE6OF02GGNEL.25.62.F07.1.454.CMB.1.raw
  modified_base (233)..(233): a, c, t, g, unknown or other
  misc_feature (233)..(233): n is a, c, g, or t
  modified_base (270)..(270): a, c, t, g, unknown or other
  misc_feature (270)..(270): n is a, c, g, or t
  modified_base (364)..(364): a, c, t, g, unknown or other
  misc_feature (364)..(364): n is a, c, g, or t
  modified_base (453)..(484): a, c, t, g, unknown or other
  misc_feature (453)..(484): n is a, c, g, or t
tcagactgtacagtcacgaccggtgctcgatttagtagtcgcataaagggaaaggggactggagtggattgggcgtctctatagtagtagggcgtcgaggtacaatccttccctcgagagcccgagtcaccatgtcgctggacaggtcctccaatcagttctccctgaggctgacctctgtgaccgccgcagacacggccgtgtattattgtgcgagagaaaatgggggggancagagttttgacggaggaaagtggtggtaatgtcggntaccttgacctctggggccagggaatcctggtcaccgtctcctcagcttccacaagggcccatcggtcttccccctggcgccctgcttccaggncacctctgggggcacagcggccctggggctgccctggtccaaggactacttccactgtacagtctgagcgggctggcaaggcgcatagnnnnnnnnnnnnnnnnnnnnnnnnnnnnnnnn

SEQ ID NO: 291265 - DNA, 528 bp, Homo sapiens
  misc_feature: GYAE6OF02IL9ZS.25.62.F07.1.454.CMB.1.raw
  modified_base (234)..(234): a, c, t, g, unknown or other
  misc_feature (234)..(234): n is a, c, g, or t
  modified_base (383)..(383): a, c, t, g, unknown or other
  misc_feature (383)..(383): n is a, c, g, or t
  modified_base (415)..(415): a, c, t, g, unknown or other
  misc_feature (415)..(415): n is a, c, g, or t
  modified_base (473)..(473): a, c, t, g, unknown or other
  misc_feature (473)..(473): n is a, c, g, or t
  modified_base (496)..(497): a, c, t, g, unknown or other
  misc_feature (496)..(497): n is a, c, g, or t
  modified_base (501)..(501): a, c, t, g, unknown or other
  misc_feature (501)..(501): n is a, c, g, or t
  modified_base (503)..(528): a, c, t, g, unknown or other
  misc_feature (503)..(528): n is a, c, g, or t
tcagactgtacagtcacgaccggtgctcgatttagtagtcgcataaagggaaagggactggagtggattgggcgtctctatagtagtagggcgtcgaggtacaatccttccctcgagagccgagtcaccatgtcgctgggacagggtcctccaatcagttctccctgaggctgacctctgtgaccgccgcagacacggccgtgtattattgtgcgagagaaaagtgggggggancagagttttggacgtaagggaaagtggtggtaatggtcggctaccttgactcgtggggccagggaatccgtggtccacggtctcctcacgtcttccacgaacgggcccagtccggtccttcccctggccgtccctcgcctccgaaggcncctacctcggtcgggcacgcggccggtcccgnggctcgccgtcggtacaacggtctactccacgtacgtacacgttctaggaggccgggntcgggacgaggcgacgtagacgnngtcngnnnnnnnnnnnnnnnnnnnnnnnnnn

SEQ ID NO: 291266 - DNA, 521 bp, Homo sapiens
  misc_feature: GYAE6OF01DMRLQ.42.25.C03.1.454.CMB.1.raw
  modified_base (203)..(203): a, c, t, g, unknown or other
  misc_feature (203)..(203): n is a, c, g, or t
  modified_base (505)..(505): a, c, t, g, unknown or other
  misc_feature (505)..(505): n is a, c, g, or t
  modified_base (515)..(515): a, c, t, g, unknown or other
  misc_feature (515)..(515): n is a, c, g, or t
tcagtgacgtatgtcacgaccggtgctcgatttagtagtgtagatttgggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaanagccaccctctcctgtagggccagtcagagtgtcagcacctacttagcctggtaccaacagaaacctggccaggctcccaggctcctcatctatagtgcttccaacagggccactgacatcccagccaggttcagaggcagtgggtctgggacagacttcactctcaccatcagcagcctggacgcctgaagatattgctagtttattactgtcagcagcgtagcagctggcctcggctcgtacgtttcgggcggacgggaccgaaggtggagatacgaaacgtactgtacggctgcacctntctgtcttcnttcccg

SEQ ID NO: 291267 - DNA, 515 bp, Homo sapiens
  misc_feature: GYAE6OF01EHIPX.42.25.C03.1.454.CMB.1.raw
  modified_base (203)..(203): a, c, t, g, unknown or other
  misc_feature (203)..(203): n is a, c, g, or t
  modified_base (509)..(509): a, c, t, g, unknown or other
  misc_feature (509)..(509): n is a, c, g, or t
tcagtgacgtatgtcacgaccggtgctcgatttagtagtgtagatttgggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaangccaccctctcctgtagggccagtcagagtgtcagcacctacttagcctggtaccaacagaaacctggccaggctcccaggctcctcatctatagtgcttccaacagggccactgacatcccagccaggttcagaggcagtgggtctgggacagacttcactctcaccatcagcagcctggacgcctgaagatattgctagtttattactgtcagcagcgtagcagctggcctcggctcgacgtttcggcggagggaccgaaggtggagagtacgaaacgactgtggctgcacctatctgtcttcnttcccg

SEQ ID NO: 291268 - DNA, 625 bp, Homo sapiens
  misc_feature: GYAE6OF01DJ0FP.42.25.C03.1.454.CMB.1.raw
  modified_base (202)..(202): a, c, t, g, unknown or other
  misc_feature (202)..(202): n is a, c, g, or t
  modified_base (297)..(297): a, c, t, g, unknown or other
  misc_feature (297)..(297): n is a, c, g, or t
  modified_base (338)..(338): a, c, t, g, unknown or other
  misc_feature (338)..(338): n is a, c, g, or t
  modified_base (514)..(514): a, c, t, g, unknown or other
  misc_feature (514)..(514): n is a, c, g, or t
tcagtgacgtatgtcacgaccggtgctcgatttagtagtgtagatttgggtttgggggaggaactgctcagttaggacccagagggaaccatggaagccccagctcagcttctcttcctcctgctactctggctcccagataccaccggagaaattgtgttgacacagtctccagccaccctgtctttgcgtccggggaaanacgccaccctctccgtgtagggccagtcagagtgtcagcacctacttaggcctaggtaccaacacgaaacctggccaggcctcccgaggctcctnactctatacgtcgtccttaccagacggcctaactcgaaccncgtaccgacgacgtaggttcaaggacggtcgtagggtcggcgtacggactacgtacttccgactcctacaacctagtaccgacgtcgaacgtcgtaggacgcgtaagataatgttacgactttaagtttactacgtcgacgtagacgacgtcgtagcgagttccgtcggtacccgnggtcctcgttaaccgttcggggacggtaacggacgtacggaggacgtacgtaaacgaacgtcgtagtcggctcgacctacgtcttacgtacgttcctacgtccgttacccg

SEQ ID NO: 291269 - DNA, 512 bp, Homo sapiens
  misc_feature: GYAE6OF01CW2OI.42.25.C03.1.454.CMB.1.raw
  modified_base (203)..(203): a, c, t, g, unknown or other
  misc_feature (203)..(203): n is a, c, g, or t
  modified_base (262)..(262): a, c, t, g, unknown or other
  misc_feature (262)..(262): n is a, c, g, or t
  modified_base (364)..(364): a, c, t, g, unknown or other
  misc_feature (364)..(364): n is a, c, g, or t
  modified_base (403)..(403): a, c, t, g, unknown or other
  misc_feature (403)..(403): n is a, c, g, or t
  modified_base (508)..(508): a, c, t, g, unknown or other
  misc_feature (508)..(508): n is a, c, g, or t
tcagtgacgtatgtcacgaccggtgctcgatttagtagtgtagatttgggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaanagccaccctctcctgtagggccagtcagagtgtcagcacctattagcctggtaccaacngaaacctggccaggctcccaggctcctcatctatagtgccttcaacagggccactgacatcccagccaggttcagaggcaggtcgggtctgggacagacttnactctcacatcagcagcctggacgcctagaagatatcgntagtttattactgtcagcagcgtagcagctggctcggctcgtacgttcggcggaggccgaaggtgagactacgaaacgtactggcggctgacactatctgtctcnttcc

SEQ ID NO: 291270 - DNA, 599 bp, Homo sapiens
  misc_feature: GYAE6OF01B7QPN.42.25.C03.1.454.CMB.1.raw
  modified_base (203)..(203): a, c, t, g, unknown or other
  misc_feature (203)..(203): n is a, c, g, or t
tcagtgacgtatgtcacgaccggtgctcgatttagtagtgtagatttgggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaanagccacctctcctgtagggccagtcagagtgtcagcacctacttagcctggtaccaacagaaacctggccaggcctccaggctcctcactctatagtcgcttcccaacgacgggcccactcgaccactcccaagcccaggttccaggaggcaggtgggtctgggacaggtacttcactctcacatcagcagcctaggacgcctagaacgtatacttggtacttaagttttactacgttgtactaggctaaggtcgtagtccgaggccgttacggcccgttcggtcctaccgttccgttcgggacgggaacgggaccgaagggtggaacgagtaaccgaaacgtacgttggcggtctcggtacaccgtacttcgttagttaccttcgtacttccccg

SEQ ID NO: 291271 - DNA, 757 bp, Homo sapiens
  misc_feature: GYAE6OF01CW7OW.42.25.C03.1.454.CMB.1.raw
tcagtgacgtatgtcacgaccggtgctcgatttagtagtgtagatttgggtttgggggaggaactgctcagttaggaccagagggaaccatggaagccccagctcagcttctcttcctcctgctactctggcctcccagactaccgaccggagaaaattgtgttgacacagtctccagccacctgtcttggtcgtaccgggggaaacgccacctctctggtacggccagtcagacgttgtcagccactacttgcctggtaaccaacgaacgaaaccgtggaccgaacggcctacccgaaggtcctacctactatactataggtcgaccttaccgaacgtaccgggacctactacgacctactacccacggtaccgtaacggttacgaagggaacggtaccgtaggggtcgggttaccggtagggaacctaaggttaccttaccacgtacctaccgaacctacgtacgacgacgtaaccggtccgttaaggggacctaaccggttaagaaacgttaacttacggttcgtaacgtttaacggtttttaaacttaccggtcgttaacgacggtacgtacggtaccggttacgtacgaggtaccgttacggaccttcggacctttacggtaaccgggtttccggggaacgggtaaccgggaaccggtaaggtacgggaaataccggtaaacgaaacgtaggtcggtacggtcgtaaccgtacgacccttagttccgtagtttacctcgttacgttacccgg

SEQ ID NO: 291272 - DNA, 737 bp, Homo sapiens
  misc_feature: GYAE6OF01C3XT5.42.25.C03.1.454.CMB.1.raw
  modified_base (202)..(202): a, c, t, g, unknown or other
  misc_feature (202)..(202): n is a, c, g, or t
tcagtgacgtatgtcacgaccggtgctcgatttagtagtgtagatttgggtttgggggaggaactgctcagttaggacccagagggaaccatggaagccccagctcagcttctcttcctcctgctactctggctcccagataccaccggagaaattgtgttgacacagtctccagccacctgtctttgtctccgggggaaangccaccctctcctgtagggccagtcagagtgtcagcacctacttagcctggtaccaacagaaacctggccaggctcccgaggcctcctcatctatagtgccttaccaaacgacgggccctaacgtggaccaactccccaagcccgtaagggtttccaaggtacggcgtaaggtcggggtcctggggaactaggtaacctttccaaccttctaccaacctatccgaagccaacggtcccgtagggacgtcctaggaaagtaacgtttattacgtacttaagttttaacttaacgttgtacgaaggtacgtaggtacgttagcgtaacgtcgtcgggtcccgttccgggccttaccgtaccggttttaccggggaccgggtaaccggggtaaccggtaaacggggttacgggtaaacggtaaccgttaaccggaaaaaccgggtacggttagggttacgggtacccgttacgggtaaccctaacccgtaacgtttaccgttacggtttaccctttaccgttacccgtttacccccgg

SEQ ID NO: 291273 - DNA, 636 bp, Homo sapiens
  misc_feature: GYAE6OF01CNWMK.42.25.C03.1.454.CMB.1.raw
  modified_base (202)..(202): a, c, t, g, unknown or other
  misc_feature (202)..(202): n is a, c, g, or t
  modified_base (318)..(318): a, c, t, g, unknown or other
  misc_feature (318)..(318): n is a, c, g, or t
tcagtgacgtatgtcacgaccggtgctcgatttagtagtgtagatttgggtttgggggaggaactgctcagttaggacccagagggaaccatggaagccccagctcagcttctcttcctcctgctactctggctcccagataccaccggagaaattgtgttgacacagtctccagccacctgtctttgcgtccgggggaaanacgccaccctctcctgtacgggccagtcagagtgtcagctacctacttagcctaggtaccaacagaaacctggccaggctcccaggcctcctcatctatacgtgcttaccaaacgngggcccactagacactcccagccctaggttcagaggcagtgggtctgggacaggtacttcactctcacatcagcagccgtaggacgcctagaagtatagttcgacgttagtttactaacgttgtacgaagtcgaagtccggttagccgagtaccgtcgggtccctacgggtcctaccgttaccggtttcgggaccgggtacgggtaaccgaagggtacggaagtaacgtaaccgtaaaacgggtacgtgggtacggtacccgtagacccgtaaccgttactaccggttaccgttcctttacccgtcctttacccccgg

SEQ ID NO: 291274 - DNA, 644 bp, Homo sapiens
  misc_feature: GYAE6OF01C77MW.42.25.C03.1.454.CMB.1.raw
  modified_base (202)..(202): a, c, t, g, unknown or other
  misc_feature (202)..(202): n is a, c, g, or t
tcagtgacgtatgtcacgaccggtgctcgatttagtagtgtagatttgggtttgggggaggaactgctcagttaggacccagagggaaccatggaagccccagctcagcttctcttcctcctgctactctggctccagataccaccggagaaattgtgttgacacagtctccagccaccctgtctttgcgtccgggggaaangcccaccctctcctgtacgggccagtcaggagtgtcagcacctacttagcctggtaccaacagaaacctggaccaggcctcccgaggcctcctcatctaatagtgccttaccgaacgacgggaccactcgaaccactcccgagccgtaaggttccaagacggcgagggtcgggtcgtagggacacgtacttcactctacaccaatcgaagcacggtccgtagggacgtaccgtagaagtattacgttagactttagtttaacttacgtgtacagtaccaggtcgtagcgagtccgtcggtccctcggtccttacgtccggtttacggggcggtaagggaccgtaagggttcggaacgtaacgtaacgaaaaccggtacgttagggtacggtccgacggtaccacctaacgttccgttacgtttcctacgttcccttaccccg

SEQ ID NO: 291275 - DNA, 702 bp, Homo sapiens
  misc_feature: GYAE6OF01AILJC.42.25.C03.1.454.CMB.1.raw
  modified_base (321)..(321): a, c, t, g, unknown or other
  misc_feature (321)..(321): n is a, c, g, or t
tcagtgacgtatgtcacgaccggtgctcgatttagtagtgtagatttgggtttgggggaggaactgctcagttaggacccagagggaaccatggaagccccagctcagcttctcttcctcctgctactctggctcccagataccaccggagaaattgtgttgacacagtctccagccaccctgtctttgtcgtccgggggaaagacgccaccctctccgtgtagggccagtcagagtgtcagcacctactagcctggtaccaacagaaacctggccaggcctacccgaggcctcctcagtctatacgtcgccttccaacgngggccacgtcgaccactcccgagtcccgaggttcagacggcaggtaggtcgtgggacaggtacttcgactcaccactatccagccaggcccgtaggacgtccgtaggaaacgtacgttagttacggtactttacgtttaacgtttaccgttacgtaccgtaacggtaccgtacggtacgttaacgcgtacgtccggtacggttcccgtaccgggtccgttaccggtaaccggttttccgggggaaccgggtaaccggggtaacccggtaaggggtaacgggtaacggtaagtaaacccggaaacggtaaccggttgggtaccggtcgttacgaccctaccgtaacgttccttaacggttcctttaccgtcccgttaccccg

SEQ ID NO: 291276 - DNA, 621 bp, Homo sapiens
  misc_feature: GYAE6OF01DFBX8.42.25.C03.1.454.CMB.1.raw
  modified_base (123)..(123): a, c, t, g, unknown or other
  misc_feature (123)..(123): n is a, c, g, or t
  modified_base (206)..(206): a, c, t, g, unknown or other
  misc_feature (206)..(206): n is a, c, g, or t
  modified_base (392)..(392): a, c, t, g, unknown or other
  misc_feature (392)..(392): n is a, c, g, or t
tcagtgacgtatgtcacgaccggtgctcgatttagtagtgtagatttgggtttgggggaggaactgctcagttaggacccagagggaaccatggaagccccagctcagcttctcttcctcctnctactctggctcccagataccaaccggagaaaattgtgttgacacagtctccagccaccctgtctttgtctaccgggggaaangccaccctctaccgtgtagggccagtcagagtgtcagcacctacttagcctgtaaccaacagaaacctggacccaggcctccaggcctacctcatctaatagtctccttacaacgacggccactgactactcccagccaggttcagagcaggtggctggacagtacttcactatcactatcagcanccgtagcgtcgtagaacgtatatagtacttaagttattacgttgacagtactaacggtccgtagcgtacgtccgtcggtacctcgggtccttaccgtacggtttacggggtacggaaccggggaaccgaagggttagggaacgtaacgtaaaccgaaacggtaacgttacggttcgggtacttacggaccacgtacgtttacttggtttacctaccgtacttacccccg

SEQ ID NO: 291277 - DNA, 760 bp, Homo sapiens
  misc_feature: GYAE6OF01ETV1Z.42.25.C03.1.454.CMB.1.raw
  modified_base (203)..(203): a, c, t, g, unknown or other
  misc_feature (203)..(203): n is a, c, g, or t
  modified_base (293)..(293): a, c, t, g, unknown or other
  misc_feature (293)..(293): n is a, c, g, or t
tcagtgacgtatgtcacgaccggtgctcgatttagtagtgtagatttgggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaangccacctctcctgtaggccagtcagagtgtcagccacctacttagcctggtaaccaacacgaaacctggccaggcctcccgaggctcctnactctatacgtgcttaccaacgacgggccacgtcgaccactcccagcctaggttcgaggacgtcgaggtgggtcgtagggactaaggcttaccaccttctaccaacctattaccgacgtccgtaggccccgttagggaccgtaccgtacggtaacgtaagtttaacgtttacggtaccgtttaaggttttaactttaccgttacggttacgtaacggtaccgtacggtttacggttaaccggtacgttaccgggtccggttaccgggtaccccggttaccgggtcccgttaccggttaaccgggtttttcccggggaaccggggttaaccggggtaacccggtaacgggggttacgggtaaaccggtaacgtaaacccggtaaaaccgggtaaccggttacgggttacggtaccgtacgtacccgtaaccgtacttacgttaccgttccttcgtccgtttacccccg

SEQ ID NO: 291278 - DNA, 708 bp, Homo sapiens
  misc_feature: GYAE6OF01CBVOC.42.25.C03.1.454.CMB.1.raw
  modified_base (207)..(207): a, c, t, g, unknown or other
  misc_feature (207)..(207): n is a, c, g, or t
  modified_base (376)..(376): a, c, t, g, unknown or other
  misc_feature (376)..(376): n is a, c, g, or t
  modified_base (391)..(391): a, c, t, g, unknown or other
  misc_feature (391)..(391): n is a, c, g, or t
  modified_base (430)..(430): a, c, t, g, unknown or other
  misc_feature (430)..(430): n is a, c, g, or t
tcagtgacgtatgtcacgaccggtgctcgatttagtagtgtagatttgggtttgggggaggaactgctcagttaggacccagagggaaccatggaagccccagctcagcttctcttcctcctgctactctggctcccagactaccaccggagaaattgtgttgacacagtcctccagcccaccctgtctttgcgtaccgggggaaanacgcccaccctctccgtggtacgggccagtcagtagtgtcgagcctaccttacgttacgcctaggtaacccaacgacgaaaccgtcggaccacggcctcccgaggcctcctgactctatagtcgtactaccaacgcggaccactcgacactcccagcctagttacgagnggcgtaggtggtcgnggacagtactcactcacacgtatacgagcacgcgagacncgtagaactattacgtgtacgttagtttactcgtgtactagagtacggtacgtagcgtaggtccgtcggtcccgttacgtaccgtacccggttaccgggtttaccggggacgggttaaaccgggtacgggtaaacgggtacggtaaacggttaaacgtaaaccgggtaaaacccggttaacggttacggggtacggtacccggttaccgaccccgttaaacgttaccgtttaacccgtttccgtttaaccccgtttagttcccccggttttaccccgg

SEQ ID NO: 291279 - DNA, 791 bp, Homo sapiens
  misc_feature: GYAE6OF01CQ1AX.42.25.C03.1.454.CMB.1.raw
tcagtgacgtatgtcacgaccggtgctcgatttagtagtgtagatttgggtttgggggaggaactgctcagttaggacccagagggaaccatggaacgccccagctcagtcttctcttcctcctgctactctggctccagataccaccggagtaattgtgttgacacagtcctccacgccctaccctcgttctttcgtaccggtaccgggggaaagtacgccctacccctcctaccgtaggtacggggcccagtacaggtagttcgtacacgtacctaccgttactacgtccgtacggtaacccaaacacgtaaaccgtcggaccgcggacctcccgaggtcctaccctacgtactaccgttaatacgtccgtaccctttaaccgaaccggtaccggacctaccgtacggtaaccctaccgtacccgaacgcccgttaacgggtcgaagggacggtaccggtagggttcgggtaccggtacggggaactacgttaccgttctacctaccgtaccaccttacgcacggaccgtacgtaccggtacggtacgtaccgtagtaacgtattacgtcgtagtttacttacttacgtgttacgtagacgtacgtacgtacgcgaggtccgtccggtccgtccggtcttacccgttacgggttacccggggtaaccgggtacgggtaacccggtagggtaacgggtacgtaaccgtacggaaacggttcggacggtaccggtcgtacgtaccccgtacgtacgttcgttaccgtttcccttcgtccgtttacccccgg

SEQ ID NO: 291280 - DNA, 844 bp, Homo sapiens
  misc_feature: GYAE6OF01DEVEH.42.25.C03.1.454.CMB.1.raw
  modified_base (211)..(211): a, c, t, g, unknown or other
  misc_feature (211)..(211): n is a, c, g, or t
tcagtgacgtatgtcacgaccggtgctcgatttagtagtgtagatttgggtttgggggaggaactgctcagttaggacccagagggaaccatggaagccccagctcagcttctcttcctcctgctactctggctcccagactaccaccggagaaattgtgttgacacagtctccgacgcctaccctgttcttcgtcgtaccgggggaaaancgcctaccctctccgtggtacgggccagtcgagagtcgtcagctaccttaactcgccttacggtaaccaaacgacgaaacccgtggccacggcctacccgacggcctccgtactacgtactagtacgtcgtcctttaccgaaccggacgggaccctacgtacgactacctacccgacgaccgtaagggttaccgaacgggtacgtacggtacggggttacgggttccggtacggggtaaccgtaacggttaacccgtttaacccgtaccgtacccgttaccccaaacccggtaacttaccccgaaacgtccggtaaccggtacccggtacggggtacgtaacccggttaaggtaaacggtaagtttacgtttacgacgttttaacgggttttaactttacggttcgttaccgtaacggtacgtaacggtacggttaacgtacggtaccggtccggttccgggtcctccgggttaccggttaccggttaaccgggtttccggggaaccggggtaaccggggtaaccggtaggggtaacgccggtaaacggtaccggtaaacgtaccgggttacggaggttcccgacgttaccgtaccgtacgttacgttccttcgttacctccgtttaccccgg

SEQ ID NO: 291281 - DNA, 557 bp, Homo sapiens
  misc_feature: GYAE6OF01CJTNJ.42.25.C03.1.454.CMB.1.raw
  modified_base (202)..(202): a, c, t, g, unknown or other
  misc_feature (202)..(202): n is a, c, g, or t
  modified_base (261)..(261): a, c, t, g, unknown or other
  misc_feature (261)..(261): n is a, c, g, or t
  modified_base (326)..(326): a, c, t, g, unknown or other
  misc_feature (326)..(326): n is a, c, g, or t
  modified_base (339)..(339): a, c, t, g, unknown or other
  misc_feature (339)..(339): n is a, c, g, or t
  modified_base (377)..(377): a, c, t, g, unknown or other
  misc_feature (377)..(377): n is a, c, g, or t
  modified_base (387)..(387): a, c, t, g, unknown or other
  misc_feature (387)..(387): n is a, c, g, or t
tcagtgacgtatgtcacgaccggtgctcgatttagtagtgtagatttgggtttgggggaggaactgctcagttaggacccagagggaaccatggaagccccagctcagcttctcttcctcctgctactctggctcccagataccaccggagaaattgtgttgacacagtctccagccaccctgtctttgctccgggggaaangccaccctctcctgtagggccagtcagagtgtcagcacctacttagcctggtaccaacngaaacctgccaggctccaggctcctcatctatagtgcttccaacacgggccactgacatcccagnacccccggttagngcaggtggtctggacagacttcactctcaccatcagcncgcctggacnccgtagaagatattgctagtttatactgtcagcagcgtagcgagcgtcggccgtcggcctcctacgtttccggacgggacgggaccgaagggtggaagactaccgaaaacgtacgtggtcggaccgtcgaccacccgtacttaccgttgttccttcgtacgtttcccccg

SEQ ID NO: 291282 - DNA, 861 bp, Homo sapiens
  misc_feature: GYAE6OF01AHJTV.42.25.C03.1.454.CMB.1.raw
  modified_base (205)..(205): a, c, t, g, unknown or other
  misc_feature (205)..(205): n is a, c, g, or t
tcagtgacgtatgtcacgaccggtgctcgatttagtagtgtagatttgggtttgggggaggaactgctcagttaggacccagagggaaccatggaagccccagctcagcttctcttcctcctgctactctggctcccagataccaccggagaaattgtgttgacacagtctccagccaccctgtctttgtcgtaccgggggaaanagccaccctctcctgtagggccagtcagagtgtcagcacctacttagcctggtaccaacagaaacctggccaggcctacccgaggcctcctcattctagtagtgccttaccaacgacgggccactcgacactacccgacgacctaggttccaaggtacggcgtagggtgggttaccgtagggaacacggtaactttccaacgttccctacaacctactaccgacgtaccgagtcccggttagggaaccgtcccgttaaggaaagttacgtttaacgtttcgggtaaccgtttaaacgtttttaacgtttaaccgtttacggttaaccgtaacgggtaccgtaaaccggggtacggttaacccggtaccgtaaccgggttaaccgggtttaccccggggtacccgtttcccggggttaaccctttacccgggttaacccggggtttttacccgggggaacccgggggttaaacccgggggtaacccgggttaaaacggggggtcggggtaaaaccggtaaaccggttaaaaccggtaaaaaccggggttaacccggttagggttacgggtacccggtttaccgaacccggttaacccgttaaccgtttacccgtttaccggtttaccctttaccgtttaccccgttttaccccccgg

SEQ ID NO: 291283 - DNA, 909 bp, Homo sapiens
  misc_feature: GYAE6OF01B7SIV.42.25.C03.1.454.CMB.1.raw
  modified_base (518)..(518): a, c, t, g, unknown or other
  misc_feature (518)..(518): n is a, c, g, or t
tcagtgacgtatgtcacgaccggtgctcgatttagtagtgtagatttgggtttgggggaggaactgctcagttaggacccagagggaaccatggaagccccagctcagcttctcttcctcctgctactctggctcccagactaccaccggagaaattgtgttgacacagtctccagcccacccttgttctttgtaccgtaccgggggaaagacgcccacctctcctggtacgggccagtcagagttgcacgccaccgttacttacggcccttacggtaacccaaacgaacgtaaacccgtggaccctagggtacctccccgaaggtccctcccgttactaacttacgttatacggtcgtacctttaccgaaacgcggggtacccacttacggacctaaccgtccccgaaggtcccgtaagggtttaccgaaggaccgggtaccgtagggttccgggtaccggtacggggtaaccgtaaggttacccttacccgtaccgtaccctacccgtaaaccctnttacccgacgtaccgaaccggtcccggtacgggtaaccgtaccggtaagaaacggttaacgtttacgttaccgggtttaaccgtttaacggtttttaaacgtttacccgttaaggttaccgtacggtacccgtaacggtccgtaaccggacgtaacgggtcccgtcgggtacccggtacgggtacccgtttaccggtaaccgggtttccggggaaccggggtaaaccgggtaccgggttaaaggggtcgggtaaacggtaacgttaaacccggggtaaaaacgttacccggggtgggtttaacccggcccgttcgggaaacccccttacccgggtaaccgtttcccgtttaaccgtttccccgttttccgtaaccggttttacccccccgg

SEQ ID NO: 291284 - DNA, 765 bp, Homo sapiens
  misc_feature: GYAE6OF01CACTM.42.25.C03.1.454.CMB.1.raw
  modified_base (204)..(204): a, c, t, g, unknown or other
  misc_feature (204)..(204): n is a, c, g, or t
tcagtgacgtatgtcacgaccggtgctcgatttagtagtgtagatttgggtttgggggaggaactgctcagttaggacccagagggaaccatggaagccccagctcagcttctcttcctcctgctactctggctcccagactaccaccggagaaattgtgttgacacagtctccagccaccctgtctttgcgtccgggggaaancgccaccctctccgtgtacgggccagtcagagtgtcagcacctactagcctggtaccaacgagaaacctggaccacggcctcccgacggtcctccgtctagttctaagtacggtcgtccttacccgaaacgacggggtaccctacgtcgaacctactccccgacgacctaggtacaggtaggccgtagggttcgggtacggtagggaaccagttacctttaccgaccttccgtacccaaccgatccgaacgtccgacgtccggtagggtacgtaccgtaagtaacgtagtttacgttacgactttaacgttttacgtttacgtcgtacgtaacggtacgtaaccggtacggttacgtaccgtaacggtccgggttaccgggtccccgttaccggggtccttacccgggttacccggggtttaccggggacccggggaacgggtaccggtaacggggtacggtaaccggtaacgtaaaccggtaaaaccggtacggttgggtaccggcgttaacgccccttaacgtacgtttccgtactttccttaccgtactttacccccg

SEQ ID NO: 291285 - DNA, 857 bp, Homo sapiens
  misc_feature: GYAE6OF01CU2DH.42.25.C03.1.454.CMB.1.raw
  modified_base (818)..(818): a, c, t, g, unknown or other
  misc_feature (818)..(818): n is a, c, g, or t
tcagtgacgtatgtcacgaccggtgctcgatttagtagtgtagatttgggtttgggggaggaactgctcagttaggacccagagggaaccatggaagccccagctcagcttctcttcctcctgctactctggctcccagataccaccggataaattgtgttgacacagtctccagcctaccctgttctttgccgtaccggggaaagcgcccaccctctccgtggtacggccgtacgtcgagacgttcgtacacgacctaccttaacgttacgccgttaacggtaacccaaacgaaccgtaaacccggtggacccgacggtccctacccgaggttaccctccttacctaacgttaccttagttaacggtaccgttaccctttaacccgaaaccgggtacccgggtaccctacggtaaccggtaaacctacccgtacccgtaacggtaccccggttaacgggttaccgtaaacgggtacggaccgggttacgggttaccgggtcggttaccgggaaaccgtaaccggtttacccttaacccgtcccgttaccgtaaccctaaccgtaaccgttccgaaaccgacccggttaccgtacccggtagggtaccgttaacgtaaacggtaagttaacgtttacgtacggttaacgttttaaacgttttacgttaagttccgtaagggacctagaccggtacgttacggaccgtaggttccgtaccggtcccgtcggtccgttaccgtccgggttcgggaacggtaccggtacggtaggtaaccgataaaccgtaagtaccggtaacgttggtaccgtcgtaacncgtacctacgttccggttagtccctattcccgttacccg

SEQ ID NO: 291286 - DNA, 740 bp, Homo sapiens
  misc_feature: GYAE6OF01BFD1U.42.25.C03.1.454.CMB.1.raw
  modified_base (448)..(448): a, c, t, g, unknown or other
  misc_feature (448)..(448): n is a, c, g, or t
tcagtgacgtatgtcacgaccggtgctcgatttagtagtgtagatttgggtttgggggaggaactgctcagttaggacccagagggaaccatggaacgccccagctcagcttctcttcctcctgctactctggcctcccagactaccaccggataaattgtgttgacacacgtctaccacgccctaccctgttctttgtccgtaccgggggaaagacgcccacctctcctggtacggccagtcagagtgtcacgcctacctacgttacgccgtacggtaaccaaacgaacgaaaccgtcggaccgacggcctaccgacgccttcctactattactagtacgtcgtacctaccaacggacggccactacgaccacctaccgacgtcctacggtacaacggaggcgtaggtcgggtcgaggacacgtactcgactctacaccatcgaacncgacgtcgacggacgtaccgtaaggaactaattacgttctagtttaattttacgtacgttacgtacgagttacgacggtacgtacgacgcggttacccgtcggttacccgtccggttacccgttaccgggttacccgggttacgggggaccggtaaccgggtaacggtacggggttaacggaaagttaaccgtaaaaccgggtaaacggtacggtcggtaaacggtcctaaccgggaacccgtaaccgttacttcccgttaaggtttcccttaccggttcccttacccccgg

SEQ ID NO: 291287 - DNA, 796 bp, Homo sapiens
  misc_feature: GYAE6OF01D5XTB.42.25.C03.1.454.CMB.1.raw
  modified_base (151)..(151): a, c, t, g, unknown or other
  misc_feature (151)..(151): n is a, c, g, or t
tcagtgacgtatgtcacgaccggtgctcgatttagtagtgtagatttgggtttgggggaggaactgctcagttaggacccagaggaaccatggaagccccagctcagcttctcttcctcctgctactctggctcccagactaccaccgganaaattgtgttagacacagtcctccacgccacccgttgttcttcgtccggtaccggggaaagacgccctaccctctccgtaggtacggccaggtcgagtacgtgtaccgactccgtaccgttacgttaccggcctaccggtaacccaaaccgaacgaaaccgtcggacccgtaacggtcccctacccgcggtacccttcccgtactaacgttccttaaacgttagtccggtaaccccttaacccgaaacggtacccgggacccgtaacgtaaccgaacccgtacccgtacccgaacggtaccggttaaacggttacgaacgggtacggtaaccggtacggggtttacgggtaccggtaaggggtaacctaacgttacccgttaccgaccgtttcccgtaaaccgacccgtagtaccgaacgccggtaacggtccgtacgggaccgtaccgtaaggtaatacgttacgttcgttaacgttagttaacttacgtacgtacgagtaccgtagtcgagcgtacgtcgtcgcgtcgtcgtcgtcgttcggaggtacggacgaggtacggagtaccgtaacgtaaacgtcggtagacccggtgaccgtcctaagttaccgttcgttacgttaccttcgtacccgttacccgg

SEQ ID NO: 291288 - DNA, 501 bp, Homo sapiens
  misc_feature: GYAE6OF02J1V6W.42.25.C03.1.454.CMB.1.raw
  modified_base (203)..(203): a, c, t, g, unknown or other
  misc_feature (203)..(203): n is a, c, g, or t
tcagtgacgtatgtcacgaccggtgctcgatttagtagtgtagatttgggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaanagccaccctctcctgtagggccagtcagagtgtcagcacctacttagcctggtaccaacagaaacctggccaggctcccaggctcctcatctatagtgcttccaacagggccactgacatcccagccaggttcagaggcagtgggtctgggacagacttcactctcaccatcagcagcctggacgcctgaagatattgctagtttattactgtcagcagcgtagcagctgcctcggctcacgtttcggcggaggacaggtgagatcaacgaactgtggctgcacatctgtcttcatcc

SEQ ID NO: 291289 - DNA, 848 bp, Homo sapiens
  misc_feature: GYAE6OF02G0P2E.42.25.C03.1.454.CMB.1.raw
  modified_base (202)..(202): a, c, t, g, unknown or other
  misc_feature (202)..(202): n is a, c, g, or t
tcagtgacgtatgtcacgaccggtgctcgatttagtagtgtagatttgggtttgggggaggaactgctcagttaggacccagagggaaccatggaagccccagctcagcttctcttcctcctgctactctggctcccagataccaccggagaaattgtgttgacacagtctccagccaccctgtctttgctccgggggaaanagccaccctctcctgtagggccagtcagagtgtcagcacctacttagcctaggtaccaacagaaacctggaccaggcctacccgaggcctcctacatctaatagtcgtaccttaccaaacgtacggggaccctaacgtacgaacctaactccccgaaggcccgtaacgggtttacccaaggtacgggtaccctaaggggttcgggggttacccgttaggggggaaccctaagggtaaccccttttaccgaaccgttttaccccgttacccgaaaccccgttaacttacccggtaaacggtcccggaaaccggttcccccggttaggggaaccggtaccccgtttaaggaaaacggtaaacgttaaacgtttacggtaaccgttaaacgtttttaaacgtttaacgttaacggttaccgtaacggtaccgtaaagggtaccggtaagtttaccgaaggtccggtacgggtcccgttaccgggtacctaccgttaccggtttaccggggaccgggtaaaccggggaaccggtaaacggggtacgggaacggtaacgtaaccggtaaaaccggtaacggttacgggtacggtaccgtacggtaacctaccgtacttccgttacggttaccttaccgtacctttaccccg

SEQ ID NO: 291290 - DNA, 727 bp, Homo sapiens
  misc_feature: GYAE6OF02GTK4W.42.25.C03.1.454.CMB.1.raw
tcagtgacgtatgtcacgaccggtgctcgatttagtagtgtagatttgggtttgggggaggaactgctcagttaggacccagagggaaccatggaagccccagctcagcttctcttcctcctgctactctggctcccagataccaccggagaaattgtgttgacacagtctccagcccaccctgtctttgtcgtaccgggggaaagacgccaccctctcctggtaggccagtcagagtgtcagcacctacttagcctgtaaccaacgaagaaaccgtggaccacggcctcccgaggtcctcctcaatctaataggtcgtaccttacccaaacgtcgggacccctaacgtacgacctactccccgaaggaccctaaggttccgaaggacggccgtaagggtcggggtcgtagggaactaagtaccttcaaccttctaccaccgtatccgacgcacggtcccgtaggacgaccgtaagaacgtaagttagttcgtacgttaacgtttaacgttacgtagttaccgaggtacgtaacggtccggtaagaccgtacggtaccggtcggtcccgttacggtcccttaccgtaccggtttaccggggaccggggtaaccgggtaacccggtaagggtacgggtaacgtaccgtaacggaaaccgttacggtacggtcggtacgtacgaccgtactacgttccgttacggtttcccttacgtaccgttaccccg

SEQ ID NO: 291291 - DNA, 746 bp, Homo sapiens
  misc_feature: GYAE6OF02H0OXG.42.25.C03.1.454.CMB.1.raw
  modified_base (204)..(204): a, c, t, g, unknown or other
  misc_feature (204)..(204): n is a, c, g, or t
  modified_base (281)..(281): a, c, t, g, unknown or other
  misc_feature (281)..(281): n is a, c, g, or t
tcagtgacgtatgtcacgaccggtgctcgatttagtagtgtagatttgggtttgggggaggaactgctcagttaggacccagagggaaccatggaagccccagctcagcttctcttcctctgctactctggctcccagataccaccggagaaattgtgttgacacagtctccagccaccctgtctttgtcgtaccgggggaaanacgtccacccttctccgtggtacgggccagtcaggtagtgtacagctaacctacttacgccgttacggtaacccaanaacgaaaccgtggaccaacggcctcccgacggtcctcctcactctatacgtgtcccttaccgaacgtacgggcccacgtacgacacctacccgagacccgtaggttacagggtaacgctagggtcggtaggtacgggactacggtactttccaaccgttccacccgtaactacgtccgaacgccaacggtcccgtaggggccttaccgtaggtaaatacgtttagttaccgtagttttaacgttttaacgttcgttacgtagtacggttaacgacggtacggttacgaccgtacggtccgtcgggtcccgttcggacctttacccgtaccgggttccggggaacggggtaacgggaccggtaagggttacggaactacgtaaaccggtaacgtaaccgggtggttaccgaccgttaacgcccgtaaccgttatcgttacccgttactttccgtaccctttccccg

SEQ ID NO: 291292 - DNA, 628 bp, Homo sapiens
  misc_feature: GYAE6OF02HL1UF.42.25.C03.1.454.CMB.1.raw
tcagtgacgtatgtcacgaccggtgctcgatttagtagtgtagatttgggtttgggggaggaactgctcagttaggacccagagggaaccatggaagccccagctcagcttctcttcctcctgctactctggctcccagataccaccggagaaattgtgttgacacagtctccagccaccctgtctttgtcgtccgggggaaagcgccaccctctcctgtacgggccagtcagagtgtcagcacctacttagcctggtaccaacagaaacctgccaggctcccgaggcctcctcatctatagtcgtcttacccaacgacgggcccacgtgaccactcccagccaaggttcaggaggcaggtgggtctagggactagtacttcactctacacctatcgacgcacgcctggactcgtagaagtaattattgtacttagtttacttacttcgtacagtacgtagtacgtagcgtacgtccgtcgtcccggtcggtccttccgtaccggtttcgggaccggggtaacgggaaccgtaaggggtacgacgggtactaaccggtaaacggtaacgtcggtacggtccgttacggacctaccgtacgtcgttaccgttacttccgtacttccccg

SEQ ID NO: 291293 - DNA, 760 bp, Homo sapiens
  misc_feature: GYAE6OF02HGHKL.42.25.C03.1.454.CMB.1.raw
  modified_base (209)..(209): a, c, t, g, unknown or other
  misc_feature (209)..(209): n is a, c, g, or t
  modified_base (505)..(505): a, c, t, g, unknown or other
  misc_feature (505)..(505): n is a, c, g, or t
tcagtgacgtatgtcacgaccggtgctcgatttagtagtgtagatttgggtttgggggaggaactgctcagttaggaccagagggaaccatggaagcccagctcagcttctcgttcctcctgctactctcggctcccagactaccacggagaaattgtgttgacacgagtcgtccacgccaccctgtctttgtccggtaccgggggaanacgccacctcctccgtggtacggccacgtcgacgtagtcgtcacgctacctacttacgccgtacggtaaccaacgaacggtaaccgtggccgaacggtcccgtaccgacggtacccttccgtacctacgttactacggttacgtcgtaccttaacccgaacgggtacggacccttacgaacggaacctaccgtaacccgcggtaccgttacggttacgaaggtaccggtacgtacgggtcgggttacggaccgggaacgtacgttaccgtacaccgtttcaaccgtacctacgtanaccgacgtaccgtcggtacggacgttacgacgaacgtacgttacgtagtcgttaacgttcgtaacgtcgtacgtacggacgttacggtaacgacgtaggtcgtaccggttcggtacccgcggttaccgacgtttaccggggtaccgggtaccgggaacgggtaaacggttacggacggaacctacggtaacggaaaccgtcggtaggtacaccgtacgaccgtacgtcgtccgttagtacctccggtactccccg

SEQ ID NO: 291294 - DNA, 718 bp, Homo sapiens
  misc_feature: GYAE6OF02HQCKY.42.25.C03.1.454.CMB.1.raw
  modified_base (205)..(205): a, c, t, g, unknown or other
  misc_feature (205)..(205): n is a, c, g, or t
  modified_base (236)..(236): a, c, t, g, unknown or other
  misc_feature (236)..(236): n is a, c, g, or t
  modified_base (268)..(268): a, c, t, g, unknown or other
  misc_feature (268)..(268): n is a, c, g, or t
  modified_base (298)..(298): a, c, t, g, unknown or other
  misc_feature (298)..(298): n is a, c, g, or t
tcagtgacgtatgtcacgaccggtgctcgatttagtagtgtagatttgggtttgggggaggaactgctcagttaggacccagagggaaccatggaagccccagctcagcttctcttcctcctgctactctggctcccagataccaccggagaaattgtgttgacacagtcctccagcccacctgtctttgtcgtaccggggaaancgccaccctctcctaggtacggccagtcagngtcgtcagcacctacttacgcctagtaccaanacgaacctggaccaggcctcccaggctccncatctaatcgtcgccttccgaaacgcgggcccacgtgaaccactccccagtcctaaggttcaaggacggtaccgtaggttcgggtacgtcgggaacctagtaccttccgacttctaccaccgtattaccgaacgacctacgccgtaaggaccgtacccgtaggaaacgtaattacgttcgtacgttaaagtttttacgtacgttcgtacgtcgtaaccgtggttaccgtacgctacggtcgtacggtcccgtcgtaccgtaccgttccggttaccgggacgggttaaacggacccggtaaagggtacggaacggttaaccttaaccgggaaaaccgttacgggtcggttaaccggtaccgtacgggacccttaccgttacgttccgttaccggttaccctttcggtacccctttccccgg

SEQ ID NO: 291295 - DNA, 895 bp, Homo sapiens
  misc_feature: GYAE6OF02GT2BA.42.25.C03.1.454.CMB.1.raw
  modified_base (204)..(204): a, c, t, g, unknown or other
  misc_feature (204)..(204): n is a, c, g, or t
tcagtgacgtatgtcacgaccggtgctcgatttagtagtgtagatttgggtttgggggaggaactgctcagttaggacccagagggaaccatggaagccccagctcagcttctcttcctcctgctactctggctcccagataccaccggagaaattgtgttgacacagtctccagccaccttgtctttgtctaccgggggaaancgcctaccctctccctggtacgggaccagtcagacgtggtccagactacctacttacgcctacggttaaccaacgacgaaaccgtcgaccgaggtcctcccgaggtccgtccctacgtactaccttagtagttcgtacctttacccgaacgtaccgggtaccccaccgttcggaacaccgttccccaacggccccgttaacgggtttaccaaacgggtacgggtccgtaggggttcggggtacccgttgggaaaccgtacggttaccttacacccgtttccgtacctaccccgtaaatttacccgaaccgtacgtaccggtcccggtaagggaccggtccccgtttaaagggtaaacggttacgtttaaagtttaccgggtagttttaaacgtttttaccgtttaaccgttcgtaccgttaacggtccgtaacgggtaacgttaccggacgtaacgggttcccgtaccgggttaccgtccgggtaccccgttacgttacccggggttttaccccggggacggggtaaaccggggtaaacccggtaaagggggtccgggtaaaacgtaacgggttaaccccgttaaaaccgggttacgggtttacggggtacggttacccggttaacgtaccccggtaacttccgtttaacccggttccggtttacctttaccgttacgtttaacccccccg

SEQ ID NO: 291296 - DNA, 501 bp, Homo sapiens
  misc_feature: GYAE6OF01CE1BC.39.46.E02.1.454.CMB.1.raw
  modified_base (471)..(471): a, c, t, g, unknown or other
  misc_feature (471)..(471): n is a, c, g, or t
  modified_base (486)..(486): a, c, t, g, unknown or other
  misc_feature (486)..(486): n is a, c, g, or t
tcagtcgcactagtcacgaccggtgctcgatttagactcatctacagggggaaaggccctgaggaaagcaaaccccagctgggaagcctgagaacacttagccttcatgagtgtcccaccatggcctggatgatgcttctcctcggactccttgcttatggatcaggagtggattctcagactgtggtgacccaggagccctcgttctcagtgtaccctggagggacagtcacactcacttgtggcttgagctctggctcagtctctagtacttactaccccagctggtaccagcacgaccccaggccaggctccacgcacgctcatctacagcacaaacattcgctcctctgggtccctcatcgcttctctgctccattcttgggaacaaagctgccctcaccatccgacgggcccaggcagagatgaatgtagtattattactgtgtgtctgtatagtggtagtggctnttcgcttagttcggnggagggccgagtccg

SEQ ID NO: 291297 - DNA, 520 bp, Homo sapiens
  misc_feature: GYAE6OF01BR673.39.46.E02.1.454.CMB.1.raw
  modified_base (201)..(201): a, c, t, g, unknown or other
  misc_feature (201)..(201): n is a, c, g, or t
  modified_base (444)..(444): a, c, t, g, unknown or other
  misc_feature (444)..(444): n is a, c, g, or t
tcagtcgcactagtcacgaccggtgctcgatttagactcatctacagggggaaaaggccctgaggaaagcaaaccccagctgggaagcctgagaacacttagccttcatgagtgtccccaccatggcctggatgatgcttctcctcggactccttgcttatggatcaggagtggattctcagactgtggtgacccagggcnccctgttctcagtgtaccctggaggacagtcacactcacttgtggcttgagctctggctcagtctctagtacttactacccagctggtaccagcacgacccagccacgcctccacgcacgctcactctacagacaacaaacattcgactcctcgtcgggtccctcatcgcttctctcgctctattcgttagggaactaaagctcgccctacaccatccgacgggcccaggcagagatgatgtntattatacgtgtgtgtctagtagtagtgggttagtggtctagtttcgcgttagtcggagggacggacgtaagtcgg

SEQ ID NO: 291298 - DNA, 521 bp, Homo sapiens
  misc_feature: GYAE6OF01DD4E7.39.46.E02.1.454.CMB.1.raw
  modified_base (502)..(502): a, c, t, g, unknown or other
  misc_feature (502)..(502): n is a, c, g, or t
tcagtcgcactagtcacgaccggtgctcgatttagactcatctacagggggaaaaggccctgaggaaagcaaaccccagctgggaagcctgagaacacttagccttcatgagtgtccccaccatggcctggatgatgcttctcctcggactccttgcttatggatcaggagtggattctcagactgtggtgacccaggagccctcgttctcagtgtaccctggagggacagtcacactcacttgtggcttgagctctggctcagtctctagtacttactaccccagctggtaccagcacgaccccaggccaggctccacgcacgctcatctacagcaacaaacattacgctcctctcggggtccctcactcgtcttctctcggcctcctattctagggaacaaagctgccctcaccatccgacggggcccaggcagaggatgaatgtgattattactgtgtgtctgtatagtgggttagtggctatttcgcttagttcgggngggtacgggcctaaggtcg

SEQ ID NO: 291299 - DNA, 511 bp, Homo sapiens
  misc_feature: GYAE6OF01AYJ2N.39.46.E02.1.454.CMB.1.raw
tcagtcgcactagtcacgaccggtgctcgatttagactcatctacagggggaaaaggccctgaggaaagcaaaccccagctgggaagcctgagaacacttagccttcatgagtgtccccaccatggcctggatgatgcttctcctcggactccttgcttatggatcaggagtggattctcagactgtggtgacccaggagcccctgttctcagtgtaccctggagggacagtcacactcacttgtggcttgagctctggctcagtctctagtacttactaccccagctggtaccagcagaccccaggccaggcctccacgcacgctcatctacagcacaacattcgctcctctcgggtccctcatcgcttctctcgctccattctggaacaagctcgccctcaccatccgacggggcccaggcagagagtcgaatgtagtattattacgtgtgtgcgtgtatagtgggtagtggtctatttcgcttagttcggaggacgggaccaggtccg

SEQ ID NO: 291300 - DNA, 549 bp, Homo sapiens
  misc_feature: GYAE6OF01ANRWG.39.46.E02.1.454.CMB.1.raw
tcagtcgcactagtcacgaccggtgctcgatttagactcatctacagggggaaaaggccctgaggaaagcaaaccccagctgggaagcctgagaacacttagccttcatgagtgtccccaccatggcctggatgatgcttctcctcggactccttgcttatggatcaggagtggattctcagactgtggtgacccaggagcccctcgttctcagtgtaccctggagggacagtcacactcacttgtggcttgagctctggctcagtctctagtacttactaccccagctggtaccagcacgaccccaggccaggcctccacgcacgctcatctacacgcacaaacacttcgctcctcgtcgggtccctcactcgtccttctctgctccattcttacggaacaagctcgccctcaccatccgacggggcccaggcgagacggatgagtgtacgatttatacgtgtagtgcttagtatacggtgggttagttcgggacttacgtttccgtacgttacgttaccggggacggacgggtaccgaaggtacccg

SEQ ID NO: 291301 - DNA, 696 bp, Homo sapiens
  misc_feature: GYAE6OF01DUPFO.39.46.E02.1.454.CMB.1.raw
tcagtcgcactagtcacgaccggtgctcgatttagactcatctacagggggaaaaggccctgaggaaagcaaaccccagctgggaagcctgagaacacttagccttcatgagtgtccccaccatggcctggatgatgcttctcctcggactccttgcttatggatcaggagtggattctcagactggtggtgacccaggacgccctcgttctcagtcgtaccctgggagggacagtcacactcacgttgtggcttgagtctctggctcagtctctagtacttacctacccagtctggtaccagcacgacccaggccacggcctccacgcaccgcctcatcctacagaccaacaaacatttccgccttccgtcgtcggggtccctcgactccgtccttcgttcgtcggtccttccgtagtttcgttacgggaaacctaaacggtccgtcgtacccctaccaacccgtacggtacccgggaaaccgggggccccgaagggaccggaacgggtagggtaacgtaggtaagttcggttagttaactttaacgtttaccgttgttaggttcgtgttacggttaagtttagggttacggggttaggttccgggttacttaaccgggtttttcgaaccgggtttaacgtttacccggggggaccgggggtaaacggggttaaccccgtaagggttacccccgg

SEQ ID NO: 291302 - DNA, 640 bp, Homo sapiens
  misc_feature: GYAE6OF01BSA72.39.46.E02.1.454.CMB.1.raw
  modified_base (257)..(257): a, c, t, g, unknown or other
  misc_feature (257)..(257): n is a, c, g, or t
tcagtcgcactagtcacgaccggtgctcgatttagactcatctacagggggaaaaggccctgaggaaagcaaaccccagctgggaagcctgagaacacttagccttcatgagtgtccccaccatggcctggatgatgcttctcctcggactccttgcttatggatcaggagtggattctcagactggtggtcgacccaggacgccccttcgttctcgagttcgtacccgtgggacgggacagtcacactcacttggnggcttgacgctctggctcagtctctagtacttactacccagctgtaccagcacgacccaggccagcctccacgcacgctcatctacagcaacaaacacttcgctacctcgtcggggtccctcactcgcttctctcggcctcctattcgtaggaacaaacgtctcgcccctacacctacgtcccgtaccgggggacccgtacggaccgacggaacggtacgtacgtaacgtgggttagtaagttttaacgtttacgtagttcggttcggtacgtttacggttaacgtttagggtttaggggtttaggtcgggttccgttagtttccggtacgtttacggttacgggtacggggtaaccgggtaacccggaggttaaccccgggg

SEQ ID NO: 291303 - DNA, 1005 bp, Homo sapiens
  misc_feature: GYAE6OF01AEFMG.39.46.E02.1.454.CMB.1.raw
tcagtcgcactagtcacgaccggtgctcgatttagactcatctacagggggaaaggccctgaggaaagcaaaccccagctgggaagcctgagaacacttagccttcatgagtgtccccaccatggcctggatgatgcttctcctcggactccttgcttatggatcaggagtggattctcagacttggtggtcgacccaggacgtccccttcggttctcaggttcgtacccgtgggacgggacaggtcacacctctacgttggtcggtcttaggacgtccttcgtcggccttaccgtacggttccttccgttaacggtttaacccttttaaccccgtaaccccccgtaacggtacccgttacgggtaacccctaacgggaccctaacccgggtaacccccccgaacggggtcccgtaacggggtccccttaaccccggacccgggtacccaacccggtaccgttccgtaactacccgttaaccgaaccggtaccaaacccgtaaaacctaacccgtttcccggtacccttccccgttccggttacccgggggttcccccttacccggttaccgttcccggttacccgttttcccgttcccggtttaccgggttaccctttacccgtttaccggttttaaccgggtttaacccgggggttaaaacccgtaaaccgttcccggttccccgggtaacccccctttacccgtaaccccgtaaccgggtttaccccggggaaccccggggggttaaccccgaaccggggtaaccggtaacggtaaacggggtacgttaaacgggttaacggtttacgggtaacggtttaacgtttacggttttaacccgttaggggttaccggttaccggttactttacgggttaacgtttaacggggttggggttaaccgggtttcggttccggtttaccggtttttaccggttaccggtttacgggtttacccgggggtaccggggtaaccgggtaaccggttaccgggttaacccggg

SEQ ID NO: 291304 - DNA, 761 bp, Homo sapiens
  misc_feature: GYAE6OF01DC0U1.39.46.E02.1.454.CMB.1.raw
  modified_base (107)..(107): a, c, t, g, unknown or other
  misc_feature (107)..(107): n is a, c, g, or t
  modified_base (162)..(162): a, c, t, g, unknown or other
  misc_feature (162)..(162): n is a, c, g, or t
  modified_base (241)..(241): a, c, t, g, unknown or other
  misc_feature (241)..(241): n is a, c, g, or t
  modified_base (262)..(262): a, c, t, g, unknown or other
  misc_feature (262)..(262): n is a, c, g, or t
tcagtcgcactagtcacgaccggtgctcgatttagactcatctacagggggaaaaggccctgaggaaagcaaaccccagctgggaagcctgagaacacttagccttnatgagtcgtccccaccatggcctggatgatgcttctcctcggactccttgcttanggatcgaggagtgattctcgagtactggtggtcgacccgagggaccgtcccctggtttacctcgaaggtcgtaccccgnggggacgggtacagtccaacnctcctagttggtgtcttggacgtcctcgtaggctcgtacgtcttcgttacgttaccttacccgtacccgtacgtcgttaccggtaaccacgaccgaacccgacccggacgacccgacggtccctaccgccgacacccgcctacaccttcaacgtaccacaaacaacctacgttccgtaccttcccgtacggtcccgggttaccctcgtaccttccccggttcttcccgtttcgttaccggtacccttccggttaactttaccggttaacgggaacctaaacgtcccgtcccgtacccctaccgtacccgttaaccggacccgggtaccccggggaccgaacgggacgaacggtaacggtaacgtagtaacggttacgttaagttacttacgtttagtcgttaggtactcgtaagttacgtaagggtttcggtaagggttctacggtttacgttcgttagttacgggacggtccggggtaacggtacgcggttacccggg

SEQ ID NO: 291305 - DNA, 720 bp, Homo sapiens
  misc_feature: GYAE6OF01BXEZ4.39.46.E02.1.454.CMB.1.raw
tcagtcgcactagtcacgaccggtgctcgatttagactcatctacagggggaaaaggccctgaggaaagcaaaccccagctgggaagcctgagaacacttagccttcatgagtgtccccaccatggcctggatgatgcttctcctcggactccttgcttatggatcgaggagtggattctcagactgtggtcgacccgaggactccccttgttctcgagttcgtacccgtgggacggacagtcacacctcacttggtgcttgacgtctcgtggctctagtctactagtaccttacctaccccagtctacggtaccacgaccaccgacccccgaggacccgacggtccctacccgaccgccgtaccgtcctaccgaacttccgtaacacgaccaaaccaaacgtacttaccggaccttacccgtcggttccgggttacccctcgtaacgtcccgttacctttccgttccgttcggtcccttacccgttagtttaccgttaacgggaaacctaacggtcctaccgcccctacgtacccgacgtcccgggaccggggacccgaggacccgaaggtacggtaagtacgtagttacggtagttaactttacgttaacgtggttagtagttacgttgtaacgtttagggtcgggttacgtacgggttacttacggtttaccgtacggttacggtaccgggtacgggacggtaacgcgttaacccgg

SEQ ID NO: 291306 - DNA, 707 bp, Homo sapiens
  misc_feature: GYAE6OF01BP2IP.39.46.E02.1.454.CMB.1.raw
  modified_base (185)..(185): a, c, t, g, unknown or other
  misc_feature (185)..(185): n is a, c, g, or t
tcagtcgcactagtcacgaccggtgctcgatttagactcatctacagggggaaaaggccctgaggaaagcaaaccccagctggggaagcctgagaacacttagccttcatgagtgtccccaccatggcctggatgatgcttctccgtcggacttccttgcttatggatcgaggagtggattctanagtactggtggtcgacccgaggaccgtccccttcgttcctcgagttcgtacccgtgggaacgggctagtcaccgacttctacgtttggtggtcttagacgctcgtggtctcgacgttcttactacgttacctttaaccctaccctacgtcgttacggtaccacgtccaccgaccccgagggccacggccctccgacgaccgacgcctacactacctacacgacaaacaaactactccgccttcctccggtcgggtccctacacgttcgtccttcgtcgtcgtcctaccttacgttcgtacgggaaactacgtctccgacccctacgaccctacggtaccggacccggggacccgtaggcgaaggacggacttacgggaacttggttaacttaacgtttaacttacggttgttcggtaccgtagttacggttaaacgtttgggtacgggttaggtacgttcggttagttttccggtcgttaagggttaccggggaccggtaacggacccgtagggttacccgg

SEQ ID NO: 291307 - DNA, 512 bp, Homo sapiens
  misc_feature: GYAE6OF02IFXH1.39.46.E02.1.454.CMB.1.raw
tcagtcgcactagtcacgaccggtgctcgatttagactcatctacagggggaaaaggccctgaggaaagcaaaccccagctgggaagcctgagaacacttagccttcatgagtgtccccaccatggcctggatgatgcttctcctcggactccttgcttatggatcaggagtggattctcagactgtggtgacccaggagccctcgttctcagtgtaccctggaggacagtcacactcacttgtggcttgagctctggctcagtctctagtacttactacccagctggtaccagcagaccccaggccaggctccacgcacgctcatctacagcacaaacattcgctcctctggggtccctcatcgcttctctggctccattcttagggaacaaagctgccctcaccatcacggggcccaggccagaggatgaatgtagagttattaactgtgtgctgtatagtgggtaagtggctatttcgcttaagtttcggcgggagggacccaagtccg

SEQ ID NO: 291308 - DNA, 506 bp, Homo sapiens
  misc_feature: GYAE6OF02IYXPR.39.46.E02.1.454.CMB.1.raw
tcagtcgcactagtcacgaccggtgctcgatttagactcatctacagggggaaaaggccctgaggaaagcaaaccccagctgggaagcctgagaacacttagccttcatgagtgtccccaccatggcctggatgatgcttctcctcggactccttgcttatggatcaggagtggattctcagactgtggtgacccaggagccctcgttctcagtgtaccctggagggacagtcacactcacttgtggcttgagctctggctcagtctctagtacttactacccccagctggtaccagcagaccccaggccaggctccacgcacgctcatctacagcacaaacattcgctcctctggggtccctcactcgcttctctgctccattcttgggacaaagctgccctcaccatcgacggggcccaggcagaggatgaatgtgattattactgtgtgctgtatagtgggtagtggctagtttcgcttagttcggacggagggaccagtccg

SEQ ID NO: 291309 - DNA, 525 bp, Homo sapiens
  misc_feature: GYAE6OF02ISLDH.39.46.E02.1.454.CMB.1.raw
  modified_base (215)..(215): a, c, t, g, unknown or other
  misc_feature (215)..(215): n is a, c, g, or t
  modified_base (246)..(246): a, c, t, g, unknown or other
  misc_feature (246)..(246): n is a, c, g, or t
  modified_base (344)..(344): a, c, t, g, unknown or other
  misc_feature (344)..(344): n is a, c, g, or t
tcagtcgcactagtcacgaccggtgctcgatttagactcatctacagggggaaaaggccctgaggaaagcaaaccccagctgggaagcctgagaacacttagccttcatgagtgtccccaccatggcctggatgatgcttctcctcggactccttgcttatggatcaggagtggattctcagactgtggtgacccaggagccctcgttctcagtntaccctgggagggacagtcacactcacttgnggcttgagctctggctcagtctctagtacttactaccccagctggtaccagcagaccccaggccaggactcacgcacgctcatctacagcaacaaacnttacgctcctctcgggtccctcactcgcttctctggctcgattactgggaacaaagctcgcctcaccatccgacggggcccaggctagagatgaactcgtagaattacttaacgtgtgtgacctgtatacgtgggtacgtggctactttggcttagtcggacggacgggtaccaggtaccg

SEQ ID NO: 291310 - DNA, 544 bp, Homo sapiens
  misc_feature: GYAE6OF02GIA3C.39.46.E02.1.454.CMB.1.raw
tcagtcgcactagtcacgaccggtgctcgatttagactcatctacagggggaaaaggccctgaggaaagcaaaccccagctgggaagcctgagaacacttagccttcatgagtgtccccaccatggcctggatgatgcttctcctcggactccttgcttatggatcaggagtggattctcagactgtggtgacccaggagccctcgttctcagtgtaccctggagggacagtcacactcacttgtggcttgagctctggctcagtctctagtacttactaccccagctggtaccagcagaccccaggccaggcctccacgcacgctcatctacagcacaaacacttcgctcctctcggggtccctcatcgctttctctggctcctattcgttgggaacaagctcgccctcaccactcgaccggggcccagggccaggacgatagaagtgtagtattattacgtgtgtgtgttgtagtagttcgggtaaggttggtcgttagtttcgtcgttacgttcgggaccgggaacgggtaccgagtccgg

SEQ ID NO: 291311 - DNA, 656 bp, Homo sapiens
  misc_feature: GYAE6OF02HGILP.39.46.E02.1.454.CMB.1.raw
tcagtcgcactagtcacgaccggtgctcgatttagactcatctacagggggaaaaggccctgaggaaagcaaaccccagctgggaagcctgagaacacttagccttcatgagtgtccccaccatggcctggatgatgcttctcctcggactccttgcttatggatcaggagtggattctcagactggtggtgacccaggacgcccttcgttctcagtcgtaccctgggagggacagtcacactcacttggtgcttgagctctggctcagtctctagtacttactaccccagctgtaccagcacgaccccaggccacggctccgacgcacgctcgactctacagcaacaaacattccgcttacctcgttcggggtcccctcgtactcgtcctttcttcgtcgtccttacctacgtttcgttacgggaaacctaaacgtccgttacgacccctaccaacccgttacgtaccggaacccgggggtacccacgggtaccgaaggaacgggtaactaggtaacgtggttacgtaagtttacgttacgtagttaggttcgttacgttagttaacgtttaggttacggggtagttacgggtacttaacggtttccgtagttaccggttcggggaaccgggtacgggtaaccgaggttacccgg

SEQ ID NO: 291312 - DNA, 663 bp, Homo sapiens
  misc_feature: GYAE6OF02HS2NY.39.46.E02.1.454.CMB.1.raw
  modified_base (257)..(257): a, c, t, g, unknown or other
  misc_feature (257)..(257): n is a, c, g, or t
  modified_base (362)..(362): a, c, t, g, unknown or other
  misc_feature (362)..(362): n is a, c, g, or t
  modified_base (367)..(367): a, c, t, g, unknown or other
  misc_feature (367)..(367): n is a, c, g, or t
tcagtcgcactagtcacgaccggtgctcgatttagactcatctacagggggaaaaggccctgaggaaagcaaaccccagctgggaagcctgagaacacttagccttcatgagtgtccccaccatggcctggatgatgcttctcctcggactccttgcttatggatcaggagtggattctacagactggtggtcgacccgaggacgccccttcgttctcgagttcgtacccgtgggacgggacagtcacactcattgngcttgagctcgtggctcagtctctagtacttacctaccccagtcgtacgtaccagcacgaccccaggccaggcctccaccgcacgctcatctacacgacacaaancttcnccttctccggtcgggttccctactacgtccgtacctttcgtccgtcgtacccttccgtacttttcggttaacgggaacgtaaacgtccctaccggccccttacgaccctacgtccggaccggggcccacggaccgagggtaacgacgtacgtacgtagttagtactttacgttacgtacggttagttcgacgtttcgttaacgttaggttacggggttaggtcggtaccgttaggtttacccgtacggtttaccggttaccggggtacgggaacgggttaccgacggttacccggg

SEQ ID NO: 291313 - DNA, 667 bp, Homo sapiens
  misc_feature: GYAE6OF02GCHLR.39.46.E02.1.454.CMB.1.raw
  modified_base (252)..(252): a, c, t, g, unknown or other
  misc_feature (252)..(252): n is a, c, g, or t
  modified_base (337)..(337): a, c, t, g, unknown or other
  misc_feature (337)..(337): n is a, c, g, or t
  modified_base (370)..(370): a, c, t, g, unknown or other
  misc_feature (370)..(370): n is a, c, g, or t
tcagtcgcactagtcacgaccggtgctcgatttagactcatctacagggggaaaaggccctgaggaaagcaaaccccagctgggaagcctgagaacacttagccttcatgagtgtccccaccatggcctggatgatgcttctcctcggactccttgcttatggatcaggagtggattctcagactgtggtgacccaggacgccctcgttctcgtagtcgtacccgtgggacgggacagtcacactcacttgngcttgacgctctggctcagtctctagtaccttacctacccagtctcggtaccacgcacgaccccgacggccaggcctccacgccnccgctacacgtactacagacaacaaactactcnccttacctcgtccggggtccctacgtacttccgtacctttcttaccgtcgtcctaccttcgtttccgttaacgggtaaacctaacggtcgttaccgacccctaccgacctacgccggtacccgggggacccgacggacgacgggacgtacgtacggtacgttcggtacgttaatttaacgtttacgtggttgttccgtagtttacgttaagttacgggttacgggttaggttacggtacttacgtttacgttcgttacggttccgggtacgggacggtaccggtaacgttaaccggg

SEQ ID NO: 291314 - DNA, 489 bp, Homo sapiens
  misc_feature: GYAE6OF01EWK47.35.8.A08.1.454.CMB.1.raw
  modified_base (470)..(470): a, c, t, g, unknown or other
  misc_feature (470)..(470): n is a, c, g, or t
  modified_base (481)..(481): a, c, t, g, unknown or other
  misc_feature (481)..(481): n is a, c, g, or t
tcagtacagatcgtcacgaccggtgctcgatttagcatactctacagggggagtcagtctcagtcaggacacagcatggacatgagggtccccgctcagctcctggggctcctgctactctggctccgaggtgccagatgtgacattcagatgacccagtctccatcctccctgtctgcatctgtaggagacagagtcaccgtcacttgccgggcaagtcagagcattaacaagaatttaaattggtatcagcagaaacctgggaaagtccctaggctcctcatctatgctgcttccactttgcaagatgggtcccatcaaggttcagagcactggatctgggacagaattcgctctcaccatcagcagtctgcaacctgaagtattttgctaacttactactgtacaacagagttacagtggtcttcactttcggcggagggaccaagggtggacatcaaacgaactgnggctgacaccntcgttacg

SEQ ID NO: 291315 - DNA, 486 bp, Homo sapiens
  misc_feature: GYAE6OF01BXQHT.35.8.A08.1.454.CMB.1.raw
tcagtacagatcgtcacgaccggtgctcgatttagcatactctacagggggagtcagtctcagtcaggacacagcatggacatgagggtccccgctcagctcctggggctcctgctactctggctccgaggtgccagatgtgacattcagatgacccagtctccatcctccctgtctgcatctgtaggagacagagtcaccgtcacttgccgggcaagtcagagcattaacaagaatttaaatggtatcagcagaaacctgggaaagtccctaggctcctcatctatgctgcttccactttgcaagatggggtcccatcaaggttcagtaggcactggatcgtgggacagaattcgctctcaccatcagcagtctgcaacctgaagtattttgctaactttactactgtacaacagtagttacagttgcttcatttcggcggaggaccaaggtggactatcaaacgatgtagctgacacatctacg

SEQ ID NO: 291316 - DNA, 485 bp, Homo sapiens
  misc_feature: GYAE6OF01ERF1J.35.8.A08.1.454.CMB.1.raw
  modified_base (204)..(204): a, c, t, g, unknown or other
  misc_feature (204)..(204): n is a, c, g, or t
  modified_base (480)..(480): a, c, t, g, unknown or other
  misc_feature (480)..(480): n is a, c, g, or t
tcagtacagatcgtcacgaccggtgctcgatttagcatactctacagggggagtcagtctcagtcaggacacagcatggacatgagggtccccgctcagctcctggggctcctgctactctggctccgaggtgccagatgtgacattcagatgacccagtctccatcctccctgtctgcatctgtaggagacagagtcaccgtnacttgccgggcaagtcagagcattaacaagaatttaaattggtatcagcagaaacctgggaaagtccctaggctctcatctatgctgcttccactttgcaagatggggtcccatcaaggttcagtaggcactggatctgggacagattcgctctcaccatcagcagtctgcaacctgaagtatttgctaacttactactgtacaacagtacgttacagtgtcttcacgtttggcggaggacgaaggtggacatacgaaacgactgacgctgacacntctcg

SEQ ID NO: 291317 - DNA, 544 bp, Homo sapiens
  misc_feature: GYAE6OF01D7HYM.35.8.A08.1.454.CMB.1.raw
tcagtacagatcgtcacgaccggtgctcgatttagcatactctacagggggagtcagtctcagtcaggacacagcatggacatgagggtccccgctcagctcctggggctcctgctactctggctccgaggtgccagatgtgacattcagatgacccagtctccatcctccctgtctgcatctgtaggagacagagtcaccgtcacttgccgggcaagtcagagcattaacaagaatttaaattggtatcagcagaaacctggaaagtccctaggctcctcatctatgctgcttccactttgcaagatggggtcccatcaaggttcagaggcactggatctgggacagaattcgctctcaccatcagcagtctgcaacctgaagtattttgactaactttactacttacgtacaaactaagtacgttaacaggttaaccgccccgacgactccacggtcttccgggaccgtaaggggacctaacggaacgtgggaaacgtaagttaaaaaacggtacttaggtaggaccgtgtccgtaaacccg

SEQ ID NO: 291318 - DNA, 593 bp, Homo sapiens
  misc_feature: GYAE6OF01BVJYJ.35.8.A08.1.454.CMB.1.raw
tcagtacagatcgtcacgaccggtgctcgatttagcatactctacagggggagtcagtctcagtcaggacacagcatggacatgagggtccccgctcagctccgtggggctcctgctactctggctccgaggtgccagatgtgacattcagatgacccagtctccatccctccctgtctgcatctgtaggagaaagcgtcaccatcacttgccggacagtcagagtattagtaattggttgctggtatcagcaagaaaccgagggaaacgacccctaaactcctagattcgtttaaggcgttcttaactttaggagtaggtcggggtacccagttacgaaggttcaaggcggcgaggtggatcgtagggacagtacttcgactctcaccatcaccagcctgcacgctgactgtattttcgactaaccgttattacgtcgacctaacgtagttagtggtactacgtttcccgtacttaccgtttccgggtacccgtgggtaacctaaggtgtaacttaactaaccgtaaacggtacttgggtacggtcctggaccctaacgtacttcttcgttccttaccgtcgtttacccccg

SEQ ID NO: 291319 - DNA, 511 bp, Homo sapiens
  misc_feature: GYAE6OF01BNHAT.35.8.A08.1.454.CMB.1.raw
  modified_base (376)..(376): a, c, t, g, unknown or other
  misc_feature (376)..(376): n is a, c, g, or t
tcagtacagatcgtcacgaccggtgctcgatttagcatactctacagggggagtcagtctcagtcaggacacagcatggacatgagggtccccgctcagctcctggggctcctgctactctggctccgaggtgccagatgtgacattcagatgacccagtctccatcctccctgtctgcatctgtaggagacagagtcaccgtcacttgccgggcaagtcagagcaattaacaagaatttaaattggtatcagcagaaacctggaaagtccctaggctcctcatctatgctgcttccactttgctaagatggggtcccatcaaggttcagaggcactggatcgtgggacagaattcgctctcaccatcagcagtcngcaacctgaagtattttgactaacttactactgtacaacagtagttacagtggtacttctactttcgggacggtagggacctaaagggtggaactagtacgaaacgaacgtaggtggctgacacctatcgttacg

SEQ ID NO: 291320 - DNA, 495 bp, Homo sapiens
  misc_feature: GYAE6OF01AIIQP.35.8.A08.1.454.CMB.1.raw
  modified_base (356)..(356): a, c, t, g, unknown or other
  misc_feature (356)..(356): n is a, c, g, or t
  modified_base (360)..(360): a, c, t, g, unknown or other
  misc_feature (360)..(360): n is a, c, g, or t
  modified_base (489)..(489): a, c, t, g, unknown or other
  misc_feature (489)..(489): n is a, c, g, or t
tcagtacagatcgtcacgaccggtgctcgatttagcatactctacagggggagtcagtctcagtcaggacacagcatggacatgagggtccccgctcagctcctggggctcctgctactctggctccgaggtgccagatgtgacattcagatgacccagtctccatcctccctgtctgcatctgtaggagacagagtcaccgtcacttgccgggcaagtcagagcattaacaagaatttaaattggtatcagcagaaacctgggaaagtccctaggctcctcatctatgctgcttccatttgcaagatgggtcccatcaaggttcagaggcactggatcgtgggacagatcgctcncacntcagcagtctgcaacctgaagtatttgactaactttactactgtacaacagtagttacagttggctttcgacgtttcggcggagggtaccaagggtcggacatacgaaacgactgtacggctgaccacntcgtcg

SEQ ID NO: 291321 - DNA, 586 bp, Homo sapiens
  misc_feature: GYAE6OF01E5FRC.35.8.A08.1.454.CMB.1.raw
  modified_base (390)..(390): a, c, t, g, unknown or other
  misc_feature (390)..(390): n is a, c, g, or t
tcagtacagatcgtcacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagcgtcaccatcacttgccgggcaagtcagagcattggctagttctttaaattggtatcaaacggaaaccagggaaacgcccctaaaactcctgatctatgctgctatcctattttgactaaaggtcggggtacccggcgtaacggttcaaggtggcaggtggatcgtagggacagtaagttcactctacaccatcancagtctacgcaactgtaagtatttagacctaaccttacttattacgtacaaccgtaagtacgttaaccgaacggttacccggccgtaccgtatccgtaacgtccgttaccggaccgaaagggacccgaggtactaagggaagtaaacgttaaaacggaacgttgggtacgtctaggaccctaaccgtactttaccg

SEQ ID NO: 291322 - DNA, 849 bp, Homo sapiens
  misc_feature: GYAE6OF01DOVOU.35.8.A08.1.454.CMB.1.raw
  modified_base (217)..(217): a, c, t, g, unknown or other
  misc_feature (217)..(217): n is a, c, g, or t
tcagtacagatcgtcacgaccggtgctcgatttagcatactctacagggggagtcagtatcagtcaggacacagcatggacatgagggtccccgctcagctcctggggctcctgctactctggctccgaggtgccagatgtgacattcagatgacccagtctccatccctccctgtctgcatctgtaggagacagagtcaccgtcacttggccgggnaagtcagagcattaacaagtaatttaaattggtatcagacaagaaaccgtagggaacgtcccgtaggtcctcctacattctatcgtctcgtcctttacctactttgacgtaagtacggttccggggtaccctaagttaccggtaaacgggtttccgaaagggtaacggtaccgtaaccggttagggtaaccgttacgggttaacggggaaaccgtaaacggttaaacgttttcccggtaccctttcccgttaaccctaaccccgtaagttaccccgaacgggtacccgtaacggtttcccgtaaccggtaacccgtaaaacccggtttaggtaaacggtttacgttttttaaccggtaaccctttaaaacccgtttttaacccttaaccgtttaaccggttaaccgtaaaaccgttaaggttaaaccggtttaacggtaacgggttacgggtttacccgttttacccggttaccgggttttaccgggggaaccggggtaaccggggtaaacccggtaaagggggttaccggaaaaccgtaacggtttaaacccggaaaaccgggttaaccggttcgggttaaccgggtaccgttaccggaaccctaacccgttacgtttcccggtttaccgg

SEQ ID NO: 291323 - DNA, 530 bp, Homo sapiens
  misc_feature: GYAE6OF01BNVB5.35.8.A08.1.454.CMB.1.raw
  modified_base (190)..(190): a, c, t, g, unknown or other
  misc_feature (190)..(190): n is a, c, g, or t
  modified_base (215)..(215): a, c, t, g, unknown or other
  misc_feature (215)..(215): n is a, c, g, or t
tcagtacagatcgtcacgaccggtgctcgatttagcatactctacagggggagtcagtctcagtcaggacacagcatggacatgagggtccccgctcagctcctggggctcctgctactctggctccgaggtgccagatgtgacattcagatgacccagtctccatcctccctgtctgcatctgtagganacagagtcaccgtcacttgccgggnaagtcagagcaattaacaagaatttaaattggtatcagcagaaacctaggaacgtcctaggctcctcatctatgctgcttccactttgactaagatcgggtcccagtcaaggttcagacggcacgtggatcgtagggacagtaattcgctctcacctatcagcagtctgacaaccgtgtaacgttatttacgactaacttactactgtacaacgtagtagttacgtagtcgtacttcgtacgttacggacggtacggacgaaggtcgtacgtataacgaacgtacgtaggtacggtctacgactactagtgtacg

SEQ ID NO: 291324 - DNA, 509 bp, Homo sapiens
  misc_feature: GYAE6OF01E3PBK.35.8.A08.1.454.CMB.1.raw
tcagtacagatcgtcacgaccggtgctcgatttagcatactctacagggggagtcagtctcagtcaggacacagcatggacatgagggtccccgctcagctcctggggctcctgctactctggctccgaggtgccagatgtgacattcagatgacccagtctccatcctccctgtctgcatctgtaggagacagagtcaccgtcacttgccgggcaagtcagagcattaacaagaatttaaattggtatcagcagaaacctgggaaagtccctaggctcctcatctatgctgcttccactttgcaagatggggtcccatcaaggttcagaggcactggatcgtggacagaattcgctctcaccatcagcagtctgcaacctgaatattttgactaacgttactactgtacaacgagagttactagtggtcttcacgtttcggcggagggtaccaagggtcggaactatacgaaacgaactggtacgtctcggaccaccgtatcgttacg

SEQ ID NO: 291325 - DNA, 829 bp, Homo sapiens
  misc_feature: GYAE6OF01DY74J.35.8.A08.1.454.CMB.1.raw
  modified_base (192)..(192): a, c, t, g, unknown or other
  misc_feature (192)..(192): n is a, c, g, or t
tcagtacagatcgtcacgaccggtgctcgatttagcatactctacagggggagtcagtctcagtcaggacacagcatggacatgagggtccccgctcagctcctggggctcctgctactctggctccgaggtgccagatgtgactattcagatgacccagtcctccatccctccctgtctgcatctgagganacagagtcaccgtcacgttcggccgggacaagtcagagactaattaaacaaagtaaatttaaagttggtaatcaagacaacgaaaccgtaggaaacgtcccgtaggcctacctcacttctatcgtctcgtccttcctactttgactaagtagtcgggtaccacgtacgtaaggttacgaaggacggtacacgtcggtaactcggtacgggaacgtaacggtaacttccgtaccttacctaccgaaccctacgttaccgacggtacctaacgtccgtaccggaaccttaaacccgttagggtaaacgttttaacgtttttaccggaaccctttaaaccgttttaaccgttaaccgtttacgttaaaccgtaaaaccgtttaaacggttaaaccggttttaaccgtaacggtttaccgggtttaccccttttaacccgggttaaccggttttaccggggggaaacccggggttaaaccgggggtaaaaccccggttaaaaggggggttaacccgggttaaaaacccggttaaaaacggttaaaaaacccgggttaacgggttaaccgggttaccggaccggttaccggtaaccccgtaaacccgtttaaccggtttcccggtttcggttttaacccccg

SEQ ID NO: 291326 - DNA, 512 bp, Homo sapiens
  misc_feature: GYAE6OF01BKETZ.35.8.A08.1.454.CMB.1.raw
tcagtacagatcgtcacgaccggtgctcgatttagcatactctacagggggagtcagtctcagtcaggacacagcatggacatgagggtccccgctcagctcctggggctcctgctactctggctccgaggtgccagatgtgacattcagatgacccagtctccatcctccctgtctgcatctgtaggagacagagtcaccgtcacttgccgggcaagtcagagcattaacaagaatttaaattggtatcagcagaaacctgggaaagtccctaggctcctcatctatgctgcttccactttgcaagatgggtcccatcaagttcagaggcacgtggatcgtggacagaatcgctctcacatcagcagtctgcaactgtaagtatttgactaactttactactgtacaacagtacgttacagttggtcttacgtacgtttcgggcggaagggtaccgaagggtcggactagtacgaaacggacgtggtacggactagaccactatcgttacg

SEQ ID NO: 291327 - DNA, 535 bp, Homo sapiens
  misc_feature: GYAE6OF01A4AXR.35.8.A08.1.454.CMB.1.raw
  modified_base (190)..(190): a, c, t, g, unknown or other
  misc_feature (190)..(190): n is a, c, g, or t
  modified_base (204)..(204): a, c, t, g, unknown or other
  misc_feature (204)..(204): n is a, c, g, or t
tcagtacagatcgtcacgaccggtgctcgatttagcatactctacagggggagtcagtctcagtcaggacacagcatggacatgagggtccccgctcagctcctggggctcctgctactctggctccgaggtgccagatgtgacattcagatgacccagtctccatcctccctgtctgcatctgtagganacagagtcaccgtnacttgccgggcaagtcagagcattaacaagaatttaaattggtatcagcagaaacctgggaaagtccctaggctcctcatctatgctgcttcactttgcaagatcgggtccatcaaggttcagaggcacgtggatcgtgggacagaattcgctctcaccatcagcagtctgccaaccgtgaagtattttcgactaacttactactgtacaactagtacgttacgtagttacggtctttacgtacgtttccgggacggtaggggtacccaagggtacggaactagtacgtaaaaccgacgttagtcggtactcggacctaccagttccttcg

SEQ ID NO: 291328 - DNA, 487 bp, Homo sapiens
  misc_feature: GYAE6OF01ATH6S.35.8.A08.1.454.CMB.1.raw
  modified_base (480)..(480): a, c, t, g, unknown or other
  misc_feature (480)..(480): n is a, c, g, or t
tcagtacagatcgtcacgaccggtgctcgatttagcatactctacagggggagtcagtctcagtcaggacacagcatggacatgagggtccccgctcagctcctggggctcctgctactctggctccgaggtgccagatgtgacattcagatgacccagtctccatcctccctgtctgcatctgtaggagacagagtcaccgtcacttgccgggcaagtcagagcattaacaagaatttaaattggtatcagcagaaacctgggaaagtccctaggctcctcatctatgctgcttccactttgcaagatggggtcccatcaaggttcagaggcactggatctgggacagaattcgctctcaccatcagcagtctgcaacctgaagtatttgactaacttactactgtacaacagtagttacagtgcttcacgtttcggcggaggaccaaggtcgacatacaaacgactgtgctgacaccntcgtacg

SEQ ID NO: 291329 - DNA, 500 bp, Homo sapiens
  misc_feature: GYAE6OF01COYPN.35.8.A08.1.454.CMB.1.raw
  modified_base (377)..(377): a, c, t, g, unknown or other
  misc_feature (377)..(377): n is a, c, g, or t
  modified_base (425)..(425): a, c, t, g, unknown or other
  misc_feature (425)..(425): n is a, c, g, or t
  modified_base (492)..(492): a, c, t, g, unknown or other
  misc_feature (492)..(492): n is a, c, g, or t
tcagtacagatcgtcacgaccggtgctcgatttagcatactctacagggggagtcagtctcagtcaggacacagcatggacatgagggtccccgctcagctcctggggctcctgctactctggctccgaggtgccagatgtgacattcagatgacccagtctccatcctccctgtctgcatctgtaggagacagagtcaccgtcacttgccgggcaagtcagagcattaacaagaatttaaattggtatcagcagaaacctgggaaacgtcctaggctcctcatctatgctgcttccactttgacaagagtcgggtccatcgaaggttcagaggcactggatcgtgggacagaattcgctctcacatcagcagtctnaccactgaagtatttcgactaactttactactgtacaacagtattacngttcgcttctacgttcggacggtaggaccgaagggtcgacagtacaaacgactgcgtctagacaccnttcgtacg

SEQ ID NO: 291330 - DNA, 517 bp, Homo sapiens
  misc_feature: GYAE6OF01AJND7.35.8.A08.1.454.CMB.1.raw
tcagtacagatcgtcacgaccggtgctcgatttagcatactctacagggggagtcagtctcagtcaggacacagcatggacatgagggtccccgctcagctcctggggctcctgctactctggctccgaggtgccagatgtgacattcagatgacccagtctccatcctccctgtctgcatctgtaggagacagagtcaccgtcacttgccgggcaagtcagagcattaacaagaatttaaattggtatcagcagaaacctgggaaagtccctaggctcctcatctatgctgcttccactttgcaagatgggtcccatacaaggttcagaggcacgtggatctgggacagtaattcgctctcaccatcagcagtctgcaacctgaatatttgactaacttactactgtacaactagtagttacagttgtcttacgtacgtttcgggcggagggtaccaagggtcggaactaagtacgaaacggtaactggtacggcttcggacacctagtccgttcg

SEQ ID NO: 291331 - DNA, 659 bp, Homo sapiens
  misc_feature: GYAE6OF01CQO3J.35.8.A08.1.454.CMB.1.raw
  modified_base (95)..(95): a, c, t, g, unknown or other
  misc_feature (95)..(95): n is a, c, g, or t
  modified_base (225)..(225): a, c, t, g, unknown or other
  misc_feature (225)..(225): n is a, c, g, or t
tcagtacagatcgtcacgaccggtgctcgatttagcatactctacagggggagtcagtctcagtcaggacacagcatggacatgagggtccccgntcagctccgtggggctcctgctactctggctccggaggtgccagatgtgacattcagatcgacccagtcctccatccctccctgtctgctatcgtagtaggagacagagtccaccgtcacgttgccgggnaagtcagagctaattaacaagtaatttaattggatacagacaagaaaccgtgggaaactccaggcctctcatctatgctgtcttccatttgactaagtcgtcgggtaccagtacgtaaggtcaaggacgacaacgtggtactcgtagggaactaagtacttcgcttacaccgactatcgagtcaagttcagtaacctaagtacgtaagtttacttacggaccttaaacgttaccttaacgtacgtaacgtaaacgtaaggttaacggttaaccgtaggtttaccgggtaccttttaacccggttacgggtttacccggggaacgggaaccggggtaaaccgttaaggggtaaccgaaaccttaacggtaaacggaaaacccggttggtacggtaccgggaccttaacgaccctaaccgttgttccgtttaaccg

SEQ ID NO: 291332 - DNA, 645 bp, Homo sapiens
  misc_feature: GYAE6OF01BBU36.35.8.A08.1.454.CMB.1.raw
tcagtacagatcgtcacgaccggtgctcgatttagcatactctacagggggagtcagtctcagtcaggacacagcatggacatgagggtccccgctcagctcctggggctcctgctactctggctccgaggtgccagatgtgacattcagatgacccagtctccatcctccctgtctgcatctgtaggagacagagtcaccgtcacttgccgggcaagtcagagcattaacaagaatttaaatggtatcagcagaaacctgggaaagtcctaggctcctcatctatgctgcttccacttttgactaagagtcgggtccatcaaggttcaggtagcacgtggatcgtaggacaagtaattcgactcgtcacctatcagcagtctacgcaaccgtgaacggtattttaggacctaaacctttactaacttcgtaactaaacgtacggtaacgtttaacgtacggttacggtacctttaaccgtaccggttttacggggacccgggtaaaggggtaaccccgttaaaggggttaacgggtaaacctaacggttaacccgtaaaaaacccgggtaaccgttacgggttaaccggggtaccttacggtaaaccccgttaaccgtaaaccgtttccgttttaaaccccggg

SEQ ID NO: 291333 - DNA, 573 bp, Homo sapiens
  misc_feature: GYAE6OF01B16C3.35.8.A08.1.454.CMB.1.raw
tcagtacagatcgtcacgaccggtgctcgatttagcatactctacagggggagtcagtctcagtcaggacacagcatggacatgagggtccccgctcagctcctggggctcctgctactctggctccgaggtgccagatgtgacattcagatgacccagtctccatccctccctgtctgcatctgtaggagacagagtcactattacttggtcggccagtgagagtataagtgttggttggctggtatcagcaagaaccagggaaacgccctagactcctgatgtatagggcgtctgtactaacaaaagtcggggtacccacgtaaggttcaggcggcaggtggactgtagggacagaacttcactctacacatcagtcgcctgactacgcctgtactgtactttgactaaccttattacgtacgtaccaactacttaacagtaccttactttactttcttaccgtttcgggcggtaacgggtaccgtaagggtcggaactagtacgaacggaacgtaacgttcgggtacggtacgtacggaccctaccgtaattccgttgttccgtttaccg

SEQ ID NO: 291334 - DNA, 616 bp, Homo sapiens
  misc_feature: GYAE6OF01CATE9.35.8.A08.1.454.CMB.1.raw
  modified_base (221)..(221): a, c, t, g, unknown or other
  misc_feature (221)..(221): n is a, c, g, or t
tcagtacagatcgtcacgaccggtgctcgatttagcatactctacagggggagtcagtctcagtcaggacacagcatggacatgagggtccccgctcagctccgtggggctcctgctactctggctccgaggtgccagatgtgacattcagatgacccagtcctccatcctccctgtctgcatctgtaggagacagagtcaccgtcacgttcggccggganaagtcgagacgctaattaaacaaagtaattttaaagttggtaatacagacgaagtaaaccgtagggtaaacgtccgtaggtcctccgtacacttctatgcttcgtcttcctactttgactaaggcgtcgggtacccagtacgtaaggttcaaggtcgacgagttggatcgtagggacgtaacgtaagtccgtacctacgtaccaaccgtactcgtaacggctaagtcctacgacctaaacgtagtaacgttactttacgaaccttaacttacttacgtacgtaacaacgtaagtacgtactacggttcgtacttaccgtacggtccgggaacggacggtacgaagggtacgacgtataacgacgtacgtacggtcgactgaccactgtcgttacg

SEQ ID NO: 291335 - DNA, 565 bp, Homo sapiens
  misc_feature: GYAE6OF01BN0UP.35.8.A08.1.454.CMB.1.raw
  modified_base (215)..(215): a, c, t, g, unknown or other
  misc_feature (215)..(215): n is a, c, g, or t
tcagtacagatcgtcacgaccggtgctcgatttagcatactctacagggggagtcagtctcagtcaggacacagcatggacatgagggtccccgctcagctcctggggctcctgctactctggctccgaggtgccagatgtgacattcagatgacccagtctccatcctccctgtctgcatctgtaggagacagagtcaccatcacttgccgggnaagtcagaccattcgcgtctatttaaatggtatcgcagaggccaggagaacgcccctaactactgatgtatactgtatctactttgcattattgcgtccatcaaggttcagtgcagtgatcgtgggacagtatttcactctcacctatacaaacaatataacaactagaactactttagacttaacttactacttagtaccaactagtaaccttaccgacgggtacccctaagtttcctaaccgttttccggaccccttaggggaacccctaacgtaccgttacccaacgttacctacccgtaaacgtaaaccgttgtaccggtacttcgacctacctacttcgttaccg

SEQ ID NO: 291336 - DNA, 580 bp, Homo sapiens
  misc_feature: GYAE6OF01A5HJJ.35.8.A08.1.454.CMB.1.raw
  modified_base (205)..(205): a, c, t, g, unknown or other
  misc_feature (205)..(205): n is a, c, g, or t
  modified_base (336)..(336): a, c, t, g, unknown or other
  misc_feature (336)..(336): n is a, c, g, or t
  modified_base (350)..(350): a, c, t, g, unknown or other
  misc_feature (350)..(350): n is a, c, g, or t
  modified_base (378)..(378): a, c, t, g, unknown or other
  misc_feature (378)..(378): n is a, c, g, or t
tcagtacagatcgtcacgaccggtgctcgatttagcatactctacagggggagtcagtctcagtcaggacacagcatggacatgagggtccccgctcagctcctggggctcctgctactctggctccgaggtgccagatgtgacattcagatgacccagtctccatccctccctgtctgcatctgtaggagacagagtcaccgtnacgttgccgggcaagtcagagcattaacaagtaatttaaattggtatcagcaagaaacctagggaaagtccctaggctcctcatctatgctgcttccactttgcaagatggggtccatcaaggttcagagnactggatcgtgganagaatcgctctcacactcagctagtctnacaacgtgaagtatttcgactacttactactgtacaatagtacgttacgtagttgtcttacgtaccgtttcggggaccgggtaacgggtaaccggtaagggttacgggtaaccgtaaacgttaacggtaaaaaccggtaaacgttcgggttacgggacccggtttagaaccccgtaaccgtaaccgttcccggtttaaccgg

SEQ ID NO: 291337 - DNA, 585 bp, Homo sapiens
  misc_feature: GYAE6OF01BB0IN.35.8.A08.1.454.CMB.1.raw
  modified_base (215)..(215): a, c, t, g, unknown or other
  misc_feature (215)..(215): n is a, c, g, or t
tcagtacagatcgtcacgaccggtgctcgatttagcatactctacagggggagtcagtctcagtcaggacacagcatggacatgagggtccccgctcagctcctggggctcctgctactctggctccgaggtgccagatgtgacattcagatgacccagtctccatcctccctgtctgcatctgtaggagacagagtcacagtcacttgccgggnaagtcagagcaattaacaagaatttaaattggtatcagcagaaacctgggaaagtcctaggctcctcatctatgctgtcttccactttgcaagagtcggggtcccatcgaaggttcagacggcactggatcgtagggacagaattcgctctcaccatcacgtcagtctgacaacctgaagtattttagactaactttactaacttacgtacaacgtagtacgttaacgtacggttacggtaccgtttaccgtaaccgtttccggggtacgggtaacggggtaaacccggtaaagggttacggaacgtaacgtaaacccggaaaacgtaacgttaggtacgggtactacggtaccaacccgtagttacccg

SEQ ID NO: 291338 - DNA, 701 bp, Homo sapiens
  misc_feature: GYAE6OF01EUHXD.35.8.A08.1.454.CMB.1.raw
tcagtacagatcgtcacgaccggtgctcgatttagcatactctacagggggagtcagtctcagtcaggacacagcatggacatgagggtccccgctcagctcctggggctcctgctactctggctccgaggtgccagatgtgacattcagatgacccagtctccatccctcctgtctgcatctgtaggagacagagtccaccgtcacgttggccgggcaagtcagagacaattaaacaaagtaaattttaaattggtatcagacaagaaaccgtagggaaacgtccctaggcctcctacattctatgcctcgtcctttcctacgttttcgacgtaaagtacggttaccggggtaccctagttaaccgtaacggttacgaaggtacggacgtacgtagggtacgttcggtagggtaacctaaggtaacttccgtaccttacctaccaacctacgtacgacgacgtacgttcgtacgacctaaccgtaggtaacgtttatttacgaccttaacctttacgttaacctacgtaacgaaacgttaaggtaacgttacgtacggtttacgttacctttaccggtaccggtttaccggggaaccgggtaacgggtaaaccgtaagggttacggaactaacgttaaccggaaaacgttaccggttaggtaccggtaccgttacgaccctaccgttattcccgttaccg

SEQ ID NO: 291339 - DNA, 694 bp, Homo sapiens
  misc_feature: GYAE6OF01ED93Z.35.8.A08.1.454.CMB.1.raw
  modified_base (226)..(226): a, c, t, g, unknown or other
  misc_feature (226)..(226): n is a, c, g, or t
tcagtacagatcgtcacgaccggtgctcgatttagcatactctacagggggagtcagtctcagtcaggacacagcatggacattgagggtccccgctcagctcctggggctcctgctactctggctccgaggtgccagatgtgacatttcagatgaccctagtctccatcctcctgtctgcattcgtggtaggagacgagacgtccaccgtcacgttggccggganaagtcagagcaattaacaagtaatttaaattggtactcagtcaaggaaaccgtgggaaacgtcccgtaggcctcctcatcctaagtgctgtccttcctactttcgacaagtacgtcgggtacccaagttacgtaaaggttcaaggtacggtactaacggtggtacttcggtaggggaactaaggtaacctttcgaccttacgtaccaaccgtactacgacggtacacgttactacgacctaaccgtgtaacgtttatttacgaacttaaacgtttactacgttcgttaacaaaccgtaggtaaccgttacgtagggttacgttacccgtttacgtacccggttttacggggaccggtaaacggggtaccgtaaagggggttacgaaaccgtaacgttaacccggtaaaacggttaccgttggtacgggtacccttacgggaacccctaacggtccgttcgtttacccg

SEQ ID NO: 291340 - DNA, 770 bp, Homo sapiens
  misc_feature: GYAE6OF01CH61V.35.8.A08.1.454.CMB.1.raw
  modified_base (196)..(196): a, c, t, g, unknown or other
  misc_feature (196)..(196): n is a, c, g, or t
tcagtacagatcgtcacgaccggtgctcgatttagcatactctacagggggagtcagtctcagtcaggacacagcatggacatgagggtccccgctcagctcctggggctcctgctactctggctccggaggtgccagatgtgacattcagatgacccagtctccactccctccctgtctgctatcgtggtagganacgagacgtaccaccgtcacgttcggccgggacaacgtcgaagacgactaaacgttaaactaaagttaaattttaaagttaggtactacgaacgaacgaaacggtaaaccgtaggggtaaaccgtcccgtaggtcccttaccctactacttacgttatcggcttacgtccttaccgttactttcggaacgtaacggtcggtaccgggtacctaacggttacgtaacggttcgaagggacgtacgtaacggtagggtacgttacggtacgggaactaacggttaacttccggacctttccgaaccctaactacgtaccgacgtcctaagttccgtacgtaacctaacgtacggtaaacgtttcgtttaaccgtacgttaaacctttaagtacccgttacgaaccgttaaacgtagtttacggtagtaccgtttaccgttacccgttaacgttccccggttacccgggttaacccggtaagggtaaaccgttaggaacggttaaacgtaaccttaaccgggtaaaacgtaccgttgtaccgggtacttacggacccttacgtccgttcgtttaccg

SEQ ID NO: 291341 - DNA, 656 bp, Homo sapiens
  misc_feature: GYAE6OF01C0100.35.8.A08.1.454.CMB.1.raw
tcagtacagatcgtcacgaccggtgctcgatttagcatactctacagggggagtcagtctcagtcaggacacagcatggacatgagggtccccgctcagctcctggggctcctgctactctggctccgagtgccagatgtgacattcagatcgacccagttcctccactccctccctgtctgctatctggtaggagacagagtccaccgtcacgttggccggacaagtcagagcagttggctagtttacttaagtggtaactacgaaaccggaaacgagggaaacgacccctaaatcctagatctatgctgactatcctagtttcgacgtaaggtccggggtaccgagtaacggttcgtaggtacgagtacggtagtcgtaccggtaggaactaagtaacttccgtaactccttaaccgacctaagtaccgaacgactacggtactaccggaactaaccgtagtaacgttactttacgtaaccgtaaacctttattacttacggaactaagtaagtacgttaacgacgttaccgaccgtacgactcgtaagtccgtaaccgggacgtaaacggactaacgtaacggtaggtaaagttaaacgtaaaacggttaccttggtaacgggtctacgtaaccaacttagtcccgtttaacg

SEQ ID NO: 291342 - DNA, 635 bp, Homo sapiens
  misc_feature: GYAE6OF01AZ82T.35.8.A08.1.454.CMB.1.raw
tcagtacagatcgtcacgaccggtgctcgatttagcatactctacagggggagtcagtctcagtcaggacacagcatggacatgagggtccccgctcagctcctggggctcctgctactctggctccgaggtgccagatgtgacattcagatgacccagtctccatcctccctgtctgcatctgtaggagacagagtcaccgtcacgttggccgggacaagtcaggagctaattaaacaagtaaatttaaattaggtatcagtacaagaaaccgtagggaaacgtccgtaggctacctcatctatcgtctgtccttcctactttgacgtaaggtacgtcggggtacctacgtacgtaacggttacgaaggacggactacgtaggtactcggtagggaacgaaggtaacgttcgtacttaccgtaccacctactacacgtcgtagtacctcgacctaaccgtagtaacgttagtttacgtaacttaacctttacttacgtacgtaactaacgtaacgtacgttacgtagttcgtactttacgtacgttcggacgggtacgggtaccgtaagggtacggaacgtagtaaccgaaacggtacgtacgggtcgtacgtacgaccacgtcgttcgttacg

SEQ ID NO: 291343 - DNA, 721 bp, Homo sapiens
  misc_feature: GYAE6OF01D0ZT2.35.8.A08.1.454.CMB.1.raw
tcagtacagatcgtcacgaccggtgctcgatttagcatactctacagggggagtcagtctcagtcaggacacagcatggacatgagggtccccgctcagctcctggggctcctgctactctggctccgaggtgccagatgtgacattcagatgacccagtctccatccctcctgtctgcatctgtaggagacagagtccaccgtcacgttcgccgggacaaggtcagagcaattaacaaagtaatttaaagttaggtatacagacaagaaaccgtaggaaacgtcctaggcctcctcatctatgctcgtccttcctactttcgactaaggtacgttcggggtacccaagttacgtaaacgggtttacgaaggtaggacctaacgtaggtacgtccgttaggggaactaaggtaaacgtttcggcttacctaccaacctactacgacgtactacgttcacgtaccgtaaccgttaggtaaacggtttacttttacggtaaccttaaaccgtttttaactaaccttacggttaacctaaacgttaacggttaacgtttaaccgttaagggtttccggttactttcccgttaacgggttttaccggggaccggggtaaacgggtaacccgtaaaggggttcggaaaccgtaacgtaaccggtaaaaccgggttaacgttacgggtcgggtaaccgttacgacccgtaacctgttcccgttaccg

SEQ ID NO: 291344 - DNA, 691 bp, Homo sapiens
  misc_feature: GYAE6OF01BY8I4.35.8.A08.1.454.CMB.1.raw
  modified_base (194)..(194): a, c, t, g, unknown or other
  misc_feature (194)..(194): n is a, c, g, or t
  modified_base (236)..(236): a, c, t, g, unknown or other
  misc_feature (236)..(236): n is a, c, g, or t
  modified_base (298)..(298): a, c, t, g, unknown or other
  misc_feature (298)..(298): n is a, c, g, or t
tcagtacagatcgtcacgaccggtgctcgatttagcatactctacagggggagtcagtctcagtcaggacacagcatggacatgagggtccccgctcagctccgtggggctcctgctgctctggctccaggtgccaagtgttacatcgaaatgacccagtcctccttccaccctgtctgctatcgtggtggganacagcgtcatcatcacttgcctggccagtcagacgtattagngtacgtggttgtctggtatcagcaagaaaccgaggaaccaaaaacctatcctagtaatttanaacggccttataagtttaacaaggtcgggtacccagacgtaagggtcggacggacaggtggactcggtacgggactaggtactttccgacttcgtacaacctagtacaacgaccaaccgttgacctacgaccgtaggaacgttacgtttacgaccttaaatttacgttaacgtcggtaaccctaaacgttagttaaacttaaaccgtttaaccgtttacccgttaacgttaaaccgggttttaccgggaaccggggtaaacggtaacccgtaaagggtaaccgaacggaaaacccgttaaaccggtaacgtcgggtacggtactcgggaaccaccggtacttccggttacttacgttacctacgtttacccctcccgtaccgtattaacccgg

SEQ ID NO: 291345 - DNA, 853 bp, Homo sapiens
  misc_feature: GYAE6OF01BSK8Q.35.8.A08.1.454.CMB.1.raw
tcagtacagatcgtcacgaccggtgctcgatttagcatactctacagggggagtcagtctcagtcaggacacagcatggacatgagggtccccgctcagctcctggggctctgctactctggctccgaggtgccagatgtgacattcagatgacccagtctcctatcctccctgtctgcatctgtaggacacgagacgtacaccgtctacttcggaccgggcaaaggtcaggacgactaaattaaaccgaaagttaaacttttaaagttaggtaacttaccgaaggaacctaacggtaaaaaccggttagggggtaaaccgttaccccgttagggtaccttaccgtaccggtaaacttccgtttaaagtccggttaacccttggttacccttttaccccgttaagtttttaccgacgttaaaagggtccggttaccgggggttacccctaaagttacccggtaaaacgggtttcccgaaaggtaccggtaaccgtaacggttcgggtaaacgttcccggtaagggggtaaacctacggttaaaccgttccggtaccttaccggttaccaacccgttaacttccgtaaacggtaccgtaacgttcgtaccgtaaacccggttaaccttaagggtaaacgttttaacgtttaccgaacccgttaacctttaccgttaacggtaccttaacgtaaaccgtaaggttaaccggttaacgtacggtttacggaccttttaccggtaccggtttaacggaccgggtaacgggtaaaccgtaacggggtcggtaaacctacggtaaacgtaccggtaacgttcggaaccgttcgaccgtacaccgtagttcgtttacccg

SEQ ID NO: 291346 - DNA, 840 bp, Homo sapiens
  misc_feature: GYAE6OF01C1O7M.35.8.A08.1.454.CMB.1.raw
  modified_base (201)..(201): a, c, t, g, unknown or other
  misc_feature (201)..(201): n is a, c, g, or t
tcagtacagatcgtcacgaccggtgctcgatttagcatactctacagggggagtcagtctcagtcaggacacagcatggacatggagggtccccgctcagctccgtggggcctcctgctactctggctccggaggtgccagatgtgacattcagtatcgacccagtcctccatccctcctgtctgctagtctaggtagganacagacgtccaccgtcacgttcggaccgggtacaaacggtcgaaggacgtactaaagttaaaaccgtaaaagttaaacttttaaaggttaggtaacttacgaacgacgaaacggtaaaccggtacgggtaaaaccggttacccgtacggtcccttaccgtactactacgttagtcgtcctcgttcctttaccctacgttttacgacgtaacggtacggttacccggggtaccttaacggtacgttaaacgggttacgaaacgggtacggtacgtacggtaggtacgttaccggggtagggtaaactaacgttaaccgttccgtacccgttacgtaacctacctacgtacgtagtaccgtacggttaccgtaacgtaaccctaaacgggtttaacgttaagggtttaacctttaacgtaaccctttaaaccttttaaccgtttaacccgttaacgttaaccgaaaacgttaggttaaaccggttacgtacggttaccggttaccgttaaccggttcgggttaaccggggtaacccggggaaacgggtaccggtaagggtaccggaaaccttaaccggtaaacggtaaacctacggggttcgtacggacgttaacccggactaccgttcgttcgttacccg

SEQ ID NO: 291347 - DNA, 683 bp, Homo sapiens
  misc_feature: GYAE6OF01EQ0IR.35.8.A08.1.454.CMB.1.raw
tcagtacagatcgtcacgaccggtgctcgatttagcatactctacagggggagtcagtctcagtcaggacacagcatggacatgagggtccccgctcagctcctggggctcctgctactctggctccgaggtgccagatgtgacattcagatgacccagtctccatccctccctgtctgcatctgtaggagacagagtcacccgtctacttcggcccgggacaagtcagagaccaattaaacaagtaatttaaagttaggtatcagacaagaaaccgtagggaaacgtcccgtaaggtcctacctctattcctatgtctgtcctttcctactttgacgaaaggtagtccggggttaccctaagttacgtaaaggtttcgaagtacggacgtacgtaggtacgtcgtagggaactaaggtaacgttccgtacttccgtaccaacctacgtccgacgtaccgtagttcgtcgtaacctaaccgtaggtaacgttacgttttcgtaccgttaactttaacctacttacgtaccgtaaagtacgtaagttacgtacggttcgttaccttacgtaaccggtttaccgggacgggtacgggaaccggtaagggtacggtaacgtaacgtaaccggaaacgtaacgttacgggtacggtacgtacgaaccgtaccctagtccgttaccgg

SEQ ID NO: 291348 - DNA, 698 bp, Homo sapiens
  misc_feature: GYAE6OF01BP5E7.35.8.A08.1.454.CMB.1.raw
  modified_base (640)..(640): a, c, t, g, unknown or other
  misc_feature (640)..(640): n is a, c, g, or t
  modified_base (688)..(688): a, c, t, g, unknown or other
  misc_feature (688)..(688): n is a, c, g, or t
tcagtacagatcgtcacgaccggtgctcgatttagcatactctacagggggagtcagtctcagtcaggacacagcatggacatgagggtccccgctcagctccgtggggctcctgctactctggctccgaggtgccagatgtgactattcagatcgacccagtcctccactccctccctgtctgctatctggtaggagacagagtccacccgtacacgttcggcccgggacaacgtcgaagacgactaacttaaacaaagttaaattttaaattaggtaatacgaaggacaaacggtaaaccggtaacgggtaaacgttaccccgtaggtcccttacccgtactacttctacgtggtccttcgtcctttaccctattttcggactaacggtacggtcccggggtacccagttaaccgtaaggttaccgaagggtcggtaactacggttcgggtaagttcccggtaaaggggtaaccgtaaggtaaacggtttccccgtaccttaccgtaacccaactacgtaaccgacgtacgtacgtactacgtaaccctaaccgtaggtaatttacgtttaccaacttaacgttacctactagtaccaagtagtaccgtatacggtctcgttacgtcggttaccgggnggaacggtacgtaggtacgacacgtaataacgtgtcgagtacgtacanacgtctgtac

SEQ ID NO: 291349 - DNA, 872 bp, Homo sapiens
  misc_feature: GYAE6OF01C0WMK.35.8.A08.1.454.CMB.1.raw
tcagtacagatcgtcacgaccggtgctcgatttagcatactctacagggggagtcagtctcagtcaggacacagcatggacatgagggtccccgctcagctccgtggggctcctgctactctggctccggaggtgccagatgtgacattcagatcgaccagtctccactcctccctgtctgctatcgtagtaggacacgaggacgtaccgaccgtctaccgttcggaccgggacaacggtcgaaggacgtactaaacttaaacgaaagttaaattttaaaagttggtaaactaccgaaacgtaaccgtaaaacggtaaaaccggttacgggtaaaaccgttcccgtaacggggtccttaccctaactaacgttccttaagttccggtactttaccggttaccttttacccgtaacgttttacggaaacgttaacggttaaccgggttacccggggttaacctaaacggttaccggtaaacgggtttacgaaacggttagggacccgttaaaggtacgggtacgttacgggtagggtaacctaaggtacttttaccgacttacctaacaacctaactaacaaactactaaaccttaacgtaacgtaaggttacttaacttacgtaaacctaaacctttacgtaacgttaactaaccctaacggtaacgtttaacccgtaacggaaccccggttacccttaacgttacccggtttacccggttacccgggacccgttaacggggtaaccccaaacgggttaccctaaacctaacggtaaacccgttaacccggtaaacggttacggtaccggttaacggtaccttacccggaaaccctttacccggtaactttcccgggtacctttaaaccccg

SEQ ID NO: 291350 - DNA, 670 bp, Homo sapiens
  misc_feature: GYAE6OF01DXQJF.35.8.A08.1.454.CMB.1.raw
  modified_base (216)..(216): a, c, t, g, unknown or other
  misc_feature (216)..(216): n is a, c, g, or t
tcagtacagatcgtcacgaccggtgctcgatttagcatactctacagggggagtcagtctcagtcaggacacagcatggacatgagggtccccgctcagctcctggggctcctgctactctggctccgaggtgccagatgtgacattcagatgacccagtctccatcctccctgtctgcatctgtaggagacagagtccaccgtcacttgccgggnaagtcagagctaataacaagtaatttaaatgtatcagcagaaacctggaaagtccctaggctcctcatctatgctgcttcactttgcaagtagtgggtcccaatcgtaaggttcagaggcactaggtatcgtgggaacaaggtaacttcgcttacgtccaccactccacgcgtaacgtcctacgaccgtaaacctacggtaaaggtacttttacgaaccgttaaccttaaccttaagttacgtaactaaccgtaaacggtacgtttaacggtaacgtttacgggtacccgttttacgttaccggttttacccggggacccggggttaacggggaaaccccggttaaaggggtaccgggttaaaccgtaacgttaaaacccggtaaaaccggtaaacccgggttaacgtacggggtaccctacggtacccaacccgttaacgtcgtttaacccgg

SEQ ID NO: 291351 - DNA, 632 bp, Homo sapiens
  misc_feature: GYAE6OF01CS3S4.35.8.A08.1.454.CMB.1.raw
  modified_base (95)..(95): a, c, t, g, unknown or other
  misc_feature (95)..(95): n is a, c, g, or t
  modified_base (190)..(190): a, c, t, g, unknown or other
  misc_feature (190)..(190): n is a, c, g, or t
  modified_base (202)..(202): a, c, t, g, unknown or other
  misc_feature (202)..(202): n is a, c, g, or t
  modified_base (491)..(491): a, c, t, g, unknown or other
  misc_feature (491)..(491): n is a, c, g, or t
  modified_base (535)..(535): a, c, t, g, unknown or other
  misc_feature (535)..(535): n is a, c, g, or t
tcagtacagatcgtcacgaccggtgctcgatttagcatactctacagggggagtcagtctcagtcaggacacagcatggacatgagggtccccgntcagctccgtgggctcctgctactctggcctccggaggtgccagatgtgacattcaggactacgacccagttcctaccacttccctccctgtccngcatctgagganacagactccaccgtcacgttggaccggactaagtcgagagctaattaaacaagtaaatttaagttggtaactcgaagaccaaacggtaaaccgtagggaaacctcctaaggcctccgtactatcctatcgcttcgtccttactaccgtttaggactaacgaggtttccgggaccctaaggttacgtaaggtccaaggacggtacctacggtgggactacgtgggaactaggtaacttccgcttactacacactgacgtaccatccgaagtaccgtacgtagtaacgttntttacgaacttagttacctactagtacaaacgtctaacgttcgngttacgtcctttacgtacgtaccgggacggaacggaccgtagacggtaaactacgtacgaaacgttacgtgaccgtcgtacacccgtactgtctacg

SEQ ID NO: 291352 - DNA, 687 bp, Homo sapiens
  misc_feature: GYAE6OF01EREYY.35.8.A08.1.454.CMB.1.raw
  modified_base (278)..(278): a, c, t, g, unknown or other
  misc_feature (278)..(278): n is a, c, g, or t
  modified_base (455)..(455): a, c, t, g, unknown or other
  misc_feature (455)..(455): n is a, c, g, or t
tcagtacagatcgtcacgaccggtgctcgatttagcatactctacagggggagtcagtctcagtcaggacacagcatggacatgagggtccccgctcagctccgtggggcctcctgctactctggctccgaggtgccagatgtgactattcagatcgaccctagtcctccacttccctcccgttgtctgcatcgtaggtaggagacgagacgtccgaccgtctacgtcggacccgacagtacgagtagttaattagttagttggtacggtctggtacncgagacaacgaaaccgaacggaaccctacccctaaactcctagtacgttacgttaacggtccttagttaacgttaggacggtcgggtccggtacctagttaccgtaggtcgacggccggtacgtagtacggatcggtacggactacgtacctacgactccacctaccactacccacncgtctcgacgacgtcgtatacgttgttacgttacgaccttaacttactaccgtacgtacctaagtagttagtacgttactaccgttccgttccgttacccgttccgggtaccgtaagggtaaccgtaacggtacgtaacgttaaccgtaacgtaacgtcggttacggtcgtaccgtaccgacccttaaccgttcgttacccgttcgtttcccttccgtacccgtttcccccg

SEQ ID NO: 291353 - DNA, 571 bp, Homo sapiens
  misc_feature: GYAE6OF01A4JFW.35.8.A08.1.454.CMB.1.raw
  modified_base (563)..(563): a, c, t, g, unknown or other
  misc_feature (563)..(563): n is a, c, g, or t
  modified_base (566)..(566): a, c, t, g, unknown or other
  misc_feature (566)..(566): n is a, c, g, or t
tcagtacagatcgtcacgaccggtgctcgatttagcatactctacagggggagtcagtctcagtcaggacacagcatggacatgagggtccccgctcagctcctggggctcctgctactctggctccgaggtgccagatgtgacattcagatgacccagtctccatcctccctgtctgcatctgtaggagacagagtcaccgtcacgttgccgggcaagtcagagcattaacaagtaatttaaatgtatcagacagaaaccgtggaaacgtccctaggcctctcatctatgctgtccttcctatttgacaacgagtcggggtacccagtacgtaaggttcaggacggcacgtggagtcggtagggaactagtaacgttcgccgttaccgtcaacctataccgagtacacgtctacggactaaccgtagtaacgttatttacgaccttaacttacgtactagtacaacgtaagtacgttacgtaggtcgttcttacgtacgttcgggcggaacgggacgaaggacgctaagtaacgaaacggactggtccggctacgcaaccgnttnttccg

SEQ ID NO: 291354 - DNA, 728 bp, Homo sapiens
  misc_feature: GYAE6OF01AL1JS.35.8.A08.1.454.CMB.1.raw
  modified_base (198)..(198): a, c, t, g, unknown or other
  misc_feature (198)..(198): n is a, c, g, or t
  modified_base (401)..(401): a, c, t, g, unknown or other
  misc_feature (401)..(401): n is a, c, g, or t
tcagtacagatcgtcacgaccggtgctcgatttagcatactctacaggggggagtcagtctcagtcaggacacagcatggacatgagggtccccgctcagctcctggggctcctgctactctggctcccaggtgccaagtgtgacatacgaaatcgacccagttcctccttcccacccttgtctgcatctggtggganacagcgtcatcactctacttgccgtggccagtcaaggactattaggtgaccgttgggtcggccgttggtactcaggacaacgaaaccgacggaaccaaaaaccccttaactccgttagttaactttagtacggtccttacgttaagtttaacgaacgggtcgggtcccaggtacgaagggttcggcggcgaggtcggatacgngggtactagttactttcacttctaccacgtactcgtacacctaacctgacacgtcgtagtacggtactttgaaccttaacttacgttacgtacgacctaaacgtagtttaaacgttaacctttaacccgtttaaccccgttacgtttaaccgggtttaccggggaccggggttaaccggaaccggttaacggtaacgggaacccgtaaacccggaaaccggttacggttacgggtacgttacccgtacgtaacccctaacccgttccgttacgtttccctaccgttacccttcccgttaccccggtaccctacgttcccgtaacggg

SEQ ID NO: 291355 - DNA, 765 bp, Homo sapiens
  misc_feature: GYAE6OF01ENAV3.35.8.A08.1.454.CMB.1.raw
tcagtacagatcgtcacgaccggtgctcgatttagcatactctacagggggagtcagtctcagtcaggacacagcatggacatgagggtccccgctcagctcctggggctcctgctactctggctccgaggtgccagatgtgacattcagatcgaccctagtcctccattccctcccttgtcctgcattcgtaggtaggagacagacgttccaccggtctacttcggcccgggacaagtcaagacgactaattaaacaagttaaattttaaagttggtaactacaagtacaaacggaaaccgttagggaaacgttcccctacggtccttacctacgtacttctaatcgcttcgtcctttacgtactttcggactaaggtacgttccgggtaccctaagtacgtaaggttcgaaggtacgaccgtacgtacggtacgtacgtaggggactaaaggtacctttccgccttaccgacctacctagtaccgagtaccgttacgtacctcgaacctaacgttaacggtaatttacgtttaacacccttaaacgtttacttaaccgtagttaaccgaacgttaacgggtaacgtttaacgacggtttccgttaacccgtttacgttacccgggtttacgggaaccggggttaaccggtaaaccgggtaacggggttacgaaacccgttaagtaaaccccggttaaaggggaccgtttaacgggacggttaccggttaccaaccgttaccctttaggttaccccgtttccgg

SEQ ID NO: 291356 - DNA, 706 bp, Homo sapiens
  misc_feature: GYAE6OF01A5KTH.35.8.A08.1.454.CMB.1.raw
  modified_base (226)..(226): a, c, t, g, unknown or other
  misc_feature (226)..(226): n is a, c, g, or t
  modified_base (358)..(358): a, c, t, g, unknown or other
  misc_feature (358)..(358): n is a, c, g, or t
  modified_base (361)..(361): a, c, t, g, unknown or other
  misc_feature (361)..(361): n is a, c, g, or t
tcagtacagatcgtcacgaccggtgctcgatttagcatactctacagggggagtcagtctcagtcaggacacagcatggacatgagggtccccgctcagctccgtgggctcctgctactctggctccggaggtgccagatgtgactattcagatcgacccagtctaccatccctcctgtctgcatctggaggagacagacgtccaccgtctacgttcggcccgganaacgtcgagacgtactaaagttaaacaaagttaaattttaaacgttaggttatacacgtacgtaaacgaaccggttagggaaaccgtcccgtaggtccctcctacgtattctactcgtctctccttaccgtntanacgaagtccgtacgggtacccagtacgtaaggtacgaacggcggtacgtacggtaggtacgtacggtaggtaaacgtacgtacgttacgaccttacacctaaccgtacgtaccgtacggccgttaacgtaccgtacgaaccgtaacgttagttaaacgtttcgtttaaccttaaccttaaccgtttaaccgttaactaacgtaaccgtaacgtaaggttacttacggtacgttagttcccgttacgtttaccgggtaccgggtaccgggtaagtaaccgggtaggtaaccgagtaacctacggtaaacgtcggtagtaccggtctacgactacctgttacgttcg

SEQ ID NO: 291357 - DNA, 772 bp, Homo sapiens
  misc_feature: GYAE6OF01AEP1U.35.8.A08.1.454.CMB.1.raw
tcagtacagatcgtcacgaccggtgctcgatttagcatactctacaggggggagtcagtctcagtcaggacacagcatggacatgagggtcccccgctcagctccgtggggctcctgctactctggctccggaggtgccagatgtgactattcagatcgacccagtcctccactccctcctgtctgctatcgtaggtaggagacagacgtcaccgtctacgtcggccggacaacgtcagagactaattaaacaaagttaaatttaagttaggtactacgaagaaccgaaacggtaaaccggtaacgggtaaaccgtacccgtacgtccctcctactactactacttcctcgttccttacctactttagacgtaaggtacggtaccgggtacctacgtacggtaacggtacgaggacggtaccgtaacggtcggtacgtacggtaagggacttaacggtaaccgttccgtacgtaccgtaccctacgtactacggacgtccgtacggttacgtacgtaaccctaacgtttaaggttaacgtttacgtttaaccgtaacctttaaacgtttacccttaaccgttacgtaaccgtaacgttaacggttaacggttaccggtaggtttaccgttacgtttacccggtacggggtttaccgggaaccggggttaaccgggaaccggttaaacgggtacgtaaccgtaacgttaaacgggaaaccggttcggacggtacgtaccgtacgtacctaccgttcttcccggtgttaacccg

SEQ ID NO: 291358 - DNA, 697 bp, Homo sapiens
  misc_feature: GYAE6OF01E3P01.35.8.A08.1.454.CMB.1.raw
  modified_base (99)..(99): a, c, t, g, unknown or other
  misc_feature (99)..(99): n is a, c, g, or t
  modified_base (229)..(229): a, c, t, g, unknown or other
  misc_feature (229)..(229): n is a, c, g, or t
  modified_base (269)..(269): a, c, t, g, unknown or other
  misc_feature (269)..(269): n is a, c, g, or t
  modified_base (420)..(420): a, c, t, g, unknown or other
  misc_feature (420)..(420): n is a, c, g, or t
  modified_base (454)..(454): a, c, t, g, unknown or other
  misc_feature (454)..(454): n is a, c, g, or t
  modified_base (480)..(480): a, c, t, g, unknown or other
  misc_feature (480)..(480): n is a, c, g, or t
tcagtacagatcgtcacgaccggtgctcgatttagcatactctacgagggggagtcagtctcagtcaggacacgagcatggacatggacgggtccccgntcagctccgtggggcctcctgctactctggcctccggaggtcgccagtactgtcgactattcaagtatcgaccccagtcctccactccctcctgtcctgacattctggtaggacgacagtactcaccgtnacttggccctggaccaggttccaggtacgtagtttacggngtacgttggggtacgtccttagggtactcgaagcgaaacgaaacccgacggaaaaccctaaaaacccgttaactcctaagttatttaaacgacggttccttaacgttagtttaacgaacggtcgggtacccagcgtaacgggttgcggacngtggacttcgaggactattacttcgaacctgacncgatcgactacacttacgcagtccgngtaacggtctttacgaccttaactttagttacccgacgaactaactgtaaacctttacgtaccgtttaccctaacgttaaccgggttcgggaacgggtacggaaaccgtaggtaaacgaaccgtaactaaaccggtacgtacggaccgtacgtaccgaactcccgttaaagttcccctttaaggtcctttacccgtacgttcccctccgtaacgtac

SEQ ID NO: 291359 - DNA, 640 bp, Homo sapiens
  misc_feature: GYAE6OF01BCS9J.35.8.A08.1.454.CMB.1.raw
  modified_base (196)..(196): a, c, t, g, unknown or other
  misc_feature (196)..(196): n is a, c, g, or t
  modified_base (312)..(312): a, c, t, g, unknown or other
  misc_feature (312)..(312): n is a, c, g, or t
tcagtacagatcgtcacgaccggtgctcgatttagcatactctacagggggagtcagtctcagtcaggacacagcatggacatgagggtcccccgctcagctccgtggggctcctgctactctggctccgaggaaccactggagaaacagtgatgacgcagtctccagccatcctgtctgtgtcctccgagggganagacgccaccctctcctgcagggccagtcagactatacgtaccaacttgcctggtactcagcaacgtaacctggtacacggcctacccgaggtccttcctcacttctagtgggtcnctactcccgaaccgagggcctacgtgtacctcccaggtaccctaggttccaggtcggactagggtcgggtcgtggggactaggtacgtttccacgttctacacctataccgagcgtacgccgttagcagttctgtagttgttacttttagacctttagttttactacgttgttacacgtacttattacgtagtacttaaccggtccggtacccgttccggtacggtaccggttaccgggaaccggtaaacgggtaacccgtaaggggttccgggaaaccgtacccggaaacgttacggttagggtacgaccgtaccggcccgtaaccg

SEQ ID NO: 291360 - DNA, 703 bp, Homo sapiens
  misc_feature: GYAE6OF01BT0BT.35.8.A08.1.454.CMB.1.raw
  modified_base (94)..(94): a, c, t, g, unknown or other
  misc_feature (94)..(94): n is a, c, g, or t
  modified_base (199)..(199): a, c, t, g, unknown or other
  misc_feature (199)..(199): n is a, c, g, or t
  modified_base (215)..(215): a, c, t, g, unknown or other
  misc_feature (215)..(215): n is a, c, g, or t
tcagtacagatcgtcacgaccggtgctcgatttagcatactctacagggggatcagtctcagtcaggacacagcatggacatgagggtccccgntcagctcctggggctcctgctactctggctccggaggtcgccagatgtgacattcagtatcgacccagtctccacttccctccgtgtctgctattcgtgtagganacagacgtccaccgtntacgttcggccgggatagtcaggagactaaattaaacgaagttaaattttaaacgttggtactacgacgacgtaaacgaaccgttagggaaacgttccccgtaaggtccctaccgtactattacgtagttcggcttccgtacccttttacgtacgtttacgacgtaaggtacggttccgggtaccctagtaacgtaaggttacaagggacgtactacggtacggtacgtcggaacggtaacctaaggtaccgttccgtccgttacctaccaacctacgtcgtaacgtcgtactcggtacaaccgtacgttagtacgtttacgtttaccaacctttaactacttacgtacaacgtaacagtttacggtacgtgttcttacgtcggtaccgggtagggaccggtaggtaccgtaaggtcgtaaaacctacgtaaacggtaaccgttaggtccggttacgacgttaccgaacctcgttgttccgttacccg

SEQ ID NO: 291361 - DNA, 743 bp, Homo sapiens
  misc_feature: GYAE6OF01CV6C7.35.8.A08.1.454.CMB.1.raw
  modified_base (95)..(95): a, c, t, g, unknown or other
  misc_feature (95)..(95): n is a, c, g, or t
  modified_base (155)..(155): a, c, t, g, unknown or other
  misc_feature (155)..(155): n is a, c, g, or t
  modified_base (195)..(195): a, c, t, g, unknown or other
  misc_feature (195)..(195): n is a, c, g, or t
  modified_base (215)..(215): a, c, t, g, unknown or other
  misc_feature (215)..(215): n is a, c, g, or t
  modified_base (405)..(405): a, c, t, g, unknown or other
  misc_feature (405)..(405): n is a, c, g, or t
  modified_base (441)..(441): a, c, t, g, unknown or other
  misc_feature (441)..(441): n is a, c, g, or t
  modified_base (485)..(485): a, c, t, g, unknown or other
  misc_feature (485)..(485): n is a, c, g, or t
tcagtacagatcgtcacgaccggtgctcgatttagcatactctacagggggagtcagtctcagtcaggacacagcatggacatgacgggtccccntcagctccgtgggcctcctgctactcgtggcctccggaggtcgacagatggtacgaactnttacagactcgaccctagtcctccacttcccctcctgtcngctatcgtaggaacgactanaggtacctacccgtacgttactacggtcggaccggataacggcaagtacacttaaacttaaacgtaaattaacgtttaaggtcgaatacgacggtaacgtaaaccggtacggtaacggtaaccctccccgtagaacccttccgtactaacgttctagtccgttcgtaccttccttacgtacgtaccgtanaacgggtccggaccgttctaccgtaggtaaccggtnacggactccggtaagtggaccgttagacgggttaacacggtttnaccgtccctataccgactacgtacgacgtatacccgtctaacgtactaacgttagtacttacgtactaccgttaacttcgtaactacgtacgaaagtcgttaacgttacggcgttaccggttacttaccggggttcggtaaccggggtaacggtaaccgggtaaacggttaacggaccgtaaacgtaaccgtaaacggtaaacggtccgttaggttaccggtaaccgttaccgaacctacttcccgtgttaaccccgg

SEQ ID NO: 291362 - DNA, 482 bp, Homo sapiens
  misc_feature: GYAE6OF02GFAJH.35.8.A08.1.454.CMB.1.raw
  modified_base (479)..(479): a, c, t, g, unknown or other
  misc_feature (479)..(479): n is a, c, g, or t
tcagtacagatcgtcacgaccggtgctcgatttagcatactctacaggggagtcagtctcagtcaggacacagcatggacatgagggtccccgctcagctcctggggctcctgctactctggctccgaggtgccagatgtgacattcagatgacccagtctccatcctccctgtctgcatctgtaggagacagagtcaccgtcacttgccgggcaagtcagagcattaacaagaatttaaattggtatcagcagaaacctgggaaagtccctaggctcctcatctatgctgcttccactttgcaagatggggtcccatcaaggttcagaggcactggatctgggacagaattcgctctcaccatcagcagtctgcaacctgaagattttgctaactttactactgtacaacagagttaacagtgcttcactttcggcggaggaccaaggtggacatcaaacgactgtgctgacaccatntcg

SEQ ID NO: 291363 - DNA, 490 bp, Homo sapiens
  misc_feature: GYAE6OF02JAPNJ.35.8.A08.1.454.CMB.1.raw
tcagtacagatcgtcacgaccggtgctcgatttagcatactctacagggggagtcagtctcagtcaggacacagcatggacatgagggtccccgctcagctcctggggctcctgctactctggctccgaggtgccagatgtgacattcagatgacccagtctccatcctccctgtctgcatctgtaggagacagagtcaccgtcacttgccgggcaagtcagagcattaacaagaatttaaattggtatcagcagaaacctgggaaagtccctaggctcctcatctatgctgcttccactttgcaagatggggtcccatcaaggttcagaggcactggatctgggacagaattcgctctcaccatcagcagtctgcaacctgaagatttgctaacttactactgtcaacagagttacagtgcttcactttcggacgtaggaccaagggtcggacagtacaaacgaactggtagctgcaccgtatcttacg

SEQ ID NO: 291364 - DNA, 715 bp, Homo sapiens
  misc_feature: GYAE6OF02HQCKH.35.8.A08.1.454.CMB.1.raw
tcagtacagatcgtcacgaccggtgctcgatttagcatactctacaggggagggtcagtctcagtcgaggacctacacgcgaattcggaacgatgtacgggtccccgtcgtcagctcctgggctcctagctactcgtggctccgaggtggcctaggatgtgacagttttctagtatgaccctagtacgtcactacctcctgtctgcatctgtaggagactaggagtctaccggtcacttcgccggggccaagtcagagccagttaacaagaatttaaacttggtagtactaacgtcaagtaaacccttagggaaagtccctaaggtctacctcgactcctagtcgcctggacgttcctactttcgacgtaaggtactcggggtacccaattactaaggttcgaaggtacggacaacttaggtaactcgtagggaacctaggtattcggacgtccgtactaccctaactaccacgacagtaccgtacgcctaaaccgtagtaacgtacttttgacttaaccttactactacgttacaaacgtaacgtaccgtttaacgaacgggtaccccgtaacgttaccgtaaccgtttaccgggacccgttacgggtacccttaacgtaaccggttaccggtaaacgttcccggaaacggtaaccggtaaaccgttacgggttacggggtaccgttacggacccgtaaccctaagttacccgg

SEQ ID NO: 291365 - DNA, 483 bp, Homo sapiens
  misc_feature: GYAE6OF02G825P.35.8.A08.1.454.CMB.1.raw
tcagtacagatcgtcacgaccggtgctcgatttagcatactctacagggggagtcagtctcagtcaggacacagcatggacatgagggtccccgctcagctcctggggctcctgctactctggctccgaggtgccagatgtgacattcagatgacccagtctccatcctccctgtctgcatctgtaggagacagagtcaccgtcacttgccgggcaagtcagagcattaacaagaatttaaattggtatcagcagaaacctgggaaagtccctaggctcctcatctatgctgcttccacttttgcaagatggggtcccatcaaggttcagaggcactggatctgggacagaattcgctctcaccatcagcagtctgcaacctgaagattttgcaacttactactgtacaacagagtacagtgcttcactttcggcgtaggaccaaggtcggacagtcaaacgactgtaggctgcaccatctcg

SEQ ID NO: 291366 - DNA, 512 bp, Homo sapiens
  misc_feature: GYAE6OF02F4A7M.35.8.A08.1.454.CMB.1.raw
tcagtacagatcgtcacgaccggtgctcgatttagcatactctacagggggagtcagtctcagtcaggacacagcatggacatgagggtccccgctcagctcctggggctcctgctactctggctccgaggtgccagatgtgacattcagatgacccagtctccatcctccctgtctgcatctgtaggagacagagtcaccgtcacttgccgggcaagtcagagcattaacaagaattaaattggtatcagcagaaacctggaaagtccctaaggctcctcatctatgctgcttccactttgcaagatggggtccatcaaggttcagaggcactggatctgggacagaattcgctctcacatcagcagtctgacaacctgaagtatttgactaacttactactgtacaacagagttacagtcgacttcacgtttacggcggtacgggtacgaaggtacggaactaagtacgaaaacgtaacgtggtacgcgtacgaccacgacttcttacgg

SEQ ID NO: 291367 - DNA, 511 bp, Homo sapiens
  misc_feature: GYAE6OF02GZ0VZ.35.8.A08.1.454.CMB.1.raw
tcagtacagatcgtcacgaccggtgctcgatttagcatactctacagggggagtcagtctcagtcaggacacagcatggacatgagggtccccgctcagctcctggggctcctgctactctggctccgaggtgccagatgtgacattcagatgacccagtctccatcctccctgtctgcatctgtaggagacagagtcaccgtcacttgccgggcaagtcagagcattaacaagaatttaaattggtatcagcagaaacctgggaaagtccctaggctcctcatctatgctgcttcactttgcaagatgggtccatacaggtcagaggcactggatcgtggacagaattcgctctcaccatcagcagtctcgacaaccgtagaagtatttcgtactaacttactactcgtacaacagtagttacagttcgtcttcgtactttcgggcggagggaccgtaaggtcggaacataccgaaacgtaacgttagtacggcgtcgcacctatctacg

SEQ ID NO: 291368 - DNA, 533 bp, Homo sapiens
  misc_feature: GYAE6OF02FSPQU.35.8.A08.1.454.CMB.1.raw
tcagtacagatcgtcacgaccggtgctcgatttagcatactctacagggggagtcagtctcagtcaggacacagcatggacatgagggtccccgctcagctcctggggctcctgctactctggctccgaggtgccagatgtgacattcagatgacccagtctccatcctccctgtctgcatctgtaggagacagagtcaccgtcacttgccgggcaagtcagagcattaacaagaatttaaattggtatcagcagaaacctgggaaagtccctaggctcctcatctatgctgcttccactttgcaagatgggtcccatcaaggttcagaggcactggatctgggacagaattcgctctcaccatcagcagtctgcaacctgaagtatttgctaacttctactgtcaactagtacgttacaggttcgactttcgacgttttcgggacgggtacgggtacctaagggtcggaactaagtaccgaaaacggtaaccttggtacggccttacgggccctaaccgtacgtccttacgg

SEQ ID NO: 291369 - DNA, 505 bp, Homo sapiens
  misc_feature: GYAE6OF02H3UV0.35.8.A08.1.454.CMB.1.raw
tcagtacagatcgtcacgaccggtgctcgatttagcatactctacagggggagtcagtctcagtcaggacacagcatggacatgagggtccccgctcagctcctggggctcctgctactctggctccgaggtgccagatgtgacattcagatgacccagtctccatcctccctgtctgcatctgtaggagacagagtcaccgtcacttgccgggcaagtcagagcattaacaagaattaaattggtatcagcagaaacctgggaaagtccctaggctccctcatctatgctgcttccactttgcaagatggggtcccatacaaggttcagaggcactggatcgtggacagattcgctctcacatcagcagtctgcaactgaagtattttgactaacttactaactcgtacaactagagttacagttggacttcacgtttcggcggagggaccgaagggttggaacgtatacaaattagaacgtgtaggctgactacctattaccg

SEQ ID NO: 291370 - DNA, 524 bp, Homo sapiens
  misc_feature: GYAE6OF02F90AJ.35.8.A08.1.454.CMB.1.raw
  modified_base (307)..(307): a, c, t, g, unknown or other
  misc_feature (307)..(307): n is a, c, g, or t
tcagtacagatcgtcacgaccggtgctcgatttagcatactctacagggggagtcagtctcagtcaggacacagcatggacatgagggtccccgctcagctcctggggctcctgctactctggctccgaggtgccagatgtgacattcagatgacccagtcctccatccctccctgtctgcatctgtaggagacagagtcaccgtcacttgccggcaagtcagagcattaacaagaatttaaatggtatcagcaagaaacctggaaagtccctaggctctcatctatgctgcttccactttgcaagntcgggtcccatcgaaggttcagagcacgtggatcgtggacagtaacttcgctctcacatcaccagcctgcagcctgattgtacttttgaaccttattacagtaccaaagtagttacgtggtactacttccgtctacgtttccggaccctagggtaccaaaggtcggtaacttaacgtaacgaaacgtacgtggtacgctcggaccacgtatcttacg

SEQ ID NO: 291371 - DNA, 564 bp, Homo sapiens
  misc_feature: GYAE6OF02ISJ7J.35.8.A08.1.454.CMB.1.raw
tcagtacagatcgtcacgaccggtgctcgatttagcatactctacagggggagtcagtctcagtcaggacacagcatggacatgagggtccccgctcagctcctggggctcctgctactctggctccgaggtgccagatgtgacattcagatgacccagtctccatcctccctgtctgcatctgtaggagacagagtcaccgtcacttgccgggcaagtcagagcattaacaagaatttaaattggtatcagcagaaacctggaaagtccctaggctcctcatctatgctgcttccactttgcaagatggggtccatcaaggttcagtacggcactggatctgggacagtaattcgctctcacctatcaagcagtctagcaacctgaagtattttgactaactttactactgtacaaactagtaacgttacagttcggcttttacacgttttacgggacgggtaaggggtacctaagggtacgggtaacctaacgtaaccgtaaaaccggtaacgttacggttacggtacgttacggaccgtaacccgtacgttcgtttaccgg

SEQ ID NO: 291372 - DNA, 548 bp, Homo sapiens
  misc_feature: GYAE6OF02GX6VP.35.8.A08.1.454.CMB.1.raw
  modified_base (340)..(340): a, c, t, g, unknown or other
  misc_feature (340)..(340): n is a, c, g, or t
  modified_base (373)..(373): a, c, t, g, unknown or other
  misc_feature (373)..(373): n is a, c, g, or t
tcagtacagatcgtcacgaccggtgctcgatttagcatactctacagggggagtcagtctcagtcaggacacagcatggacatgagggtccccgctcagctcctggggctcctgctactctggctccgaggtgccagatgtgacattcagatgacccagtctccatcctccctgtctgcatctgtaggagacagagtcaccgtcacttgccgggcaagtcagagcattaacaagaatttaaattggtatcagcagaaacctgggaaagtccctaggctcctacatctatgctgtccttcctactttgacaagtagtcggggtccagtcgtaggtaaaacnggagcacgtggatcgtaggacagaattcgctcncaccatacagacagtctcgacctactagaattatttcgacttaacttactactagtacaactagtacttacgagttgtaccttcgtacgtttcgggacgggtacggtaccgaagggtcgaactaagtaaccgaaacgtaacgttcggtacgcttagacctaactacgtcttaccg

SEQ ID NO: 291373 - DNA, 571 bp, Homo sapiens
  misc_feature: GYAE6OF02IXNF1.35.8.A08.1.454.CMB.1.raw
tcagtacagatcgtcacgaccggtgctcgatttagcatactctacagggggagtcagtctcagtcaggacacagcatggacatgagggtccccgctcagctcctggggctcctgctactctggctccgaggtgccagatgtgacattcagatgacccagtctccatcctccctgtctgcatctgtaggagacagagtcaccgtcacttgccgggcaagtcagagcattaacaagaatttaaattggtatcagcagaaacctgggaaagtccctaggctcctcatctatgctgcttccactttgcaagagtggggtcccatcaaggttcagaggcactggatcgtggacagaattcgctctcaccatcagcagtctgacctaaccgtagtaacgtagttttacgaccttaaactttacttactagtaccaaactacgtaagttaacgaggttacggtactttctacgtttacgggaccgggtaagggtaccgtaagggtacgggaactaacgttaacgaaaacggtaaccgttaggtacggcttaccggacctaacccgtagttccgttacg

SEQ ID NO: 291374 - DNA, 540 bp, Homo sapiens
  misc_feature: GYAE6OF02HC5KU.35.8.A08.1.454.CMB.1.raw
  modified_base (308)..(308): a, c, t, g, unknown or other
  misc_feature (308)..(308): n is a, c, g, or t
  modified_base (339)..(339): a, c, t, g, unknown or other
  misc_feature (339)..(339): n is a, c, g, or t
tcagtacagatcgtcacgaccggtgctcgatttagcatactctacagggggagtcagtctcagtcaggacacagcatggacatgagggtccccgctcagctcctgggctcctgctactctggctccgaggtgccagatgtgacattcagatgacccagtctccatcctccctgtctgcatctgtaggagacagagtcaccgtcacttgccgggcaagtcagagcattaacaagaatttaaatggtatcagcagaaacctgggaaagtccctaaggctcctcatctatgctgcttccactttgctaagntgggtccatcaaggttcagaggcacgtgatntaggacagaattcgctctcaccatccgtagcagtctagacaacctgaagtattttgactaacttaactactgtacaaacgagtagttaacgagttcggtactttcaacgtttaccgggcggtaacgggtaccgaaggtcgggaactaagttacgaaaacgtaacgtggtacgggtcctggtacctaacctagttattaccg

SEQ ID NO: 291375 - DNA, 690 bp, Homo sapiens
  misc_feature: GYAE6OF02G6OVL.35.8.A08.1.454.CMB.1.raw
tcagtacagatcgtcacgaccggtgctcgatttagcatactctacagggggagtcagtctcagtcaggacacagcatggacatgagggtccccgctcagctcctggggctcctgctactctggctccgaggtgccagatgtgacattcagatgacccagtctccatcctccctgtctgcatctgtaggagacagagtcaccgtcacttggccgggcaagtcagagcattaacaagtaatttaaattggtatcagacagaaaccgtagggaaacgtccctaggccttacctcgtatcgtaatcgctgtccttcctacgttttgactaaggtacgttacggggtcccagtacgtaaaggttacgtaaggacggtacgtacgtaggtaacgttacgtacggggtaacctaaggtaaactttccggacgttacctaccaacccgacttaccgacgtaccgtacgttcgtacgacctaaccgtaggtaaacgttacgttttacggaccttaaaccgttaacttaccgttacgtaaccgtaaacgtaacgttaacggttaacgtagttacggttacctttacgtaccgtttacgggaccgggtaacgggtaccgtaaggtacggtaacgtaacgtaaaccgtaaaccgtacgttacggtcggtacggttaccgaccgtaaccgtacttcgttaccg

SEQ ID NO: 291376 - DNA, 816 bp, Homo sapiens
  misc_feature: GYAE6OF02HZV4P.35.8.A08.1.454.CMB.1.raw
  modified_base (192)..(192): a, c, t, g, unknown or other
  misc_feature (192)..(192): n is a, c, g, or t
tcagtacagatcgtcacgaccggtgctcgatttagcatactctacagggggagtcagtctcagtcaggacacagcatggacatgagggtccccgctcagctcctggggctcctgctactctggctccgaggtgccagtatgtgacattcagatgacccagtcctccactcctcctgtctgcatctgtagganacagatcaccgtcacgttggccgggacaagtcagagctaattaaacaagtaatttaataggtatactagacaagaacgtagggaactccgtaaggcctccctacgacttactacgtgtctcgtccttcctactttacgacgtaacggtagttcggggtacctagtacgtaacggttcaaggtacggactacgtaggactacggtacggtacgtaacggtaacttcggtcctaccgtacgtacctacgtaaccgtacgtaccgtaacgttacctaaccgtaaaccgttaaggtaacgtttaacgtttacggttaaacccttaaaccgttttaaccgttaaaccgttaggttaaacccgtaaaccgttaaccgttaacccgtttaacccggtaacccggggtaaccccctttaaccggttttaacccgttacccccggttttacccggggttaacccccgttaacgggggtaacccccttaaaccggtaacccgttttacccggaaacccgttttaacccgttaaaccccggttaaacccggttaaaccggttcccgggtttaaccgggttacccgttacccggttaacccgttaacccggtaccttttacccgggtttaccccgg

SEQ ID NO: 291377 - DNA, 588 bp, Homo sapiens
  misc_feature: GYAE6OF02JQQ2G.35.8.A08.1.454.CMB.1.raw
  modified_base (215)..(215): a, c, t, g, unknown or other
  misc_feature (215)..(215): n is a, c, g, or t
tcagtacagatcgtcacgaccggtgctcgatttagcatactctacagggggagtcagtctcagtcaggacacagcatggacatgagggtccccgctcagctcctggggctcctgctactctggctccgaggtgccagatgtgacattcagatgacccagtctccatcctcctgtctgcatctgtaggagacagagtcaccgtcacgttgccgggnaagtcagagcaattaacaagtaatttaaattggtatcagcaagaaactggaagtacctaggctctcactcgtatgctgcttcctactttcgactaagtagtcggggtcccaagtacgaaggttcagaggactacgtaggtatcgaggacaacgtaattcgactcgtacaccgtatcgagactacgtctcgtaccaaccgtagtaacgtattttacaaccgttaactttactaacgttcgtaacaactaaggttactaacgtacggttacgttacttacgtaccgtttacgggacggtaacggtacgtaagggtacgaacgtaacgtacgaaaccggtacgttaggcgtactacgaacctacacgttcgttacg

SEQ ID NO: 291378 - DNA, 655 bp, Homo sapiens
  misc_feature: GYAE6OF02FEQ4A.35.8.A08.1.454.CMB.1.raw
  modified_base (145)..(145): a, c, t, g, unknown or other
  misc_feature (145)..(145): n is a, c, g, or t
  modified_base (282)..(282): a, c, t, g, unknown or other
  misc_feature (282)..(282): n is a, c, g, or t
  modified_base (452)..(452): a, c, t, g, unknown or other
  misc_feature (452)..(452): n is a, c, g, or t
  modified_base (500)..(500): a, c, t, g, unknown or other
  misc_feature (500)..(500): n is a, c, g, or t
tcagtacagatcgtcacgaccggtgctcgatttagcatactctacagggggagtcagtctcagtcaggacacagcatggacatgacgggtccccgctcagctccgtgggctcctgctgctctggctcccgaggtgaccaaatgtnacatccagcctcgacccagtcctccctccacctgtctgcatcgtaggtaaggagaacgccgtaccaccctatccgtaccgttccggacccggtaaccagtacgaagtagttagttagttagttgggtcgctaggtanacgagacaacggaaaccgaggtaaaccctccctaacgtctagtacttacgttaacgcgttacttaagttaggaggtcggtcggacctagtacgtaggttcgaggcgagtaggtagtacgtcggacgtactacgtcttacgactaccacctacctacgtacccacgtaccncgtacgacgcgtactagttactactttaccgttacaccgtaactttancgacctaacgaagttagtcgtcgttacgttcctcgttaccgtaccggttccgacggtaacgactaggtacgactaacgtactaacgcggttacggacgtacctacggtacctacttcgttaccgttacccgttactccctaccgttaccctaccg

SEQ ID NO: 291379 - DNA, 642 bp, Homo sapiens
  misc_feature: GYAE6OF02JJDBJ.35.8.A08.1.454.CMB.1.raw
  modified_base (282)..(282): a, c, t, g, unknown or other
  misc_feature (282)..(282): n is a, c, g, or t
tcagtacagatcgtcacgaccggtgctcgatttagcatactctacagggggagtcagtctcagtcaggacacagcatggacatgagggtccccgctcagctcctggggctcctgctactctggctccgaggtgccagatgtgacattcagatgacccagtctccatcctcctgtctgcatctgtaggagacagagtcaccgtcacttgccggcaagtcagagcaattaacaagtaatttaaatggtatcagacagtaaaccgtggaaactcctaggctcctnatctatcgctgtccttacctactttcggactaaggtacgttaccggggtaccctaagtaccgtaagggttccgaggtaacggctaacgtgggtacttacggtacggggaaactaacggtaaacgtttccggaccttactacccgaacctatcccgaaaggtccaaggtctacgaaccaaccgtgtaaagtacttttaggaacctaactttactactagtaacctaaagtcgtaaagtttaccaggttacgtccgttactaaccggttcggggaacgtagggaccgtagggtacggtaccaaagtccgtaaaacgtacgttaggtacggtaccgtagttaccaaccgttagtcccgttacg

SEQ ID NO: 291380 - DNA, 570 bp, Homo sapiens
  misc_feature: GYAE6OF02GPNMW.35.8.A08.1.454.CMB.1.raw
tcagtacagatcgtcacgaccggtgctcgatttagcatactctacagggggagtcagtctcagtcaggacacagcatggacatgagggtccccgctcagctcctggggctcctgctactctggctccgaggtgccagatgtgacattcagatgacccagtctccatcctccctgtctgcatctgtaggagacagcgtcaccatcacttggccggcaagtcagagcattggcagttctttaaattggtatcaacggaaaccagggaaacgcccctaaactcctgatctatgctgcatcctattttgactaaaggtcgggggtacccgctaaggttcgagtggcaggtggagtcgtagggacagtaattcactctacaccatcagcagtcctagccaacgtgaagtattttcgactaaccttacttaattcgtacaaacgtagtaacgttaacgtacgtaaccgcccgtacgtacgtcgacgtccgttaccggaccgaacgggtaccaccggtaacgtaggtaagaacgtttaaaagacgttaggtcggtacctaggacacccgtattaccg

SEQ ID NO: 291381 - DNA, 612 bp, Homo sapiens
  misc_feature: GYAE6OF02HC5YR.35.8.A08.1.454.CMB.1.raw
  modified_base (217)..(217): a, c, t, g, unknown or other
  misc_feature (217)..(217): n is a, c, g, or t
tcagtacagatcgtcacgaccggtgctcgatttagcatactctacagggggagtcagtctcagtcaggacacagcatggacatgagggtccccgctcagctcctggggctcctgctactctggctccgaggtgccagatgtgacattcagatgacccagtctccatcctccctgtctgcatctgtaggagacagagtccaccgtcacttggccgggnaagtcagagcaattaacaagtaatttaaattggtatcagacaagaaaccgtagggaaacgtccctaaggctccgtcatctatgctcgcttcctactttgacaagtagtcggggtacccagtacgaaggttcaggacggacacgtaggtatcgtaggacagtaattccgctctacacctatacgagctagtctacgacctaaccgtagtaagttacttttacgacttaacgtttacctactacgtactaaacgtaacgtagtttacgtaggttacgtactttaccgtacgtttaccggggacggtaacgggtaccgtaagggtcggaaccgtaacgtaaccgtaaaacggtacgttaggtacggtacgtacgtacctaaccgtacgttccgttacg

SEQ ID NO: 291382 - DNA, 552 bp, Homo sapiens
  misc_feature: GYAE6OF02G3DZI.35.8.A08.1.454.CMB.1.raw
  modified_base (193)..(193): a, c, t, g, unknown or other
  misc_feature (193)..(193): n is a, c, g, or t
  modified_base (196)..(196): a, c, t, g, unknown or other
  misc_feature (196)..(196): n is a, c, g, or t
  modified_base (207)..(207): a, c, t, g, unknown or other
  misc_feature (207)..(207): n is a, c, g, or t
  modified_base (227)..(227): a, c, t, g, unknown or other
  misc_feature (227)..(227): n is a, c, g, or t
  modified_base (397)..(397): a, c, t, g, unknown or other
  misc_feature (397)..(397): n is a, c, g, or t
tcagtacagatcgtcacgaccggtgctcgatttagcatactctacagggggagtcagtctcagtcaggacacagcatggacatgagggtccccgctcagctcctggggctcctgctactctggctccgaggtgccagatgtgacattcagatgacccagtcctccatccctccctgtctgcatcgtgtagganacngagtcaccgtnacttgccgggcaagtcagancattaacaagaatttaatgtatcagcagaacctgggaaagtccctaggcctacctcattctatgctgtccttcactttgcaagtactcgggtccatcaagttcagtggacagtgctcgtgggactagacgttcactcacaccatcagcagccttgactagtctagaagtnttttgacttagtttattctgtaccagtctagttatacgtattaacgtcggccttacggtacggtacccgtttacgggaccgaaacgggtaccgtaagggtacggtaacggtacccgaacggtaccgttaggtaccggtactacggacctaacccg

SEQ ID NO: 291383 - DNA, 1074 bp, Homo sapiens
  misc_feature: GYAE6OF02I7STS.35.8.A08.1.454.CMB.1.raw
tcagtacagatcgtcacgaccggtgctcgatttagcatactctacagggggagtcagtctcagtcaggacacagcatggacatgagggtccccgctcagctccgtggggctcctgctactctggctccgaggtgccagatgtgacattcagatgacccagtctccatcctccctgtctgcatctagtaggagacgagtacgtctaccgtcacgttcggccgggacaagtcagacgctaattaaacaagtaaattttaaagttggtaactacgtaacgacaaacggtaaaacccgttaggggtaaaaccgttccccggtaaaggtcccttacccgtacctaacgttacgttacgtccggtacctttacggttcccttttacccgtttaacgttttacggaaaccgttaaaggtccggggtttaccgggggttaacccccttaaaggttacccgttaaaacggggtttaccgaaacgggtaaccgggtaaccgttacccgggttaagggtacccgtttaaccggggttaacgggggtaaaaccttaaacgggttaaaacccgttttcccgggttacccgtttaccccgtaaccccttaaaaccccggttaaacgtttaaccccggaaccgggttaaccgtttaaaccggggttacccctttaggggaaaccccccttaaaaccgggttttacggtaaaacgggtttttaactttttaaccgggtaaaccctttaaaacccgggttttttaaccttaaacccggttttaaccgtaaccgttaaaaaaccggttacgggtttaaacccgggttttaaaccggttaacgggggttttacccgttttaaccccgtttttaaccggggtttaaaccggttttttaccggggggaaaacccggggttaacccggggggttaaaaccgttaaaccgggggggttacccgtaaaacccgggtttaaacccgggttaaacccggttaaaaaaacccgggtttacccgggttagggttaacccgggttacccgtttacccgggaaacccttaacccccggtttagttttacccccgtttaaccggg

SEQ ID NO: 291384 - DNA, 702 bp, Homo sapiens
  misc_feature: GYAE6OF02JK511.35.8.A08.1.454.CMB.1.raw
  modified_base (159)..(159): a, c, t, g, unknown or other
  misc_feature (159)..(159): n is a, c, g, or t
  modified_base (260)..(260): a, c, t, g, unknown or other
  misc_feature (260)..(260): n is a, c, g, or t
tcagtacagatcgtcacgaccggtgctcgatttagcatactctacagggggagtcagtctcagtcaggacacagcatggacatgagggtccccgctcagctccgtgggctcctgctactctggctccgaggtgccagatgtgacattcgagatgacccngtctccatccctccctgtctgccattctgtaggagacagtatccaccgtcacgttcgccgggacaagtcagagcaattaacaataatttaatgtatacagnagaaacgtagggaagtcccgtaggcctacgtctatctatgtctgtcttcctagtttcgactaagtcgtacgggtcctagtacctaagggttacaggtacgccgtacgttacggattcgtagggtaacctaacggttaacgtttccgtaccttacccgtaaccgtaaccctacgttaccgaacgtcctaggtcgtacggtaaccctaccgttaggaaacgttttagtttaaccgtacgttaaacccgttttaactacccggtttagttaacccaaaccgttaggttaaccgtttaacgtacggttacggttacctttaccgttaacggttttaccggggaacgggttaaccgggtacggaaaggttccggaatacgttaaaccggtaaaccggtactttaggggtacgtcccgtagacccggtaaccttcgtacgtttaccgg

SEQ ID NO: 291385 - DNA, 664 bp, Homo sapiens
  misc_feature: GYAE6OF02FV4GO.35.8.A08.1.454.CMB.1.raw
  modified_base (218)..(218): a, c, t, g, unknown or other
  misc_feature (218)..(218): n is a, c, g, or t
tcagtacagatcgtcacgaccggtgctcgatttagcatactctacagggggagtcagtctcagtcaggacacaacatggacatgagggtccccgctcagctcctggggctcctgctactctggctccgaggtgccagatgtgacatccagatgacccagtcctccggcctccctgtctggtgctgtcggagacagactgaccatcacttggcccgganaacgtcacgtaccgttcgcgtacttaagtttaaagttggtatcgagtacaagtaaaccgagggaacccgcccctagagctcgctcgctctatactgtactcttagtttccattcgttacgggtccctattcgtaaggttcaggttcggctaggttcggttgtcgggaactagtactttccgaaccttcgtacctacgtatcgtacgaccgtacgttcgtacgtacctaaaccgtagaacgttagtttacggtactaactttaaaccttacgtttaacctcgtaacctaacgaccgttaaccgttaccgggacccgtacccttacgtttcccgtaccgtttcccgggaccctacggaacccacgttaccgtacgaaccgttccgaacggtaccgtaacgttcgggaccgtacgtcgaccctaccgtagttccgttagtcttaccccg

SEQ ID NO: 291386 - DNA, 703 bp, Homo sapiens
  misc_feature: GYAE6OF02GRGRX.35.8.A08.1.454.CMB.1.raw
tcagtacagatcgtcacgaccggtgctcgatttagcatactctacagggggagtcagtctcagtcaggacacagcatggacatgagggtccccgctcagctcctggggctcctgctactctggctccggaggtgccagatgtgacattcagatcgacccagtctccatcctccctgtctgcatctggtaggagactagacgtcaccgtctacttcggccgggactaaggtcaggacgctaattaaacaagtaaatttaaagttggtatcaagtacgaacgtaaaccgtagggaaaccgtacccgtaggtcctacccgtactaacttcgtaagtcggctacgttcctttaccctacgtttcgaacgtaaggtaccggtacgggtaccctagtaccgtaaaggtccgaaggtacggactacgtaggacgtcgtacgggtaactaaggtaacgtttccgactccgtaccaactatacgacggtactacgtccgtacgtacctaaaccggtagttaaacgttacgtttacgtaaccttaaaccgtttacttacgtacgtacgtaaacgtacggttaacgttacgtaacggttgtaccgttcgttaccggttacggggaccggtaacgggtaccgtagggtacgaacgttaactaaccgaaacggttaacgtcggacggtacacggactaacccttagtccttaccgg

SEQ ID NO: 291387 - DNA, 684 bp, Homo sapiens
  misc_feature: GYAE6OF02FYAEC.35.8.A08.1.454.CMB.1.raw
tcagtacagatcgtcacgaccggtgctcgatttagcatactctacagggggagtcagtctcagtcaggacacagcatggacatgagggtccccgctcagctcctggggctcctgctactctggctccgaggtgccagatgtgacattcagatgacccagtctccatcctccctgtctgcatctgtaggagacagagtcaccgtcacttcggccggacaagtcaggacgctagttggctagtttactttaaattcggtatacgaaacggaaaccgaaggaacgacccctaaactctagactctatgctgcactctatttcgacgtaacggtcgggtccgacgtaacggttcgacgtcggctaggtggtatcgtaggacagtaactcgacttctaccactactacgtacgactacgtctacgactaaccgttagtaaacgtttacgtttacgaacctaaccgttacttaacgttacgtaaccgtaaacgtaacggtaacgtttaacgaaccgggttaccggacccgtaacgtaacgtaccgtaacggtcccggtttaaccggaacccggtaaacggggtaccgtaaaccgggtaccggttaacgggtaaacggttaaaaccggttaaaaggtaaccggttacgggtacggtacgttaccgacgtaacccgtattccggtttaaccg

SEQ ID NO: 291388 - DNA, 968 bp, Homo sapiens
  misc_feature: GYAE6OF02IYLRK.35.8.A08.1.454.CMB.1.raw
tcagtacagatcgtcacgaccggtgctcgatttagcatactctacagggggagtcagtctcagtcaggacacagcatggacatgagggtcccgctcagctccgtgggctcctgctactctggcctcgaggtcgccagatgtgactattcagatcggaacccagttcctcctactcccgttcctgtaccgtgactaacttctagggtacggagtacgaagacgtaccgaccgttacgtacgtttcggaccggggtaacaacggtccgaagacgtactaagtttaaacgaaagttaaagtttaaagttcggtactaacgaacgacgtaaacggtaaacccggttaggggaaaaccttcccgtaaggtccttaccgtacgtaacgttacgttaagccggttcttcgttaaccccgttttaccgttaaccggttttacgaaccgtttaagggttaccgggttaccgggttaccccttaaaggttacccggtttaaaagggtccgtaaaccgggttaacggacccgtttaaacggtcggttaaacgtttacggaaaccgggggttaacgtaaaccgggtttaaacccgttcggtacccgttaaccgttaacccggaaccgtttaacgaaccggtaccgtaacggtttaccggttaccggttaaaccgtaaccgtttaaaccgggtaggttttaaaccgtttaaggtttacccgttaaccgttttaaaacccttcgttaaccggaaccggtttaacctaaaacgggagttttaaaaccggggtccctttaaggggtttacccgttaccgtttttaaccgggtaacccggggtttccggggaaaacgggtttaaccggggtaacgtacggtttacccggaaaaccggttaccgtaaaaccggtaacgggttaacccggttcgggtaacgtccccggtaaaacggtcctaaaacccgtttgttacccgttacccgg

SEQ ID NO: 291389 - DNA, 766 bp, Homo sapiens
  misc_feature: GYAE6OF02IX5CA.35.8.A08.1.454.CMB.1.raw
  modified_base (122)..(122): a, c, t, g, unknown or other
  misc_feature (122)..(122): n is a, c, g, or t
  modified_base (205)..(205): a, c, t, g, unknown or other
  misc_feature (205)..(205): n is a, c, g, or t
  modified_base (673)..(673): a, c, t, g, unknown or other
  misc_feature (673)..(673): n is a, c, g, or t
tcagtacagatcgtcacgaccggtgctcgatttagcatactctacagggggagtcagtctcagtcaggacacagcatggacatgacgggtcccgctcagctccgtggggctactgctactcnggctccggaggtgaccagatgtgactattcagatcgaccctagtcctaccactcccgtccctagtctgactatcgtagtaganacgagacgtcaccgtcacgttcgaccggactaagtcagagtactaactaaacgaagtaaagttttaaagttcggtaatacgaacgtacgtaaacggtaaaccgtacgggtaaaaccgttccccgtaaggtaccccttaccggtactaacgtttaccgtaagtacggtccgtttaaacggttacccttttacccgaaacgttttacggaacgttaaacgggtaaccggtttaccggggtaaccccttaaaggtaaccgttaaacggggttacgaaacggttaaccgggtacctttaaacgggttcgggtaaacgttccgggtaacgggttaaaccaaagggttttacccttaccgggtacctttaacgtaccgtaaactacgttaccgacgtacgtacgttactacggaacctaacgtagtaacgttatttacgaacttacttagtactagtaacaagtacgtagtacngtcgtacttcgtaacgtgggaccgaggactaggagtaacagtaacgtaaacgtaagtcggtacgtacgtacgttaccaacggttactgttacc

SEQ ID NO: 291390 - DNA, 725 bp, Homo sapiens
  misc_feature: GYAE6OF02H239H.35.8.A08.1.454.CMB.1.raw
  modified_base (95)..(95): a, c, t, g, unknown or other
  misc_feature (95)..(95): n is a, c, g, or t
tcagtacagatcgtcacgaccggtgctcgatttagcatactctacagggggagtcagtctcagtcaggacacagcatggacatgagggtccccgntcagctcctggggctcctgctactctggctccgaggtgccagatgtgacattcagatgacccagtctacatcccgtcctgtctgccattctagtaggagacagacgtccaccgtcattcggcggacaagtcagagacaattaaacaagtaagtttaaattaggtatacagcaaacgaaacgtagggaataccgtaaggtcctccgtacacgttactatgactgtaccttcctactttagacgtaaaggtacgtacggggtaccattaaccgtaaggttacctaagggacgtacgtaacgttacggaacttcgggtaagggtaacgaacgttaagttccggtaaccttctaaccgtaaccctacgtttaccgagaacccgtagttaccgagtaacccgtaacgttaggtaaaagttacgttttaacgaacttaaacctttaaccgtacgttaactaaccgtaaacgtaggtaacgtttaaaccgacggtttcgtaccgtttaccgacggttttaccgggaccgggttaacggtaaccggtacggtaaacgggtctaaaccgtaaccgtaaaacggttaacttacgggtacgttcgtaacggaccctaaccgtaacgttacgtttaacccgg

SEQ ID NO: 291391 - DNA, 957 bp, Homo sapiens
  misc_feature: GYAE6OF02IHXEI.35.8.A08.1.454.CMB.1.raw
tcagtacagatcgtcacgaccggtgctcgatttagcatactctacaggggggagtcagtctcagtcaggacacagcatggacatgagggtccccgctcagctccgtggggctcctgctgctctggctcccaggtgaccaaatgtgacatccagctgaccctagtcctccctccaccctgtctgctattctggtaggaagaacgccgtacaacctatacctaccgttcggacccggacctagtcgaaggtacgttaatttaggttaacgttttggggtttacggacccgttagggttactacgtaacggtaccaaacggaaaacccgaaacggggtaaaaccctaacccccccgttaaaacgttcccgttaagtacgttttaaccggttttaacggggtccgtttaccgttaacgttttaaggacggtacgggttaccgggggtacccctaaagttaccggttaaacgggttccgaacgggtccgggtaccgtaggttcgggtaatttccgggtagggaaccttacggtacttaccgtaccttacctaccacccgtactacccgaccgaacgttcccggtacgaccctacggtaccccgttaggtacgtttacggttaacgttttacgaccccgtttaaacgtttaacctttaccgttaaccggtaacccgtaaacggtttacgggtaacggtttcggggtttaacctttacccggttttacccggttaacccgtttacccggggtttttaaccccggggaacccccgggttaaaggggttaaaaccccgtttaaaggggttaaccgttaaacgttaaccggttaacccgttaaaaccggtttaacggttcgggtaaccgggttaccttaaccccggttaaccgttaacccggttactttaccgggttttaccctttaacccggttacccttacccggtttaccccgttaacccccgg

SEQ ID NO: 291392 - DNA, 743 bp, Homo sapiens
  misc_feature: GYAE6OF02FRJF0.35.8.A08.1.454.CMB.1.raw
tcagtacagatcgtcacgaccggtgctcgatttagcatactctacagggggagtcagtctcagtcaggacacagcatggacatgacgggtccccgctcagctcgtgggctcctgctactctggctcgaggtgccagatgtgactacttcaagtactcgaccctagtcctccaacttccctccctggtctcgactactcgttaggtacggagtaccgtagaacgtccgtacccgtactacggttcggaccgggacaacgtcgaacgacgtacctaaacttaaaacgtaaagttaaaattttaaacggttacggtaactaccgtaacgggtaccgtaaacggtaaaacccgggtacgggtaaaaccgtcccggtaacggtccttaccctacgtaacttcgtacgtccgtcgttaccgtccttttacccgtattacggaacctaagggtaccgttcggaccctaggttactacggttacgacggtacgacgtacgtacggatccggtaacggactacgtacgttcgtacccgtaccacctaacgtctaacgcgtaaccgtcggttacaccggttaacacggttaagtaacgttactttacccgaaacttaccgtttagtacgtacgttaacgaagtacgttacgaccgacgtccggaccctagtactcgtaacggttccaccggaacgtacggtaacgaccggttagtaacggaattaacgacgtagttcggacgctccggtatcc

SEQ ID NO: 291393 - DNA, 1037 bp, Homo sapiens
  misc_feature: GYAE6OF02HDAQ4.35.8.A08.1.454.CMB.1.raw
tcagtacagatcgtcacgaccggtgctcgatttagcatactctacagggggagtcagtctcagtcaggacacagcatggacatgagggtccccgctcagctcctgggctcctgctactctggctccgaggtgccagatgtgacattcagatgacccagtctccatcctccctgtctgctatcgtgtaggagacagtagtccaccgtcacgttggccgggtacaagtcaagacgctaattaaacaagtaatttaaagttaggtaattacaagctaagaaaccgtagggtaaacgtcccgtaggctccctacgattactatcgtctgtcttcctactttcgactaagacgtacggggtacccagttaccgtaaacggttacgaacggtaacggtaccgtaacgttacggggtaacttacggtaacggggtaaccgtaacggtaaaacgttttcccggtacccgtttacccggtaacccttaaaccccgtaaacgtttaccgaaacggttaacccgtaaacggtttacccttaacggggttaaacccttaaaaccccggttaacgggttaaaaaccggttttaaccggttttttaaacggtaaacccccgtttaaaacccgtttttaaacccgttaaacccgttttaaacgggtttaaccccgttaaaacggttaaacccggtttaaacgggtttttaaacccgtaacggggttttaacccggtttaaacccgtttttaaccccgggttaaacccggtttttaacccgggggggtaaaccggggtttaaaccccggggggggttaaaaaccccccgggtttaaaaccggggggtttaacccgggggtttaaaacccccggggttaaaaaccggttttaaaacccccgggttaaaaaaacccccggggtttaaaaccgggtttttaaacccgggggttttaaacccggggggtttaaacccgtttaaaccccggggttaaacccccgttaaacccccggggttttaaccccgttttaacccgggttttttaaacccccggg

SEQ ID NO: 291394 - DNA, 594 bp, Homo sapiens
  misc_feature: GYAE6OF01DYGDI.25.70.G04.1.454.CMB.1.raw
  modified_base (338)..(338): a, c, t, g, unknown or other
  misc_feature (338)..(338): n is a, c, g, or t
  modified_base (531)..(531): a, c, t, g, unknown or other
  misc_feature (531)..(531): n is a, c, g, or t
  modified_base (537)..(537): a, c, t, g, unknown or other
  misc_feature (537)..(537): n is a, c, g, or t
  modified_base (541)..(541): a, c, t, g, unknown or other
  misc_feature (541)..(541): n is a, c, g, or t
  modified_base (556)..(556): a, c, t, g, unknown or other
  misc_feature (556)..(556): n is a, c, g, or t
  modified_base (559)..(559): a, c, t, g, unknown or other
  misc_feature (559)..(559): n is a, c, g, or t
  modified_base (564)..(564): a, c, t, g, unknown or other
  misc_feature (564)..(564): n is a, c, g, or t
  modified_base (568)..(568): a, c, t, g, unknown or other
  misc_feature (568)..(568): n is a, c, g, or t
  modified_base (572)..(572): a, c, t, g, unknown or other
  misc_feature (572)..(572): n is a, c, g, or t
  modified_base (574)..(574): a, c, t, g, unknown or other
  misc_feature (574)..(574): n is a, c, g, or t
  modified_base (576)..(576): a, c, t, g, unknown or other
  misc_feature (576)..(576): n is a, c, g, or t
  modified_base (578)..(578): a, c, t, g, unknown or other
  misc_feature (578)..(578): n is a, c, g, or t
  modified_base (581)..(581): a, c, t, g, unknown or other
  misc_feature (581)..(581): n is a, c, g, or t
  modified_base (583)..(583): a, c, t, g, unknown or other
  misc_feature (583)..(583): n is a, c, g, or t
  modified_base (586)..(586): a, c, t, g, unknown or other
  misc_feature (586)..(586): n is a, c, g, or t
  modified_base (589)..(589): a, c, t, g, unknown or other
  misc_feature (589)..(589): n is a, c, g, or t
  modified_base (591)..(591): a, c, t, g, unknown or other
  misc_feature (591)..(591): n is a, c, g, or t
  modified_base (593)..(593): a, c, t, g, unknown or other
  misc_feature (593)..(593): n is a, c, g, or t
tcagactgtacagtcacgaccggtgctcgatttagtgtagtgtgaagggaaaggggctggtgtgggtctcacgtcttaataatgatggcagtaccacaaattacgcggactccgtgaagggccgattcaccatttccagagacaacgccaagaacacggtgtatctgcaaatgagtagtctgagagccgaggacacggctgtctattactgtgcgaagaggagcatagcagcagctggtctttgactggcgtgggaccagggtaacccttggtccaccgttctcctcgacgtcctcccgaaccgacgggccctacgttccggttcccgtttcccccgngggtcccgcccgtcggtacctccgaagggtaccgccaaccgtccggagacgccgacgacggccggcccgttggggcctcggtccgttagggaccgtaaacggtaccttaccgtccacgttacggactaggtacccgtgggtacgggcgggtacctacggaccggtaaacgggctaccgttaaagacgggcacncgagtngcgngacgcgcgtcgctcngcncgcgntctngtcngntncnacncncgncgngngng

SEQ ID NO: 291395 - DNA, 216 bp, Homo sapiens
  misc_feature: GYAE6OF02J3W65.25.70.G04.1.454.CMB.1.raw
  modified_base (212)..(216): a, c, t, g, unknown or other
  misc_feature (212)..(216): n is a, c, g, or t
tcagactgtacagtcacgaccggtgctcgatttagtgtagtgtgaagggaagggaccacggtcaccgtctcctcagcctccaccaagggcccatcggtccttcccctggccaccctcctccaagagcacctcgtggggcacagcggccctgggctgcctggtcaaggactacttccactgtacagtctgagcgggctggcaaggcgcatagnnnnn

SEQ ID NO: 291396 - DNA, 211 bp, Homo sapiens
  misc_feature: GYAE6OF02GIAXP.25.70.G04.1.454.CMB.1.raw
  modified_base (210)..(211): a, c, t, g, unknown or other
  misc_feature (210)..(211): n is a, c, g, or t
tcagactgtacagtcacgaccggtgctcgatttagtgtagtgtgaagggaaagggaccacggtcaccgtctcctcagcctccaccaagggcccatcggtcttcccctggcaccctcctccaagagcacctctggggcacagcggccctgggctgcctggtcaaggactacttccactgtacagtctgagcgggctggcaaggcgcatagnn

SEQ ID NO: 291397 - DNA, 467 bp, Homo sapiens
  misc_feature: GYAE6OF02IQ9W1.25.70.G04.1.454.CMB.1.raw
  modified_base (435)..(435): a, c, t, g, unknown or other
  misc_feature (435)..(435): n is a, c, g, or t
  modified_base (443)..(467): a, c, t, g, unknown or other
  misc_feature (443)..(467): n is a, c, g, or t
tcagactgtacagtcacgaccggtgctcgatttagtgtagtgtgaagggaaaggggctggtgtgggtctcacgtcttaataatgatggcagtaccacaaattacgcggactccgtgaagggccgattcaccatttccagagacaacgccaagaacacggtgtatctgcaaatgagtagtctgagagccgaggacacggctgtctattactgtgcaagaggaggcatagcagcagctggctttgactgctggggccagggaacccctggtcaccggtctcctcagcctccaccaagggccccatccggtcttccccctggccgcccctgcctccaggacgccaccctccgagacgccacgagccggccctggggcctggcctgggtcaacggactaccttccacgtgtaccagtctgagccgggctggcaagggcncatacggnnnnnnnnnnnnnnnnnnnnnnnnn

SEQ ID NO: 291398 - DNA, 218 bp, Homo sapiens
  misc_feature: GYAE6OF01ADK85.13.78.H01.1.454.CMB.1.raw
  modified_base (216)..(218): a, c, t, g, unknown or other
  misc_feature (216)..(218): n is a, c, g, or t
tcagtcacgtactacacgaccggtgctcgatttagtgtgagtagttggtttgggccagggagccctggtcaccgtctcctcagcctccaccaagggcccatcggtcttcccctggcaccctcctccaagagcacctctggggcacagcggccctgggctgcctggtcaaggactacttcctagtacgtgactgagcgggctggcaaggcgcatagnnn

SEQ ID NO: 291399 - DNA, 223 bp, Homo sapiens
  misc_feature: GYAE6OF01C7IQH.13.78.H01.1.454.CMB.1.raw
  modified_base (221)..(223): a, c, t, g, unknown or other
  misc_feature (221)..(223): n is a, c, g, or t
tcagtcacgtactacacgaccggtgctcgatttagtgtgagtagtttgggtttggggccagggagccctggtcaccgtctcctcagcctccaccaagggcccatcggtcttccccctggcaccctcctccaagagcacctctgggggcacagcggccctgggctgcctggtcaaggactacttcctagtacgtgactgagcgggctggcaaggcgcatagnnn

SEQ ID NO: 291400 - DNA, 289 bp, Homo sapiens
  misc_feature: GYAE6OF01C5E00.13.78.H01.1.454.CMB.1.raw
  modified_base (286)..(289): a, c, t, g, unknown or other
  misc_feature (286)..(289): n is a, c, g, or t
tcagtcacgtactacacgaccggtgctcgatttagtgtgagtagtttgggtttggggtcccatcaaggttcagcggcagtggatctggcacagacttcattctcaccatcagcagcctgcagcctgaagattttgcaacttattactgtctacaagatcacaattatcctgggacgttcggccaaagggaccaaggtggaaatcaaacgaactgtggctgcaccatctgtcttcatcttcccgcatctgatagtacgtgactgagcgggctggcaaggcgcatagnnnn

SEQ ID NO: 291401 - DNA, 225 bp, Homo sapiens
  misc_feature: GYAE6OF01D3TA9.13.78.H01.1.454.CMB.1.raw
  modified_base (222)..(225): a, c, t, g, unknown or other
  misc_feature (222)..(225): n is a, c, g, or t
tcagtcacgtactacacgaccggtgctcgatttagtgtgagtagtttgggtttgggggccagggagccctggtcaccgtctcctcagcctccaccaagggcccatcggtcttccccctggcaccctcctccaagagcacctctgggggcacagcggccctgggctgcctggtcaaggactacttcctagtacgtgactgagcgggctggcaaggcgcatagnnnn

SEQ ID NO: 291402 - DNA, 288 bp, Homo sapiens
  misc_feature: GYAE6OF01ALE87.13.78.H01.1.454.CMB.1.raw
  modified_base (286)..(288): a, c, t, g, unknown or other
  misc_feature (286)..(288): n is a, c, g, or t
tcagtcacgtactacacgaccggtgctcgatttagtgtgagtagtttgggtttggggtcccatcaaggttcagcggcagtggatctggcacagacttcattctcaccatcagcagcctgcagcctgaagattttgcaacttattactgtctacaagatcacaattatcctgggacgttcggccaagggaccaaggtggaaatcaaacgaactgtggctgcaccatctgtcttcatcttcccgccatctgatagtacgtgactgagcgggctggcaaggcgcatagnnn

SEQ ID NO: 291403 - DNA, 483 bp, Homo sapiens
  misc_feature: GYAE6OF01A4FEC.13.78.H01.1.454.CMB.1.raw
  modified_base (357)..(357): a, c, t, g, unknown or other
  misc_feature (357)..(357): n is a, c, g, or t
  modified_base (372)..(372): a, c, t, g, unknown or other
  misc_feature (372)..(372): n is a, c, g, or t
  modified_base (465)..(483): a, c, t, g, unknown or other
  misc_feature (465)..(483): n is a, c, g, or t
tcagtcacgtactacacgaccggtgctcgatttagtgtgagtagtttgggtttgggctcgtccactgacatggtgacgcgactattgagggacgggctggagtggattggggaaatctatcatagtgggaccacctactacagcccgtccctcaatagtcgcgtcaccatgtcagtggacgagcccaagaaccagttctccctgagcctgacctctgtgaccgccgcggactcggccctatacttctgtgcgagagatcgagatgtgtcatcgcggggcacttttgatatctggggccaagggtcgatggtcatcgtctcttcagcctccaccaaggcccatcggtctcccctggcnccctgctccaggacncacctccgagagcacacgccggccctgggcctgccctggtacaaggcctaccttcctagtacgtgactgagcgggctggacaggcgcagtagnnnnnnnnnnnnnnnnnnn

SEQ ID NO: 291404 - DNA, 335 bp, Homo sapiens
  misc_feature: GYAE6OF01DZUMX.13.78.H01.1.454.CMB.1.raw
  modified_base (295)..(295): a, c, t, g, unknown or other
  misc_feature (295)..(295): n is a, c, g, or t
  modified_base (300)..(301): a, c, t, g, unknown or other
  misc_feature (300)..(301): n is a, c, g, or t
  modified_base (303)..(305): a, c, t, g, unknown or other
  misc_feature (303)..(305): n is a, c, g, or t
  modified_base (307)..(335): a, c, t, g, unknown or other
  misc_feature (307)..(335): n is a, c, g, or t
tcagtcacgtactacacgaccggtgctcgatttagtgtgagtagtttgggtttggggtcccagtcaaggttcagcggctagtggatcgtggcacagaccttcatttctcaccctatcagccagcctgcagcctgaagattttgcaacttattactgttctacaagatcacaattatcctgggacgttcggccaagggaccaaggtggaaatcaaacgactgtggctgcaccatctgtcttcatccttcccgccattctgatagtaaccgtagactgagccggctggcctaaggcncatannannngnnnnnnnnnnnnnnnnnnnnnnnnnnnnn

SEQ ID NO: 291405 - DNA, 519 bp, Homo sapiens
  misc_feature: GYAE6OF01CJBV8.13.78.H01.1.454.CMB.1.raw
  modified_base (508)..(519): a, c, t, g, unknown or other
  misc_feature (508)..(519): n is a, c, g, or t
tcagtcacgtactacacgaccggtgctcgatttagtgtgagtagtttgggtttgggctcgtccactgacatggtgacgcgactattgagggacgggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagacggacccgaaagaggaaagtggctacgatttgggaagtactaactacatggacgtctggggacgaaagggaccaacggtcaaccgtctcctcagcttccaccaacgggccatcggtcctcccctggcgccctgcctcaggacgcaccgtcgtgggggcacgacggccggccctggggcctggccctgggtaccaagggactacgttcctaggttacgtgacgtgaggccgggctgggacgaaggcgcgatagnnnnnnnnnnnn

SEQ ID NO: 291406 - DNA, 487 bp, Homo sapiens
  misc_feature: GYAE6OF01DN8VF.13.78.H01.1.454.CMB.1.raw
  modified_base (402)..(402): a, c, t, g, unknown or other
  misc_feature (402)..(402): n is a, c, g, or t
  modified_base (472)..(487): a, c, t, g, unknown or other
  misc_feature (472)..(487): n is a, c, g, or t
tcagtcacgtactacacgaccggtgctcgatttagtgtgagtagtttgggtttgggctcgtccactgacatggtgacgcgactattgagggacgggctggagtggattggggaaatctatcatagtgggaccacctactacagcccgtccctcaatagtcgcgtcaccatgtcagtggacgagcccaaagaaccagttctccctgagcctgacctctgtgaccgccgcggactcggccctatacttctgtgcgagagatcgagatgtgtcatcggcggggcacttttgatatctggggccaagggtcgagtggtcatcgtctcttcagcctccaccaagggcccatccggtcttccccctggccgccctgcctcaggacgccaccctccgagacgccaacgngccggcccgtgggctcgcctggtcaaggacttacttctagtcgtgactgagcggctggcaggcgcatagnnnnnnnnnnnnnnnn

SEQ ID NO: 291407 - DNA, 308 bp, Homo sapiens
  misc_feature: GYAE6OF01B12UL.13.78.H01.1.454.CMB.1.raw
  modified_base (278)..(278): a, c, t, g, unknown or other
  misc_feature (278)..(278): n is a, c, g, or t
  modified_base (284)..(308): a, c, t, g, unknown or other
  misc_feature (284)..(308): n is a, c, g, or t
tcagtcacgtactacacgaccggtgctcgatttagtgtgagtagtttgggtttggggtcccagtcaaggttcagcggctagtggatctggcacagaccttcattctcaccatcagcagcctgcagcctgaagattttgcaacttattactgtctacaagatcacaattatcctgggacgttcggccaagggaccaaggtggaaatcaaacgactgtgctgcacatctgtctcatcttcccgcatctgatagtacgtgactgagccggctggcaaggcncatagnnnnnnnnnnnnnnnnnnnnnnnnn

SEQ ID NO: 291408 - DNA, 473 bp, Homo sapiens
  misc_feature: GYAE6OF01CDXFR.13.78.H01.1.454.CMB.1.raw
  modified_base (463)..(473): a, c, t, g, unknown or other
  misc_feature (463)..(473): n is a, c, g, or t
tcagtcacgtactacacgaccggtgctcgatttagtgtgagtagtttgggtttgggctcgtccactgacatggtgacgcgactattgagggacgggctggagtggattggggaaatctatcatagtgggaccacctactacagcccgtccctcaatagtcgcgtcaccatgtcagtggacgagcccaagaaccagttctccctgagcctgacctctgtgaccgccgcggactcggccctatacttctgtgcgagagatcgagatgtgtcatcgcggggcacttttgatatctggggccaagggtcgatggtcatcgtctcttcagcctccacaaggcccatcggtcttcccctggcgccctgctccgaggacgcacctcgagagcacagcggccctgggctgccctgggtcaaggactacttcctagtacgtgactgagcgggctggacgtaaggcgcatagnnnnnnnnnnn

SEQ ID NO: 291409 - DNA, 300 bp, Homo sapiens
  misc_feature: GYAE6OF01C6RN3.13.78.H01.1.454.CMB.1.raw
  modified_base (289)..(289): a, c, t, g, unknown or other
  misc_feature (289)..(289): n is a, c, g, or t
  modified_base (294)..(300): a, c, t, g, unknown or other
  misc_feature (294)..(300): n is a, c, g, or t
tcagtcacgtactacacgaccggtgctcgatttagtgtgagtagtttgggtttggggtcccatcaaggttcagcggcagtggatctggcacagacttcattctcaccatcagcagcctgcagcctgaagattttgctaacttattactgtctacaagatcacaattatcctgggacgttcggaccaaagggaccaaggtggaaatacaaaacgaactgtggctgcaccatctgtcttcatccttcccgctatctgatagtacgtgactggagcgggctggcaaggccgnatagnnnnnnn

SEQ ID NO: 291410 - DNA, 305 bp, Homo sapiens
  misc_feature: GYAE6OF01A27MD.13.78.H01.1.454.CMB.1.raw
  modified_base (254)..(254): a, c, t, g, unknown or other
  misc_feature (254)..(254): n is a, c, g, or t
  modified_base (284)..(305): a, c, t, g, unknown or other
  misc_feature (284)..(305): n is a, c, g, or t
tcagtcacgtactacacgaccggtgctcgatttagtgtgagtagtttgggtttgggtcccatcaaggttcagcggcagtggatctggcacagacttcattctcaccatcagcagcctgcagcctgaagattttgcaacttattactgtctacaagatcacaattatcctgggacgttcggccaaagggccaaggtggaaatcaaaacgatgtggctgcaccatctgtctcatcttcccgcatctgatagtacgngactgacgcgggctgccaaggtcgcatagnnnnnnnnnnnnnnnnnnnnnn

SEQ ID NO: 291411 - DNA, 322 bp, Homo sapiens
  misc_feature: GYAE6OF01AQ9NN.13.78.H01.1.454.CMB.1.raw
  modified_base (266)..(266): a, c, t, g, unknown or other
  misc_feature (266)..(266): n is a, c, g, or t
  modified_base (305)..(322): a, c, t, g, unknown or other
  misc_feature (305)..(322): n is a, c, g, or t
tcagtcacgtactacacgaccggtgctcgatttagtgtgagtagtttgggtttggggtcccatcaaggttcagcggcagtggatctggcacagacttcattctcaccatcagcagcctgcagcctgaagtattttgctaacttattactgtctaacaagatcaactaattatccgtgggacgttcggaccaagggaccaaggtgaaatcaaacgaactgtggctgacaccatctgtcttcactccttcccgcatctgatagtacgngtactggaggcgggctcgggacaacgggcgcaagtacgnnnnnnnnnnnnnnnnnn

SEQ ID NO: 291412 - DNA, 297 bp, Homo sapiens
  misc_feature: GYAE6OF01DYWDP.13.78.H01.1.454.CMB.1.raw
  modified_base (274)..(274): a, c, t, g, unknown or other
  misc_feature (274)..(274): n is a, c, g, or t
  modified_base (290)..(297): a, c, t, g, unknown or other
  misc_feature (290)..(297): n is a, c, g, or t
tcagtcacgtactacacgaccggtgctcgatttagtgtgagtagtttgggtttggggtcccatcaaggttcagcggcagtggatctggcacagacttcattctcaccatcagcagcctgcagcctgaagattttgcaacttattactgtctacaagatcacaattatcctgggacgttcggccaagggaccaaggtggaaaatcaaaacgaactgtggctgcaccatctgtcttcatccttcccgcctatctgatagtacgtgactgagcgggntggcaaggcgcatagnnnnnnnn

SEQ ID NO: 291413 - DNA, 516 bp, Homo sapiens
  misc_feature: GYAE6OF01EVSPA.13.78.H01.1.454.CMB.1.raw
  modified_base (248)..(248): a, c, t, g, unknown or other
  misc_feature (248)..(248): n is a, c, g, or t
  modified_base (469)..(469): a, c, t, g, unknown or other
  misc_feature (469)..(469): n is a, c, g, or t
  modified_base (493)..(506): a, c, t, g, unknown or other
  misc_feature (493)..(506): n is a, c, g, or t
  modified_base (510)..(516): a, c, t, g, unknown or other
  misc_feature (510)..(516): n is a, c, g, or t
tcagtcacgtactacacgaccggtgctcgatttagtgtgagtagtttgggtttgggctcgtccactgacatggtgacgcgactattgagggacgggctggagtggattggggaaatctatcatagtgggaccacctactacagcccgtccctcaatagtcgcgtcaccatgtcagtggacgagcccaaagaaccagttctccctgagcctgacctctgtgaccgccgcggactcggccctatacttcngtgcagagatcgagatgtgtcatcgcggggcacttttgatatactggggccaaagggtcgaatggtcatcgtctcgttcagccttccaaccaaaggggcccaagtcggtccttcccccctggccgccctgcctcgagaacgtcaccttccgagaggcaacgagccgcccgtagggcttggcctgggtcaaagggactacttcctaaggtactgacttgagnggctggacaaggcgataacgtgannnnnnnnnnnnnngggnnnnnnn

SEQ ID NO: 291414 - DNA, 742 bp, Homo sapiens
  misc_feature: GYAE6OF01CLNIT.13.78.H01.1.454.CMB.1.raw
  modified_base (265)..(265): a, c, t, g, unknown or other
  misc_feature (265)..(265): n is a, c, g, or t
  modified_base (675)..(675): a, c, t, g, unknown or other
  misc_feature (675)..(675): n is a, c, g, or t
  modified_base (701)..(701): a, c, t, g, unknown or other
  misc_feature (701)..(701): n is a, c, g, or t
  modified_base (710)..(710): a, c, t, g, unknown or other
  misc_feature (710)..(710): n is a, c, g, or t
tcagtcacgtactacacgaccggtgctcgatttagtgtgagtagtttgggtttgggctcgtccactgacatggtgacgcgactattgagggacgggctggagtggattggggaaatctatcatagtgggaccacctactacagcccgtccctcaatagtcgcgtcaccatgtcagtggacgacgcccaagacccagttcctccctggagccctgaccctctgtcgacccgccgcggactccggccctatacttctgtcgcgaganactcgagtatgtgcagtcgcgggctacgttttgatacgtcgtcggggaccgaacgggttccgaagttcggtacgacgttcccgttaccgttccttcgtaccgtacccccgttacccgtaacccggtaaaccgggacccctaaggttccccgggtttcccttaccccccggtcgggtccccggttacccctcgtaccctccccgtaaggacccgaccctacccgtaccggaacgaccgtaccacgtaccgggcccggtaccccggttcggggccgttccggcccgttacgggtaccgtaaaccgggtaccctttaccgtttaacccgttacggttaaccggtaccgtaacgtaccggtacggtaccggggtacgtcggtaccggaaccggtacgtacccgtagttaaccgngactcgagacgtcaggcgacggtccnggttaaccncgtacgcgtactacgtacgtacgtcgtcgtcg

SEQ ID NO: 291415 - DNA, 507 bp, Homo sapiens
  misc_feature: GYAE6OF01BQXCU.13.78.H01.1.454.CMB.1.raw
  modified_base (478)..(478): a, c, t, g, unknown or other
  misc_feature (478)..(478): n is a, c, g, or t
  modified_base (486)..(486): a, c, t, g, unknown or other
  misc_feature (486)..(486): n is a, c, g, or t
  modified_base (490)..(507): a, c, t, g, unknown or other
  misc_feature (490)..(507): n is a, c, g, or t
tcagtcacgtactacacgaccggtgctcgatttagtgtgagtagtttgggtttggggaaatctatcatagtgggaccacctactacagcccgtccctcaatagtcgcgtcaccatgtcagtggacgagcccaagaaccagttctcccctgagcctgacctctgtcgaccgccgcggactcggccctatacttctgtgcgagagatcgagatgtgtcatcggcggggtctacttttgattattcgtggggaccgaagggtcgagttggtcattccgtcttccttcacgtccctcccaaccgaacgggcccaagttccggttcccttccccccgtggccctccccgtgcctccgaggcgcacccgtcggaagacgacacgacggcccggcccgtggggcctcggccgtggaccgtaacggtaccttaccgttcccgtagttcgcgtaaccgtggacgggcgggtctggggacgacgggcncgagtgcngacnnnnnnnnnnnnnnnnnn

SEQ ID NO: 291416 - DNA, 289 bp, Homo sapiens
  misc_feature: GYAE6OF02JI958.13.78.H01.1.454.CMB.1.raw
  modified_base (284)..(289): a, c, t, g, unknown or other
  misc_feature (284)..(289): n is a, c, g, or t
tcagtcacgtactacacgaccggtgctcgatttagtgtgagtagtttgggtttgggtcccatcaaggttcagcggcagtggatctggcacagacttcattctcaccatcagcagcctgcagcctgaagattttgcaacttattactgtctacaagatcacaattatcctgggacgttcggccaagggaccaaggtggaaatcaaacgaactgtggctgcaccatctgtcttcatcttcccgcatctgatagtacgtgactgagcgggctggcaaggcgcatagnnnnnn

SEQ ID NO: 291417 - DNA, 155 bp, Homo sapiens
  misc_feature: GYAE6OF02GZ6Q0.13.78.H01.1.454.CMB.1.raw
  modified_base (154)..(155): a, c, t, g, unknown or other
  misc_feature (154)..(155): n is a, c, g, or t
tcagtcacgtactacacgaccggtgctcgatttagtgtgagtagtttgggtttgggaccaaggtggaaatgaaacgaactgtggctgcaccatctgtcttcatcttcccgccatctgatagtacgtgactgagcgggctggcaaggcgcatagnn

SEQ ID NO: 291418 - DNA, 236 bp, Homo sapiens
  misc_feature: GYAE6OF02HZFOC.13.78.H01.1.454.CMB.1.raw
  modified_base (234)..(236): a, c, t, g, unknown or other
  misc_feature (234)..(236): n is a, c, g, or t
tcagtcacgtactacacgaccggtgctcgatttagtgtgagtagtttgggtttgggagttcgactactggggccagggaaccctggtcaccgtctcctcagcctccaccaagggcccatcggtcttcccctggcaccctcctccaagagcacctctggggcacagcggccctgggctgcctggtcaaggactacttcctagtacgtgactgagcgggctggcaaggcgcatagnnn

SEQ ID NO: 291419 - DNA, 537 bp, Homo sapiens
  misc_feature: GYAE6OF02FI8GC.13.78.H01.1.454.CMB.1.raw
  modified_base (442)..(442): a, c, t, g, unknown or other
  misc_feature (442)..(442): n is a, c, g, or t
tcagtcacgtactacacgaccggtgctcgatttagtgtgagtagtttgggtttggggtgaagaagcctgggtcctcggtgaaggtctcctgcaagccttctggaggcaccttcaacaactatgctataaactgggtgcgacaggcccctggacaagggcctgagtggatgggaggtttcatccctgtctttgatacaacaaactacggacagaggttccagggcagactcacgattaccgcggacagatccacgagcacagtgtacatggagctgagccgcctgacatctgaagacacggccgtgtattactgtgcgagagatcggggactataccggggcatattcgcgacctggacttctacttctacatggacgtctggggcaaagggccacggtcaccgtctcctcagcctccaccaagggcccatcggtcttccccnggccgccctgcctccaggacgccacctccgagacgccacacgccggccctgggctgccgtggtcaaggctacttcctagtacgtgactgagcggc

SEQ ID NO: 291420 - DNA, 299 bp, Homo sapiens
  misc_feature: GYAE6OF02I0Z0B.13.78.H01.1.454.CMB.1.raw
  modified_base (287)..(299): a, c, t, g, unknown or other
  misc_feature (287)..(299): n is a, c, g, or t
tcagtcacgtactacacgaccggtgctcgatttagtgtgagtagtttgggtttggggtcccagtcaaggttcagcggcagtggatctggcacagacttcattctcaccatcagcagcctgcagcctgaagattttgcaacttattactgtctacaagatcacaattatcctgggacgttcggccaagggaccaaggtggaaatcaaacgaactgtggctgcaccatctgtcttcatcttcccgccatctgatagtacgtgactgagcgggctggcaaggcgcatagnnnnnnnnnnnnn

SEQ ID NO: 291421 - DNA, 229 bp, Homo sapiens
  misc_feature: GYAE6OF02FQTGH.13.78.H01.1.454.CMB.1.raw
  modified_base (222)..(229): a, c, t, g, unknown or other
  misc_feature (222)..(229): n is a, c, g, or t
tcagtcacgtactacacgaccggtgctcgatttagtgtgagtagtttgggtttgggggccagggagccctggtcaccgtctcctcagcctccaccaagggcccatcggtcttccccctggcaccctcctccaagagcacctctgggggcacagcggccctgggctgcctggtcaaggactacttcctagtacgtgactgagcgggctggcaaggcgcatagnnnnnnnn

SEQ ID NO: 291422 - DNA, 478 bp, Homo sapiens
  misc_feature: GYAE6OF02I6WH6.13.78.H01.1.454.CMB.1.raw
  modified_base (360)..(360): a, c, t, g, unknown or other
  misc_feature (360)..(360): n is a, c, g, or t
  modified_base (460)..(478): a, c, t, g, unknown or other
  misc_feature (460)..(478): n is a, c, g, or t
tcagtcacgtactacacgaccggtgctcgatttagtgtgagtagtttgggtttgggctcgtccactgacatggtgacgcgactattgagggacgggctggagtggattggggaaatctatcatagtgggaccacctactacagcccgtccctcaatagtcgcgtcaccatgtcagtggacgagcccaagaaccagttctccctgagcctgacctctgtgaccgccgcggactcggccctatacttctgtgcgagagatcgagatgtgtcatcgcggggcacttttgatatctggggccaagggtcgatggtcatcgtctcttcagcctccaccaagggcccatcggtcttccccctggcnccctgctccaggacgcacctccgagagcacagcgccctgggctgcctggtcaaggactacttcctagtcgtgactgagcgggctggcaaggcgcagtagnnnnnnnnnnnnnnnnnnn

SEQ ID NO: 291423 - DNA, 297 bp, Homo sapiens
  misc_feature: GYAE6OF02GD9EK.13.78.H01.1.454.CMB.1.raw
  modified_base (286)..(297): a, c, t, g, unknown or other
  misc_feature (286)..(297): n is a, c, g, or t
tcagtcacgtactacacgaccggtgctcgatttagtgtgagtagtttgggtttggggtcccatcgaaggttcagcggcagtggatctggcacagacttcattctcaccatcagcagcctgcagcctgaagattttgcaacttattactgtctacaagatcacaattatcctgggacgttcggccaagggaccaaggtggaaatcaaacgaactgtggctgcaccatctgtcttcatcttcccgcatctgatagtacgtgactgagcgggctggcaaggcgcatagnnnnnnnnnnnn

SEQ ID NO: 291424 - DNA, 302 bp, Homo sapiens
  misc_feature: GYAE6OF02HIZLF.13.78.H01.1.454.CMB.1.raw
  modified_base (285)..(302): a, c, t, g, unknown or other
  misc_feature (285)..(302): n is a, c, g, or t
tcagtcacgtactacacgaccggtgctcgatttagtgtgagtagtttgggtttggggtcccatcaaggttcagcggcagtggatctggcacagacttcattctcaccatcagcagcctgcagcctgaagattttgcaacttattactgtctacaagatcacaattatcctgggacgttcggccaagggaccaaggtggaaatcaaacgaactgtggctgcaccatctgtcttcatcttcccgcatctgatagtacgtgactgagcgggctggcaaggcgcatagnnnnnnnnnnnnnnnnnn

SEQ ID NO: 291425 - DNA, 225 bp, Homo sapiens
  misc_feature: GYAE6OF02FPHY6.13.78.H01.1.454.CMB.1.raw
  modified_base (223)..(225): a, c, t, g, unknown or other
  misc_feature (223)..(225): n is a, c, g, or t
tcagtcacgtactacacgaccggtgctcgatttagtgtgagtagtttgggtttgggggccaggggagccctggtcaccgtctcctcagcctccaccaagggcccatcggtcttccccctggcaccctcctccaagagcacctctgggggcacagcggccctgggctgcctggtcaaggactacttcctagtacgtgactgagcgggctggcaaggcgcatagnnn

SEQ ID NO: 291426 - DNA, 249 bp, Homo sapiens
  misc_feature: GYAE6OF02GEQQF.13.78.H01.1.454.CMB.1.raw
  modified_base (246)..(249): a, c, t, g, unknown or other
  misc_feature (246)..(249): n is a, c, g, or t
tcagtcacgtactacacgaccggtgctcgatttagtgtgagtagtttgggtttggggcgcgtactcctcttgagatctggggccaggggacaatggtcaccgtctcttcagcctccaccaagggcccatcggtcttccccctggcaccctcctccaagagcacctctgggggcacagcggccctgggctgcctggtcaaggactacttcctagtacgtgactgagcgggctggcaaggcgcatagnnnn

SEQ ID NO: 291427 - DNA, 546 bp, Homo sapiens
  misc_feature: GYAE6OF02IMOF4.13.78.H01.1.454.CMB.1.raw
  modified_base (487)..(487): a, c, t, g, unknown or other
  misc_feature (487)..(487): n is a, c, g, or t
  modified_base (493)..(493): a, c, t, g, unknown or other
  misc_feature (493)..(493): n is a, c, g, or t
tcagtcacgtactacacgaccggtgctcgatttagtgtgagtagtttgggtttggggtgaagaagcctgggtcctcggtgaaggtctcctgcaagccttctggaggcaccttcaacaactatgctataaactgggtgcgacaggcccctggacaagggcctgagtggatgggaggtttcatccctgtctttgatacaacaaactacggacagaggttccagggcagactcacgattaccgcggacagatcccacgagcacagtgtacatggagctgagccgcctgacatctgaagacacggccgtgtattactgtgcgagagatcggggactagtaccggggcgatattcgcgacctggaactttctacttctacatggacgtctggggacaaagggaccacggtcaccgtctcctcagcctccaccaacgggcccatccggtcttccccgtggcccgccctgcctccaggacgccaccgtccgagngccacngccgcctgggctgccgtggtcaaggctacttcctagtacgtgactgagcggcg

SEQ ID NO: 291428 - DNA, 220 bp, Homo sapiens
  misc_feature: GYAE6OF02HSVW7.13.78.H01.1.454.CMB.1.raw
tcagtcacgtactacacgaccggtgctcgatttagtgtgagtagtttgggtttgggggccagggagccctggtcaccgtctcctcagcctccaccaagggcccatcggtcttccccctggcaccctcctccaagagcacctctgggggcacagcggccctgggctgcctggtcaaggactacttcctatacgtgactgagcgggctggcaaggcgcatag

SEQ ID NO: 291429 - DNA, 446 bp, Homo sapiens
  misc_feature: GYAE6OF02H0CI7.13.78.H01.1.454.CMB.1.raw
  modified_base (428)..(446): a, c, t, g, unknown or other
  misc_feature (428)..(446): n is a, c, g, or t
tcagtcacgtactacacgaccggtgctcgatttagtgtgagtagtttgggtttggggaaatctatcatagtgggaccacctactacagcccgtccctcaatagtcgcgtcaccatgtcagtggacgagcccaagaaccagttctccctgagcctgacctctgtgaccgccgcggactcggccctatacttctgtgcgagagatcgagatgtgtcatcgcggggcacttttgatatctgggggccaagggtcgatggtcatcgtctcttcagcctccaccaagggcccatcggtcttcccctggcgccctgcctccgaggacgccacctccgagacgcacgagccggcccgtgggctcgccgtggtcaagggctacttccgtaagtacgtgactggacggtcgggcgtggacgaaggcgcgtatacggnnnnnnnnnnnnnnnnnnn

SEQ ID NO: 291430 - DNA, 427 bp, Homo sapiens
  misc_feature: GYAE6OF02GA3U9.13.78.H01.1.454.CMB.1.raw
  modified_base (416)..(417): a, c, t, g, unknown or other
  misc_feature (416)..(417): n is a, c, g, or t
  modified_base (419)..(427): a, c, t, g, unknown or other
  misc_feature (419)..(427): n is a, c, g, or t
tcagtcacgtactacacgaccggtgctcgatttagtgtgagtagtttgggtttggggaaatctatcatagtgggaccacctactacagcccgtccctcaatagtcgcgtcaccatgtcagtggacgagcccaagaaccagttctccctgagcctgacctctgtgaccgccgcggacacggccgtgtattattgtgccagaggccttatggttgagggacttattctgacttctggttttgatatctggggccaggggacaatggtcactgtctcttcagcctccaccaagggcccatcggtcttccccctggcaccctcctccaagagcacctctgggggcacgagcggcccgtgggctcgcctggtcaaggactacttcctagtcgtgactgagcgggctggcaaggcgcatagnngnnnnnnnnn

SEQ ID NO: 291431 - DNA, 311 bp, Homo sapiens
  misc_feature: GYAE6OF02IUK8R.13.78.H01.1.454.CMB.1.raw
  modified_base (296)..(311): a, c, t, g, unknown or other
  misc_feature (296)..(311): n is a, c, g, or t
tcagtcacgtactacacgaccggtgctcgatttagtgtgagtagtttgggtttgggtcccatcaaggttcagcggcagtggatctggcacagacttcattctcaccatcagcagcctgcagcctgaagatttttgcaacttattactgtctacaagatcacaattatcctgggacgttcggccaaaggggaccaaggtggaaatcaaacgaactgtggctgcaccatctgtcttcatcttccccgcatctgattacgtacgtgacttggagccggggctggacaaggcgcaatagnnnnnnnnnnnnnnnn

SEQ ID NO: 291432 - DNA, 343 bp, Homo sapiens
  misc_feature: GYAE6OF02GB1T0.13.78.H01.1.454.CMB.1.raw
  modified_base (250)..(250): a, c, t, g, unknown or other
  misc_feature (250)..(250): n is a, c, g, or t
  modified_base (282)..(343): a, c, t, g, unknown or other
  misc_feature (282)..(343): n is a, c, g, or t
tcagtcacgtactacacgaccggtgctcgatttagtgtgagtagtttgggtttggggtcccgatcaaggttcagcggcagtggatctggcacagacttcattctcaccatcagcagcctgcagcctgaagattttgcagtctattactgtcagcagtatagtactgagaaccttcggccaagggacacgactggagattaaaggaactagtggctgcacatctgtctcatcttccgcatctgatgtacgngactgagtcggctggcaaggcgacatagcgannnnnnnnnnnnnnnnnnnnnnnnnnnnnnnnnnnnnnnnnnnnnnnnnnnnnnnnnnnnnn

SEQ ID NO: 291433 - DNA, 836 bp, Homo sapiens
  misc_feature: GYAE6OF02G7LNY.13.78.H01.1.454.CMB.1.raw
  modified_base (169)..(169): a, c, t, g, unknown or other
  misc_feature (169)..(169): n is a, c, g, or t
  modified_base (183)..(183): a, c, t, g, unknown or other
  misc_feature (183)..(183): n is a, c, g, or t
  modified_base (779)..(779): a, c, t, g, unknown or other
  misc_feature (779)..(779): n is a, c, g, or t
  modified_base (797)..(797): a, c, t, g, unknown or other
  misc_feature (797)..(797): n is a, c, g, or t
  modified_base (807)..(807): a, c, t, g, unknown or other
  misc_feature (807)..(807): n is a, c, g, or t
  modified_base (823)..(823): a, c, t, g, unknown or other
  misc_feature (823)..(823): n is a, c, g, or t
tcagtcacgtactacacgaccggtgctcgatttagtgtgagtagtttgggtttgggctcggtccactgacatggtcgacgcgactattgagggacgggctggagtggattggggaaatctatcatagtcgggaccactactacagcccgtcctcaatgtcgcgtcaccntgtacagtggacgngcccaagaccagttcctcctggacgcctgacctctggtcgacccgccgacgggtacctccgggaccctacttacttcctgtcgacgtaggacgtgttcggagacgttcggttagtcgtaacgtccgggtccgggggtcttaaccgttttggaacttaacgttccgggtacggggacccgtaaagggggttccgtaacggttcgggtaaccgacggttccggttacgtttcttaccgaacggtcccccgtacccgtaaccgggaaccggggtaccccttaacggttcccgggtttaccccgtttacccccggtcggggtcccccggttaccccggttcgggtacccccgttacccggggaaacgggtacccgggtacccttaaaccccggtcccgggaaacgggtacccggaacccgtaaccgccggggtaacccgggtccccggtttcggggaccgttacccgggtcccgttacgggtaacccgtaaaccgggtaccctttaccggtttaccggtacgttaaccggttacgtaccggttaggaaccgggtccgggccgttaagggaccggtaaacggccgggtactacggtaccgngtaccagtcgtagcgtancggtcacgtnacgctacgctaggccncgcgtagctacgg

SEQ ID NO: 291434 - DNA, 694 bp, Homo sapiens
  misc_feature: GYAE6OF01CC9RZ.44.36.D03.1.454.CMB.1.raw
  modified_base (302)..(302): a, c, t, g, unknown or other
  misc_feature (302)..(302): n is a, c, g, or t
  modified_base (330)..(330): a, c, t, g, unknown or other
  misc_feature (330)..(330): n is a, c, g, or t
tcagacagtatatacacgaccggtgctcgatttagctgcgtcacgatctctcttggggagctctgcttcagctgtgagcgcagaaggcaggactcgggacaatcttcatcatgacctgctcccctctcctcctccacccttctcattcactgcacagggtcctcgggcccagtctgtgttgacgcacgccgccctcagtgtctcgccggccccaggacaggagggtcaccatcctcctgctctggaacgaacctcaatgttaggaaataattatgtatctaggtaccagcaactccaggacncaccgaccccaaactcctactaatttanacgaactaaataaactaaacgaccgtaacccctacgaacgggtacttaccgtacgaacccgtatttcccgtcgttcgggtacccttaccgtaacgttccgtacggacctaaccggtccaaccggtcccctaaccccggtcggacccctacgtacccgaaccccgggtaacctacccgaacggaccggtacgggggaacgtaccgggaccgtaagtttacgtacgttacgggaccgggtaacggttgggaactacgacgacggtccgtaggtacgtcggtccgtacggggacttccggttcgggttccgttacggggacggggaacgggtacccggtaaaggggtcccgtaaacccggttaccgg

SEQ ID NO: 291435 - DNA, 595 bp, Homo sapiens
  misc_feature: GYAE6OF01ALTE9.44.36.D03.1.454.CMB.1.raw
tcagacagtatatacacgaccggtgctcgatttagctgcgtcacgatctctcttggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggcccagcctgggaactcctgagactctcctgtgcagcctctggattcatcttcaggacctatcgccatgcacgtcgggtccgccaggctccgaggcgaaggggctgggagtgggtgactaattatatcgaagaagatggtaattgaaagaacacgtacgggagaacgtccggaaggaacgggccgtaattcccgaccgtctaccgaaggaacgaactaacttaccgaacggaaaccacgacgtgactactcgtagaccaaagtcgtaaccaaccctacaactaaggtcgaacggaccgacggtcttacggtacttaagttcgttgtacggacgtacggacccgtacccccgtacggacggtccccggtaccccgg

SEQ ID NO: 291436 - DNA, 505 bp, Homo sapiens
  misc_feature: GYAE6OF01DZU01.44.36.D03.1.454.CMB.1.raw
  modified_base (216)..(216): a, c, t, g, unknown or other
  misc_feature (216)..(216): n is a, c, g, or t
  modified_base (311)..(311): a, c, t, g, unknown or other
  misc_feature (311)..(311): n is a, c, g, or t
tcagacagtatatacacgaccggtgctcgatttagctgcgtcacgatctctcttggggcagagctctggggaggaactgctcagttaggacccagacggaaccatggaagccccagcgcagcttctcttcctcctgctactctggctcccagataccactggagaaatagtgatgacgcggtctccagccaccctgtctgtgtctccaggggaaanagccacctctcctgcagggccagtcagagtgttagcagcaacttagcctcgtaccagcagaatctggccaggctccaggctcctcatctatggtncatccaccaggccatggtactcccagccaggttcagtggcaggtggtctgggacagagttcactctcacatcagcagcctgcagtctagaagtattttgctagtttattactgtcagtcagttaatatgacttcggcccttcccgttcggccaaagggaccaacggtactagggataattaaacgacgttacgg

SEQ ID NO: 291437 - DNA, 528 bp, Homo sapiens
  misc_feature: GYAE6OF01AG1BS.44.36.D03.1.454.CMB.1.raw
  modified_base (349)..(349): a, c, t, g, unknown or other
  misc_feature (349)..(349): n is a, c, g, or t
  modified_base (374)..(374): a, c, t, g, unknown or other
  misc_feature (374)..(374): n is a, c, g, or t
  modified_base (445)..(445): a, c, t, g, unknown or other
  misc_feature (445)..(445): n is a, c, g, or t
  modified_base (454)..(454): a, c, t, g, unknown or other
  misc_feature (454)..(454): n is a, c, g, or t
  modified_base (482)..(482): a, c, t, g, unknown or other
  misc_feature (482)..(482): n is a, c, g, or t
  modified_base (493)..(493): a, c, t, g, unknown or other
  misc_feature (493)..(493): n is a, c, g, or t
  modified_base (518)..(518): a, c, t, g, unknown or other
  misc_feature (518)..(518): n is a, c, g, or t
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttatttacaaggtgtccagagtgaagtgcagttggtggaggtccgggggagacttggtccagccgtggagggtccctgagactctcctgtgtcgcctctggattcaccatcagtgaccactatatggactgggtccgccaggcctccgaggggaagggctgggagtggcttggccgnaagtaaaaacaagtgccagctttancacagagtacgccgcgtctgtagaaacgccaagacttccaccctctacaagacgatgacttacaagaactnattgattcngacgaatcgaactaacctagaaaaccgnggacacggganagtgtattatgtgttgtgttatatnagatgtaccg

SEQ ID NO: 291438 - DNA, 749 bp, Homo sapiens
  misc_feature: GYAE6OF01EGBUH.44.36.D03.1.454.CMB.1.raw
tcagacagtatatacacgaccggtgctcgatttagctgcgtcacgatctctcttggggagctctgagagcggagccccagccccagaattcccaggtgtttcatttggtgatcagcactgaacacagaggactcaccatggagttcgggctgagctgggttttcctgttgttatttacaaggtgtcagagtgaagtgcagttggtggagtccgggggagacgttggtccagccgtggacgggtccctgagactctcctgtgtcgcctctggattcaccatcagtgaccactatagtggactgggtccgcaggctccgagggaagggctgggagtggcgttgggccgacgaaaggtaaaaaacaaggttacgaccctaagtcgtttaataccaacgaggtaacgttaaccggccggtaccgttacgtaggtaacggaaacgcccgaaggtacttacccaaccccttcgtaccgaaaggacgtaagttacggtaacctttacgaaaacggttaacctactaacgtttacggtaacttttaccgtacggtaaccgttaaacgttaccggtaaaaccctttaaaccccggtaaacgggaaaaaaacccccgggtagggaaaaccccggtaaaccgggggtaacctaaaggtttaccggtttaaagttttaacggtttgggtttagttttacgggtttagttttaaagttacgttaaccgtaaggggttaaacccttcgggttaaacccccggg

SEQ ID NO: 291439 - DNA, 389 bp, Homo sapiens
  misc_feature: GYAE6OF01AVA94.44.36.D03.1.454.CMB.1.raw
  modified_base (216)..(216): a, c, t, g, unknown or other
  misc_feature (216)..(216): n is a, c, g, or t
  modified_base (384)..(389): a, c, t, g, unknown or other
  misc_feature (384)..(389): n is a, c, g, or t
tcagacagtatatacacgaccggtgctcgatttagctgcgtcacgatctctcttggggcagagctctggggaggaactgctcagttaggacccagacggaaccatggaagccccagcgcagcttctcttcctcctgctactctggctcccagacaccactggagaaatagtgatgacgcagtctccagccaccctgtctctgtctccaggggaaanagccaccctctcctgcagggccagtcagagtgttggcagcagcgtagcaactggccgatcaccttcggccaagggacacgactggagattaaacgactgtggctgcacatctgtctcatcttcccgcatctgatatatactgtctgagcggctggcaaggcgcatagnnnnnn

SEQ ID NO: 291440 - DNA, 535 bp, Homo sapiens
  misc_feature: GYAE6OF01EQ6IV.44.36.D03.1.454.CMB.1.raw
  modified_base (395)..(395): a, c, t, g, unknown or other
  misc_feature (395)..(395): n is a, c, g, or t
tcagacagtatatacacgaccggtgctcgatttagctgcgtcacgatctctcttggggatcacataacaaccacactcctcctctaaagaagcccctgggagcacagctcatcaccatggactggacctggcggttcctctttgtggtggcagcagctacaggtgtccagtcccaggtgcagctggtgcagtctggggctgaggtgaagaagcctgggtcctcggtgaaggtctcctgcaaggcttctggaggcaccttcttcagctatgtcttttattgggtgcgacgaggccccgtggacaagggcttggagtggctgggaggatcatccctatcgtttgggtgcatcgaattacgcacagtaagtttcaggtacagagtcacctattaccgnggaacgaactccagacgtacagcctacatggagctggagcgaggcgtggagtactcgtaggaagaccgacggacctagtccttagtttcgtaggtcggcgagtacgccccttacgtactaacctttcagttccgtacccc

SEQ ID NO: 291441 - DNA, 775 bp, Homo sapiens
  misc_feature: GYAE6OF01B9BWL.44.36.D03.1.454.CMB.1.raw
  modified_base (305)..(305): a, c, t, g, unknown or other
  misc_feature (305)..(305): n is a, c, g, or t
tcagacagtatatacacgaccggtgctcgatttagctgcgtcacgatctctcttggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggcccagcctgggaactccctgagactctcctgtgcagcctctggattcatcttcaggacctatcgccatcgcacgtcgggtcccnccaggcctccgaggcgaaggggtctgggaggtggggtggactaaagtttatagtacgaaggaaagtagtagggtaaatttaggaaaaacggaaacctaaccgttaaacggggaacgtaaccgttaccccgggaaagggtaaaccggggtaccccgtaacgtttaccccgtaaaccccggttacccgtaccccgaaaggtaacggaaccgttaaacgtttaccccgaaacgggaaacccaacccgtaacgtacggtacctaacgttcctacgaacccgtaaaacgttaccgtaaacctaaaccccttacgtaaaccgtaaacggttaacgggaaaccgggtaacccgtaaccgggtaccttacgggtttacctttaaagttttacggtttacgggtacggtaccggtaaccgggtaaccccggtacccccccgttaccgggaacccggggttcccccgggttaccccccgg

SEQ ID NO: 291442 - DNA, 516 bp, Homo sapiens
  misc_feature: GYAE6OF01DW2RE.44.36.D03.1.454.CMB.1.raw
  modified_base (331)..(331): a, c, t, g, unknown or other
  misc_feature (331)..(331): n is a, c, g, or t
tcagacagtatatacacgaccggtgctcgatttagctgcgtcacgatctctcttggggggagacgagcccagcactggaagtcgccggtgtttccattcggtgatcatcactgaacacagaggactcaccatggactttgggctgagattgggttttcctcgttgctcttttaagaggtggccagtgtcaggtgcagctagtggagtctgggggagagcggcccagcctgggaactccctgagactctcctgtgcagcctctggattcatcttcaggacctatgccatgcactgggtccaccaggctccaggcaaggggctgggagtgggngcaagttatatcagaagatggaattgaagaacacgtacggagactaccgagaacgggccgattcgaccgtctaccagagacaacttccaggaacacactgacatctgacaatgtaacaactcacaagtgagacacggcgtgtctattattgtgcgtacgacgcccccgtacgcgccggtcccccg

SEQ ID NO: 291443 - DNA, 496 bp, Homo sapiens
  misc_feature: GYAE6OF01EKT35.44.36.D03.1.454.CMB.1.raw
  modified_base (284)..(284): a, c, t, g, unknown or other
  misc_feature (284)..(284): n is a, c, g, or t
  modified_base (414)..(414): a, c, t, g, unknown or other
  misc_feature (414)..(414): n is a, c, g, or t
  modified_base (489)..(489): a, c, t, g, unknown or other
  misc_feature (489)..(489): n is a, c, g, or t
tcagacagtatatacacgaccggtgctcgatttagctgcgtcacgatctctcttggggatcacataacaaccacactcctcctctaaagaagcccctgggagcacagctcatcaccatggactggacctggcggttcctctttgtggtggcagcagctacaggtgtccagtcccaggtgcagctggtgcagtctggggctgaggtgaagaagcctgggtcctcggtgaaggtctcctgcaaggcttctggaggcaccttcttcagctatgtcttttattgggtncgacaggcccctggacaagggcttgagtggcgtgggaggatcatccctatctttggtgcatcgaattacgcacgagaagtttcaggacagagtcaccattaccgcggacaatccagacgtacacgcctanatggagctgagcgaggctagagatcgtagaagcacggccatctatttctgtgcgagagccctcgtactactttcntcgtccc

SEQ ID NO: 291444 - DNA, 799 bp, Homo sapiens
  misc_feature: GYAE6OF01CY7YB.44.36.D03.1.454.CMB.1.raw
  modified_base (303)..(303): a, c, t, g, unknown or other
  misc_feature (303)..(303): n is a, c, g, or t
  modified_base (357)..(357): a, c, t, g, unknown or other
  misc_feature (357)..(357): n is a, c, g, or t
tcagacagtatatacacgaccggtgctcgatttagctgcgtcacgatctctcttggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtctgggggagagcggcccagcctgggaactccctgagactctcctgtgcagcctctggattcatctcaggacctatgccagtgccacgtcgggtcccnccgaggctaccgaggccgaaggggctggggacgtggggtacggctaaagtttanaatcgaaggaaagattaggggaaatttaggaaacggtaaacaacgttaaccgggaagtaaccgtacccggaaggtaaacggggtacccgtaacgtttacccggtaaccccggttaccgttacccgaaaggaacggtaaccgtaaaacgtttaccccgaaacgggtaaacccaaccgtaacccgttacggaacctaacgttaccgttaacgggtaaccctaaaaaacgttaccggttaaaaccctaaacccctttaacccgaaacggtaaaaccgggtttacgggaaacccgggaaaccgtaaaccccgggggtaccgtttaaccggggttactttaaaacggttttacggtttaacgggttacggtaacccgggtaaaccgggtaacccggtaccccccccggttacgggtaacccgggaacccccgggttttacccccggg

SEQ ID NO: 291445 - DNA, 632 bp, Homo sapiens
  misc_feature: GYAE6OF01CWA8Y.44.36.D03.1.454.CMB.1.raw
  modified_base (354)..(354): a, c, t, g, unknown or other
  misc_feature (354)..(354): n is a, c, g, or t
  modified_base (384)..(384): a, c, t, g, unknown or other
  misc_feature (384)..(384): n is a, c, g, or t
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttatttacaaggtgtccagagtgaagtgcagttggtggagtccgggggagacttggtccagcctgggagggtccctgagactctcctgtgtcgcctctggattcaccatcagtgacccatatagtggactgggtccgccaggctcccgaagggaaggggctgggagtgggcttgggcccganaaagtaaaaaacaagttgaccagctttaancagagacgtacgccgcgtctaggtagaacgccagtacttacccaccctactaacgaaagacgtatacgtaaccttacaaacgtaaccttactaagttcgtaactttcgtacggaacgtaaatacgtaaacctaaacccgtaacggaaaaacccggaggaaccgaaccgggactaagttacgttaatttaggttggtttaggtttaggttagtttaactaagttacgaaacggtaacgttcggtacccg

SEQ ID NO: 291446 - DNA, 537 bp, Homo sapiens
  misc_feature: GYAE6OF01AY6FW.44.36.D03.1.454.CMB.1.raw
  modified_base (434)..(434): a, c, t, g, unknown or other
  misc_feature (434)..(434): n is a, c, g, or t
tcagacagtatatacacgaccggtgctcgatttagctgcgtcacgatctctcttggggatcacataacaaccacactcctcctctaaagaagcccctgggagcacagctcatcaccatggactggacctggcggttcctctttgtggtggcagcagctacaggtgtccagtcccaggtgcagctggtgcagtctggggctgaggtgaagaagccgtgggtcctcggtgaaggtctcctgcaaggcttctggaggcaccttcttcagctatgtcttttagttgggtgcgacaggcccctggacagggcttgagtggcgtgggaggatcatccctatcgtttggtgctatcgaattacgcacagtaagtttcaggacagagtaccacctagttaccgacggacgaactccgaacgacgacacgcctacagtggacncgtgagcaggctgagtatcgtaggaacgacgacggccatcttacgtttcgtgtacggcgagtacgtcccgttcgtacctaacctttctacgttaccgttcccc

SEQ ID NO: 291447 - DNA, 562 bp, Homo sapiens
  misc_feature: GYAE6OF01A9B0R.44.36.D03.1.454.CMB.1.raw
  modified_base (379)..(379): a, c, t, g, unknown or other
  misc_feature (379)..(379): n is a, c, g, or t
  modified_base (493)..(493): a, c, t, g, unknown or other
  misc_feature (493)..(493): n is a, c, g, or t
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccgaggggaagggctgggagtggcttgggccgacaagtaaaaacaaggttcgaccagtctttancacagagtacgccgcgtctagtgaaacgccagacttccaccctctacaagagatgaccttacaagtaactcatttgattctgaccgtaatcgaactaaccgtagaaaaacccgnggaacacgggacaagtgttaattagttggttagtttggttagtttatactagaacggtactggtacccg

SEQ ID NO: 291448 - DNA, 616 bp, Homo sapiens
  misc_feature: GYAE6OF01B7SF9.44.36.D03.1.454.CMB.1.raw
  modified_base (357)..(357): a, c, t, g, unknown or other
  misc_feature (357)..(357): n is a, c, g, or t
  modified_base (385)..(385): a, c, t, g, unknown or other
  misc_feature (385)..(385): n is a, c, g, or t
  modified_base (531)..(531): a, c, t, g, unknown or other
  misc_feature (531)..(531): n is a, c, g, or t
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtcgaaccactatagtggactggggtcccgccgagggcctccgaggggaagggctgggagtggcttgggccganaaggtaaaaacaagttgccagtctttancacagagtacgccgtgtctgtagaaagccaagtacttcccgaacccttcgtacgaaagagtaattcgtaacctttaccgaaagtaacctctaagtttgaactttcgtagaccgtaaatcggaaaccttaaccgtagaaaaaccggngaaccgacggggtactaagttgttaatttaggttggttagttttggtagtttttaacaattaccgaaaggtaacttcggtacccg

SEQ ID NO: 291449 - DNA, 526 bp, Homo sapiens
  misc_feature: GYAE6OF01CJCXM.44.36.D03.1.454.CMB.1.raw
  modified_base (216)..(216): a, c, t, g, unknown or other
  misc_feature (216)..(216): n is a, c, g, or t
  modified_base (312)..(312): a, c, t, g, unknown or other
  misc_feature (312)..(312): n is a, c, g, or t
tcagacagtatatacacgaccggtgctcgatttagctgcgtcacgatctctcttggggcagagctctggggaggaactgctcagttaggacccagacggaaccatggaagccccagcgcagcttctcttcctcctgctactctggctcccagataccactggagaaatagtgatgacgcggtctccagccaccctgtctgtgtctccaggggaaangccaccctctcctgcagggccagtcagagtgttagcagcaacttagcctcgtaccagcagaatctggccaggctcccaggctcctcatctatggtncatccaccaggccacgtggtactcccagccaggttcagtggctaggtgggtctgggacaggtagttcgactctcaccatcagcagcctgcagtctagaagtattttgacttagtttacttacttgtctagtctaagttaataatcgtactcggtcccttcccgttcggacccgaagggacacggtactaggaagtaacttaaacggacgtacgg

SEQ ID NO: 291450 - DNA, 564 bp, Homo sapiens
  misc_feature: GYAE6OF01CFCHH.44.36.D03.1.454.CMB.1.raw
  modified_base (347)..(347): a, c, t, g, unknown or other
  misc_feature (347)..(347): n is a, c, g, or t
  modified_base (456)..(456): a, c, t, g, unknown or other
  misc_feature (456)..(456): n is a, c, g, or t
tcagacagtatatacacgaccggtgctcgatttagctgcgtcacgatctctcttggggagctctgagagcggagcccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacttggtccagcctggagggtccctgagactctcctgtgtcgcctctggattcaccatcagtgaccactatatggactgggtccgccaggctccgagggaagggctggagtggcttggccgnaagtaaaaacaagttgaccagctttagcacagagtacgccgcgtctgtagaagccagacttcaccctctacaagagatcgtacttacaagtaactcaatttgatttcgngacgtaatacgaaccttaaccgtagaaaacccgagggaaccacgggctaagtgttattaacgtttggtgtttagttagttttaatagttacgaaggtactcgtacccg

SEQ ID NO: 291451 - DNA, 692 bp, Homo sapiens
  misc_feature: GYAE6OF01CXP2H.44.36.D03.1.454.CMB.1.raw
  modified_base (215)..(215): a, c, t, g, unknown or other
  misc_feature (215)..(215): n is a, c, g, or t
  modified_base (433)..(433): a, c, t, g, unknown or other
  misc_feature (433)..(433): n is a, c, g, or t
tcagacagtatatacacgaccggtgctcgatttagctgcgtcacgatctctcttggggcagagctctggggaggaactgctcagttaggacccagacggaaccatggaagccccagcgcagcttctcttcctctgctactctggctccagataccactggagaaatagtgatgacgcggtctccagcccacctgtctgtgtctccgaggggaaancgcccacctctcctgcagggccagtcagagtgttagcagcaacttagcctcgtaccagcagaatcgtggccaggcctcccgaggcctctcatctagtggtgctactccgaccgaggtccaacgtcggtaactcccgaagcccgtaaggttcaggttcgggcctagggttcgggtacgtaggggaacgtagtacgttaccgaccttcgtacccacctanaccgtaagccacggtcccgtagaccgtaacggtccgttaggtaaacgtttacgttttcgaacgtttaggtttttaacgttaaccgttacggtacctaacggtaccgttaaagttaacttaaacggtcggtaacccgtttacggggtccccctttaccccggggtttaaccgggacccgttaaaaccgggggtacctaaacccgggtaacggttacggggtaaacgttaaacccggttaaaacggtaacccggttagggg

SEQ ID NO: 291452 - DNA, 554 bp, Homo sapiens
  misc_feature: GYAE6OF01CF7LB.44.36.D03.1.454.CMB.1.raw
  modified_base (218)..(218): a, c, t, g, unknown or other
  misc_feature (218)..(218): n is a, c, g, or t
  modified_base (317)..(317): a, c, t, g, unknown or other
  misc_feature (317)..(317): n is a, c, g, or t
tcagacagtatatacacgaccggtgctcgatttagctgcgtcacgatctctcttggggcagagctctgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttagcagcaacttagcctcgtaccagcagaaatctggccaggcctcccgaggctcctcatctatggtncatccacgagggccagtcggtactcccaagccctaggttccaggtggcaggtgggtcgtgggacaggtagttcactctcaccatcagcacgcctgccagtctagtaagtagttttagcgttagtttacttacgttcgtactaacgtaccgtacgaccgtacgtcggtaccgtacggtacgtacggttttcggaccgtaggggtaccgtaacggcgtaggacgtccgtacgtaaacgg

SEQ ID NO: 291453 - DNA, 680 bp, Homo sapiens
  misc_feature: GYAE6OF01CT8EX.44.36.D03.1.454.CMB.1.raw
  modified_base (221)..(221): a, c, t, g, unknown or other
  misc_feature (221)..(221): n is a, c, g, or t
  modified_base (311)..(311): a, c, t, g, unknown or other
  misc_feature (311)..(311): n is a, c, g, or t
  modified_base (361)..(361): a, c, t, g, unknown or other
  misc_feature (361)..(361): n is a, c, g, or t
  modified_base (373)..(373): a, c, t, g, unknown or other
  misc_feature (373)..(373): n is a, c, g, or t
tcagacagtatatacacgaccggtgctcgatttagctgcgtcacgatctctcttggggagctctgagagcggagccccagccccagaattcccaggtgtttcatttggtgatcagcactgaacacagaggactcaccatggagttcgggctgagctgggttttccttgttgttatttacaaggtgtccagagtgaagtgcagttggtggagtccggggganacgttggtccagccctgggacgggtccctgagactctcctgtgtcgcctcgtggacttcaccatcaagtgaccatatatggactgggccncaggctccgaggggaggctggagtggctggccgagaagtaaaaacagttnaccagtctttancacgagtacgtacgccgaggtctaggtagaaacgccaagtaccctttccgaacccccgtgtaccgaaaggtacgtaacttacggtaaaccctttaccgaaaaggttaaacccttcgtaaagtttcggaacttttacccgtaggaaacccgtaaattccgggaaaaccctttaaacccggtaaacgaaaaaaccccgggtagggaaaccccgtaccggggacttaaagttcggtaaaacgttttagtttgggttacgtttaggtttagttttaaactataccggtaaagggtaaaccttggtaccccg

SEQ ID NO: 291454 - DNA, 681 bp, Homo sapiens
  misc_feature: GYAE6OF01CR9UA.44.36.D03.1.454.CMB.1.raw
  modified_base (220)..(220): a, c, t, g, unknown or other
  misc_feature (220)..(220): n is a, c, g, or t
tcagacagtatatacacgaccggtgctcgatttagctgcgtcacgatctctcttggggcagagctctggggaggaactgctcagttaggacccagacggaaccatggaagccccagctcagcttctcttcctcctgctactctggctcccagacttccaccggacgaaattgtgttgacacaatctccagccaccctgtctttgtccgtccgggggaacncgccacctctcttgcgagggccgcagactgtgacgacgacttagcctggtaccaacagaagcctggccacggcctccccagtacctcctcatctatgattaccttcgtagtacgggccttctgggaccactccccgacgccccgtcttcgaggtcggctaggtgggtctagggactagtccttcgacctctaccaccactaccaaccacgtaccctaagacgtacccgtaggaacgttagttttcgacttagttttaacttacgttgtaccgtaaccgtaaccggtaacggtaacggttccggtacccttaccgtaaactttaccttaccgttaccggtttcccggacccggttaaccgggaacccgttaaaagggttcgggtaaattaactaaccgtaaaaaccggtaaccgttagggttacccggtcttaaccgggaccctaacccgtaagtttacccg

SEQ ID NO: 291455 - DNA, 714 bp, Homo sapiens
  misc_feature: GYAE6OF01CW3OY.44.36.D03.1.454.CMB.1.raw
  modified_base (322)..(322): a, c, t, g, unknown or other
  misc_feature (322)..(322): n is a, c, g, or t
  modified_base (370)..(370): a, c, t, g, unknown or other
  misc_feature (370)..(370): n is a, c, g, or t
tcagacagtatatacacgaccggtgctcgatttagctgcgtcacgatctctcttggggagctctgagagcggagccccagccccagaattcccaggttgttttcatttggtgatcagcactgaacacagaggactcaccatggagttcgggctgagcgttgggttttccttgttgttatttacaaggtgtccagagtgaagtgcagttggtggaggtccgggggagacgttggtccagccgtgggacggtccctgagactctcctgtcgtcgcctcgtggacttcaccatcagtcgaccacttatagtcggacgtgggtccnccgaggctccggaaggggaacggggctgggagtgggcgttgggccganaaagttaaaaaacgaaggttcgacccgtaagtcttttaagactaacgaggtaacgtaccgcccgtacgttctggtaacgaaacgcccgaagtacttcccgaacccttcgtaaccgaaaggagtaacttggtaaacctttacaaacgtaacttctaagtttcggtaatttcgtaggaacgtaacttacggaaaccctttaaaccggaaggtaaaaacccgagggaacccgaaccggggtaccttaaagttcggtttaaatttttagtttgggtttagttttaggtttaagtttttaaacgtaactttacgggaaacggttaaacccgttcggttaaacccccggg

SEQ ID NO: 291456 - DNA, 672 bp, Homo sapiens
  misc_feature: GYAE6OF01CZLMM.44.36.D03.1.454.CMB.1.raw
  modified_base (503)..(503): a, c, t, g, unknown or other
  misc_feature (503)..(503): n is a, c, g, or t
  modified_base (590)..(590): a, c, t, g, unknown or other
  misc_feature (590)..(590): n is a, c, g, or t
tcagacagtatatacacgaccggtgctcgatttagctgcgtcacgatctctcttggggagctctgagagcggagccccagccccagaattcccaggttgttttcatttggtgatcagcactgaacacagaggactcaccatggagttcgggctgagtcgttgggtttttccttgtttgtttattttacaaggtgtccagagtgaagtgctagttggtggaggtccgggggagacgttggtccagccgtgggacgggtccctgagactctcctgtcgtccgcctcgtggtacttccaccatcagtcgaccactatagtggacgtcgggtccgccgaggcctaccggaggggaacggggcgtagggagtgggcgttgggacccgtagtaaaggtaaaaaactaaggttcgacccgtaagttcttttaacaccaacgtaaggtacggttaccgccggtcgttcgtaggtaacgaaacgtccctaaggtacctttcccaaccccttntaaccgaagacgtatacgtaaccttacgaaacgtactctaatttgaatttcgagacgtaatacgaaccttaacgacgaaaaaccggnggaaccgacgggtatagttaggttaatttagttggttacgtttgtttagtttaatactacgaaaggtacgttcgtaacccgg

SEQ ID NO: 291457 - DNA, 560 bp, Homo sapiens
  misc_feature: GYAE6OF01BR9BW.44.36.D03.1.454.CMB.1.raw
  modified_base (381)..(381): a, c, t, g, unknown or other
  misc_feature (381)..(381): n is a, c, g, or t
  modified_base (441)..(441): a, c, t, g, unknown or other
  misc_feature (441)..(441): n is a, c, g, or t
  modified_base (474)..(474): a, c, t, g, unknown or other
  misc_feature (474)..(474): n is a, c, g, or t
  modified_base (501)..(501): a, c, t, g, unknown or other
  misc_feature (501)..(501): n is a, c, g, or t
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgtggtttctgtgttatttacaaggtgtcagagtgaagtgcagttggtggagtccgggggagacttggtccagcctgggacgggtccctggagactctcctgtgtcgcctcgtggattcaccatcagtgaccactatatggactggggtcccgccgaggcctccgaggggaagggcgtgggagtggcgttggccgagaaagtaaaaacgaagttgccagtctttancacagacgtaccgccgcgtcgtgtagaaacgccaagtacttcccaccctctaacaagganagtgacttacgaagtactactattgaatttcgngactaatgaacctaacgtagaaaccgnggacgacggactagtgttattagttgtgttagttgtttatatgaacggtactgtacccg

SEQ ID NO: 291458 - DNA, 627 bp, Homo sapiens
  misc_feature: GYAE6OF01BWKLT.44.36.D03.1.454.CMB.1.raw
  modified_base (383)..(383): a, c, t, g, unknown or other
  misc_feature (383)..(383): n is a, c, g, or t
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttatttacaaggtgtccagagtgaagtgcaggttggtggaggtccgggggagtacgttggtccagccgtgggacgggtccctgagactctcctgtgtcgcctctggattcaccatcagtcgaccactatatggactgggtccgcgaggctccgaggggagggctgggagtggcgttggccgacaagtaaaacaagttgcctagtctttancacagacgtacgccgtcgtctggtagaaacgccgaagtacttcccacccttctacgaaaggagtatacgacctttacgaaacgtaaccttactatttcgactttctacgtacgtaattacgtaaaccttaaaccgtacggaaaaacccgcgggaaccgaccggggactaaggttgtttaagtttagtttggttagtttaggtttagttttaatacgttacgaagggttaaccttcggtaccccg

SEQ ID NO: 291459 - DNA, 571 bp, Homo sapiens
  misc_feature: GYAE6OF01B2XLD.44.36.D03.1.454.CMB.1.raw
  modified_base (164)..(164): a, c, t, g, unknown or other
  misc_feature (164)..(164): n is a, c, g, or t
  modified_base (217)..(217): a, c, t, g, unknown or other
  misc_feature (217)..(217): n is a, c, g, or t
  modified_base (284)..(284): a, c, t, g, unknown or other
  misc_feature (284)..(284): n is a, c, g, or t
  modified_base (320)..(320): a, c, t, g, unknown or other
  misc_feature (320)..(320): n is a, c, g, or t
tcagacagtatatacacgaccggtgctcgatttagctgcgtcacgatctctcttggggcagagctctggggaggaactgctcagttaggacccagacggaaccatggaagccccagcgcagcttctcttcctcctgctactctggctcccagataccactgganaaatagtgatgacgcggtctccagcccacctgtctgtgtctccgaggggaaancgccaccctctcctgcagggccagtcagagtgttagcagcaacttagcctcgtaccagcagaaatcnggccaggcctcccgaggcctcctcatctagtggtcncactcccaccgacggccacgtcggtactcccgagccgtaggttcaggtcggcgtaggtcgggtcgtgggacaggtacgttcactctacaccgtatcacgcacgtcctgacagtctagtaagttgtttcgacttagtttattacgtgtacagtactaagttataagtgtacgtcggtcccttcccggtacggccgtaaacgggaccaccggtacgtacgggtaaagtaaacgttaaacggtaacgttacggg

SEQ ID NO: 291460 - DNA, 528 bp, Homo sapiens
  misc_feature: GYAE6OF01AE9CA.44.36.D03.1.454.CMB.1.raw
  modified_base (218)..(218): a, c, t, g, unknown or other
  misc_feature (218)..(218): n is a, c, g, or t
tcagacagtatatacacgaccggtgctcgatttagctgcgtcacgatctctcttggggcagagctctggggaggaactgctcagttaggacccagacggaaccatggaagccccagcgcagcttctcttcctcctgctactctggctcccagataccactggagaaatagtgatgacgcggtctccagcccaccctgtctgtgtctccagggggaaangcccaccctctcctgcagggccagtcagagtgttagcagcaacttagcctcgtaccagcagaaatctggccaggctcccaggcctcctcatctatggtgcatccaccgacgggccacgtggtactcccagccaggttcaggtggctaggtgggtctggggacagagttcactctcaccatcagcacgtcctgcagtctagagtattttgacttagtttacttacgtgtacagtactaagtatagtgtacgtcggtcccttccgtacggcccgaaggaccacgtacgtaggaagtacttaaacgagtcggg

SEQ ID NO: 291461 - DNA, 791 bp, Homo sapiens
  misc_feature: GYAE6OF01CK7MJ.44.36.D03.1.454.CMB.1.raw
tcagacagtatatacacgaccggtgctcgatttagctgcgtcacgatctctcttgggggactcctgtgccccaccatggacactctttgctacacactcctgctgctgaccaccccttcctgggtcttgtcccaggtcaccttgaaggagtctggtcctgtgctggtgaacccacagagaccctcacgctgacctgcaccatctctgggttctctctcaacgatattagaatgggtgtgagctggatccgtcagcccccagggaaggccctggagtggcttgcacacatcttctcgaatgacgaaaatcctacagtacatctctagaagagactaacgtttaaaccatacttacccaaaggtaaccaaccctacccaaaaacgggtaccgtaagggttacggttacttttaagggttaactacggtaacccaaaactaacgtacgggaacccccttggaccggggtaaaccaaaccgtaacggggacccaaacgtaaacgttaacgttttaaccgttacggttacggaaccggtaaaccggggggtttaaaacttcggggaaaccgggggaaaaaacggaaaaacccggtagggtacccgttttaggggttttaccttagggtttaaattttaacgtttaaaacggtttacccttttaaacccgtaacttaccggttagggttaacccgggttaccgggttaacgggggggtaacccaaaaaaccggggggggtacccctaaaccgggggttccccgaaaccccgggtttcccgtaccccgttaaccccgg

SEQ ID NO: 291462 - DNA, 577 bp, Homo sapiens
  misc_feature: GYAE6OF01BO28Z.44.36.D03.1.454.CMB.1.raw
  modified_base (455)..(455): a, c, t, g, unknown or other
  misc_feature (455)..(455): n is a, c, g, or t
tcagacagtatatacacgaccggtgctcgatttagctgcgtcacgatctctcttggggatcacataacaaacacactcctcctctaaagaagcccctgggagcacagctcatcaccatggactggacctggcggttcctctttgtggtggcagcagctacaggtgtccagtcccaggtgcagctggtgcagtcgtggggctgaggtgaagagccgtgggtcctcggtgaaggtctcctgcaaggcttcgtggaggcctaccttcttcagtctatgtcttttagttgggtgcgacgacggccccgtggacgaagggcttggagtggcgtgggaggatcactcctattcgtttggtgcatacgaacttacgctacagtaagtttcgaggacagacgtaccaacctacgttaccggacggaacgtaactccgacgacgtacacgacctagagtcggancgtagacgcgaggctgaagtactacgtaggaacgaaccgacggacctattacgttacgtttcgtaggtcggacggacggtaccgtcccgtacgttactaacctttcacgttaccgttacccc

SEQ ID NO: 291463 - DNA, 559 bp, Homo sapiens
  misc_feature: GYAE6OF01DXGCM.44.36.D03.1.454.CMB.1.raw
  modified_base (351)..(351): a, c, t, g, unknown or other
  misc_feature (351)..(351): n is a, c, g, or t
  modified_base (506)..(506): a, c, t, g, unknown or other
  misc_feature (506)..(506): n is a, c, g, or t
tcagacagtatatacacgaccggtgctcgatttagctgcgtcacgatctctcttggggatcacataacaaccacactcctcctctaaagaagcccctgggagcacagctcatcaccatggactggacctggcggttcctctttgtggtggcagcagctacaggtgtccagtcccaggtgcagctggtgcagtcgtggggctggaggtgaagaagccgtgggtcctcggtgaaggtctcctgcaaggcttcgtggaggcacttcttcagtctatgtcttttagttgggtgcgtacgacggcccctaggacaagggcttgagtggcgtgggaggatcatccctatcgtttggnctagtcgtaattcgctacgtagtaagtttcaggacagacgtccaacagttaccgacggaacaatcccgaagagtaaccagtacctaacagtggaacgctaggacgtcgaaggtctaggacgtatcgagaacgacgacggcctatcttagtttcgnggtacgcggacgtaccgtcccctagtactaaacgtttcaagttccgttacccc

SEQ ID NO: 291464 - DNA, 585 bp, Homo sapiens
  misc_feature: GYAE6OF01E23B0.44.36.D03.1.454.CMB.1.raw
  modified_base (351)..(351): a, c, t, g, unknown or other
  misc_feature (351)..(351): n is a, c, g, or t
  modified_base (361)..(361): a, c, t, g, unknown or other
  misc_feature (361)..(361): n is a, c, g, or t
  modified_base (524)..(524): a, c, t, g, unknown or other
  misc_feature (524)..(524): n is a, c, g, or t
  modified_base (549)..(549): a, c, t, g, unknown or other
  misc_feature (549)..(549): n is a, c, g, or t
tcagacagtatatacacgaccggtgctcgatttagctgcgtcacgatctctcgttgggggggagacgagcccagcactggaagtcgccggtgtttccattcggtgatcatcactgaacacagaggactcaccatggactttgggctgagattgggttttcctcgttgcttcttttaagaggtggccagtgtcaggtgcagctaggtggagtcgtgggggagagccggcccagcctgggaacctcccgtgacgactctcctgtgcagcctctggattcatcttcaggacctatcgccatcgcacgtcgggtcccgccgaggcctccgaggccgaaggggctgggaggtgggngactaattanatcgaagaagtagtaggaattaggaaacgtaacgtacgtaacgggaacgtaccgtaccggaagggaaacgggccgtaattcccgacccgtcctaccgagaacgaacctaacgttccgaaggaaccacgactgactatcagacaaatctaaccactacacgagngacgacacggtctgtatagttgtgngacgtacgaccgacccctcggacgtcccggtacccg

SEQ ID NO: 291465 - DNA, 666 bp, Homo sapiens
  misc_feature: GYAE6OF01CXSY8.44.36.D03.1.454.CMB.1.raw
  modified_base (319)..(319): a, c, t, g, unknown or other
  misc_feature (319)..(319): n is a, c, g, or t
tcagacagtatatacacgaccggtgctcgatttagctgcgtcacgatctctcgttggggggagacgagcccagcactggaagtcgccggtgtttccattcggtgatcatcactgaacacagaggactcaccatggactttgggctgagattgggttttcctcgttgcttcttttaagaggtggccagtgtcaggtgcagctagtggagtcgtgggggagagccggcccagccgtgggaacctccctgagtactctccgtgtgcagccctgtggattcatcttcaggtacctagtgcccagtcgcctacgtcgggtcccnccgaggcctaccgaggacgaaggggctgggaggtgggtcgactaaattagtatagaagaagagtggaaattggaaagaaacacgtaaggaagaccgtacggaaggtaacgggccgtaacgttccgaacccgtctacccgaagaagaacctaaacgttccgaaagtaaccaaccaacgttgaacctataccgtagaccgtaaaagtacgtaaaccaaccgttaccaaacgtaacggtacgaacgggaacccgaacgggtaccgttacgtacgtttaatttaggttcggtacggaccgtaaccgtaccgaccccccgtacgggaacccgtaccccggggttaccccccg

SEQ ID NO: 291466 - DNA, 695 bp, Homo sapiens
  misc_feature: GYAE6OF01CPIOL.44.36.D03.1.454.CMB.1.raw
  modified_base (307)..(307): a, c, t, g, unknown or other
  misc_feature (307)..(307): n is a, c, g, or t
tcagacagtatatacacgaccggtgctcgatttagctgcgtcacgatctctcttgggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggcccagcctgggaacctccctgacgactctcctgtgcagcctctggattcatcttcaggacctatcgccatcgcacgtgggtcccnccaggcctccgaggcgaaggggctgggagtgggtgacaagtttatatcaaggtaaagtagtagggaatttggaaagaactaacgtacgggaagtaccgtaccggaaggaacggggaccgtacttaccgaacccgttcaccgaaaggacgaaccgtaaacttacccgaaacgggtaaccaacccgtaacgttcgaccgtaacttaccgtagaacctaaaacgtttccggtaaaccctaaacccgttaaccgaacctaaaaggttcggaaaccggtaccggtaaccgggtccgttagggttaccctttaagttttagttacggtacggtacccggtaacggtaccccggtaccccccgttacgggaaccggtcccccgggttacccccgg

SEQ ID NO: 291467 - DNA, 668 bp, Homo sapiens
  misc_feature: GYAE6OF01DJJYB.44.36.D03.1.454.CMB.1.raw
  modified_base (355)..(355): a, c, t, g, unknown or other
  misc_feature (355)..(355): n is a, c, g, or t
tcagacagtatatacacgaccggtgctcgatttagctgcgtcacgatctctcttggggatcacataacaaccacactcctcctctaaagaagcccctgggagcacagctcatcaccatggactggacctggcggttcctctttgtggtggcagcagctacaggtgtccagtcccaggtgcagctggtgcagtctggggctgaggtgaagaagcctgggtcctcggtgaaggtctcctgcaaggcttctggaggcctaccttcttcagtctatgtcttttagttgggtgcgacgacggccccgtggacgaagggtcttggagtggcgtggggaggatctatcctattcgtttggtncatcgtaattacgcacgtagtaagtttcgaggtacagtacgtaccacctaacgttacccggacggaacgaactacccgaaccgtagtaaccgacgtaccctaacgaagtgggaacgccgttagggacgacgtagggtaccgtaggtaacgtacttccggttaaggaacggtaaacccggaacccgggtaccctaaacgttttccgttaacgtttttcccgtagggttacgggacccgggtaacggtacccggtcccccgtttaccggttaacccttaaaccgtttttccaaaccgtttacccggttacccccc

SEQ ID NO: 291468 - DNA, 714 bp, Homo sapiens
  misc_feature: GYAE6OF01BAJSL.44.36.D03.1.454.CMB.1.raw
  modified_base (329)..(329): a, c, t, g, unknown or other
  misc_feature (329)..(329): n is a, c, g, or t
tcagacagtatatacacgaccggtgctcgatttagctgcgtcacgatctctcgttggggggagacgagcccagcactggaagtcgccggtgtttccattcggtgatcatcactgaacacagaggactcaccatggactttgggctgagattgggttttcctcgttgcttcttttaagaggtgccagtgtcgaggtgcagtctagtggagtcgtgggggagagcggcccagccgtgggaacctcccgtgacgactctcctggtcgcagcccttcgtggtattcattcgttaccgaggtaccctatcgccagtcgcctacgtcgggtcccncgacggtcctaccgagggtacgaaggggtccttagggaggtcgggtacggactaaagtttatagtacgaaaggtaagagttaggaaagttagaaaacgaacgtaacgtagggaactaccgtacggaacggaacgggccgtaacgttacgtacccgtactaccgaagtaacgactaaacgttaccgaaacggtaaccaaccgtacgtacgacctaacgtaccgtaacgtaacgtaaacgtacgtaaacctaaccctaacgtaaccgaaacggttacggaacggtaacccgaccggtacgttagttaaccttagttacgttacgtcgggaacccgtacgggaaccccgtacccccgttacggaacccggtcccgggttaccccccgg

SEQ ID NO: 291469 - DNA, 563 bp, Homo sapiens
  misc_feature: GYAE6OF01DUUUJ.44.36.D03.1.454.CMB.1.raw
  modified_base (333)..(333): a, c, t, g, unknown or other
  misc_feature (333)..(333): n is a, c, g, or t
  modified_base (382)..(382): a, c, t, g, unknown or other
  misc_feature (382)..(382): n is a, c, g, or t
tcagacagtatatacacgaccggtgctcgatttagctgcgtcacgatctctcttggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggccagcctgggaactcctgagctctctgtgcagcctctggattcattcttcacggacctatgccatcgcacgtgggtcccgccaggctccgaggcaaggggctgggagtgggnggactaagttatatcaagaagataggaattgaaagaacacgtacggganacgtaccgagaacgggccgattcaccgtcctacgagagacaacttccaaggaacacacgtcactactcgtacgactaaactcgtaaccaacctacaacgaacgtaggaacggaccgacgcgttcgtacttagttacgttgtcgacgtacgacccgcccccgtacgacggaccccggtcccg

SEQ ID NO: 291470 - DNA, 812 bp, Homo sapiens
  misc_feature: GYAE6OF01BBCDA.44.36.D03.1.454.CMB.1.raw
tcagacagtatatacacgaccggtgctcgatttagctgcgtcacgatctctcttggggagctctgagagcggagccccagccccagaattcccaggttgttttcatttggtgatcagcactgaacacagaggactcaccatggagttcggctgagctggttttccttgttgttatttacaaggtgtccagagtgaagtgcagttggtggaggtccgggggagtacttgggtccaggccgtgggacgggtccctgagacctctccgtgtcgtcgcctcgtggacttcacctatcagtcgaccactatatggacgtgggtccgccgaggcctccgagggaacgggctgggacgtggcgttgggaccgtacgaacggtaaaaaactaaaggttcgaccctaaggtcctttaagtaccgaaccgtaaggtaacgtaacccggcccggtacgttacgtgggtaacggaaaaacggcccctaaaggtactttacccctaacccccgtacgttacgaaaacggtacgggtaaccttacggtaaaccccttttacgaaaaacggttaaccctttacctaaagtttttcggaaacttttccggttaacgggaaccccgttaaaagtttaaccgggtaaaccccttaaaacccggttaaaccggaaaaaaaaccccggggtagggtaaacccggaaacccgggggtaactaaacggttacggttttaaaagttacgtttttagggttacggttttttaggttaacgtttttaaacgttaaacttacccggttaaaggttaaacccgttccgggttaaccccg

SEQ ID NO: 291471 - DNA, 604 bp, Homo sapiens
  misc_feature: GYAE6OF01EYWF4.44.36.D03.1.454.CMB.1.raw
  modified_base (318)..(318): a, c, t, g, unknown or other
  misc_feature (318)..(318): n is a, c, g, or t
  modified_base (394)..(394): a, c, t, g, unknown or other
  misc_feature (394)..(394): n is a, c, g, or t
  modified_base (525)..(525): a, c, t, g, unknown or other
  misc_feature (525)..(525): n is a, c, g, or t
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcaggttgggtggaggtccgggggagacttggtccagcctgggacgggtccctgagactctcctgtgtccgcctctggattcaccatcagtcgaccactatatgggactggggtcccnccgaggcctccgaggggagggcgtgggagtggcgttgggccgacgaagtaaaaacgaagttcgacctagtctttancacagacgtacgccgtgtctgtagaaacgccagtacttccaccctctacaaagagtatcgaaccttacgaaacgtaaccttacatttgtactttcgtagacgtaatcgtaactaacccgtagaaaacccgngggaaccgacgggactagttaggtaatttagttggttgtttagtttagtttaatagttacgtaggtaacctcgtacccg

SEQ ID NO: 291472 - DNA, 566 bp, Homo sapiens
  misc_feature: GYAE6OF01AU5PA.44.36.D03.1.454.CMB.1.raw
  modified_base (350)..(350): a, c, t, g, unknown or other
  misc_feature (350)..(350): n is a, c, g, or t
  modified_base (443)..(443): a, c, t, g, unknown or other
  misc_feature (443)..(443): n is a, c, g, or t
tcagacagtatatacacgaccggtgctcgatttagctgcgtcacgatctctcttggggatcacataacaaccacactcctcctctaaagaagcccctgggagcacagctcatcaccatggactggacctggcggttcctctttgtggtggcagcagctacaggtgtccagtcccaggtgcagctggtgcagtctggggctgaggtgaagagcctgggtcctcggtgaaggtctcctgcaaggcttctggaggctaccttcttcagctatgtcttttagttgggtgcgacgacggcccctggacgaagggtcttggagtggcgtgggaggatcgactcctatcgtttggtnctatcgtaattacgctagagtaagtttcaggacagagtacaacctattaccggcggaacaactcccgaacgtacgtaacctacgacccttaanacgttacggacgtacgtaggacggcgaggtcgtaggagtacgtacgtagaacgacgtacggctatcttattcgtgtcggacgacgacgtccccgtacgtactaacgtttcagttcccgtaccc

SEQ ID NO: 291473 - DNA, 673 bp, Homo sapiens
  misc_feature: GYAE6OF01A2E66.44.36.D03.1.454.CMB.1.raw
tcagacagtatatacacgaccggtgctcgatttagctgcgtcacgagtctctcttgggatcacactaaccaacccacactcctcctctaaagaagcccctgggagcacagctcatcaccatggactggacctggcggttcctctttgtggtggcagcagctacaggtgtccagtcccaggtgcagctggtgcagtctggggctgaggtgaagaagcctgggtcctcggtgaaggtctcctgcaaggcttctggaggctaccttcttcagtctatgtcttttagtttgggtgcgtacgacggcccccgtggacgaagggcctttggaggttgggcgtagggggacggacgtactaccgttaccgttacgttcgttggcgtactacgtacgtaacttacgactaacgtaagttaacggttacgaacggacgtaacggtacgtaccaaccgttaacgttacccgggaccggtaaacgtaccgtaaccgaacggtaacgaacgtcccgttaacgtacgtacggtaggacgtcgaggacggacgtacggtacgtacggtaagtacgtacgtaaaggaccgaaccgaccgtacgtacgttacttacgttccgtagtacggacggtaccgtacctcccggttactaacgtttaaccttacgttaccgtacccgttacccc

SEQ ID NO: 291474 - DNA, 755 bp, Homo sapiens
  misc_feature: GYAE6OF01C991L.44.36.D03.1.454.CMB.1.raw
tcagacagtatatacacgaccggtgctcgatttagctgcgtcacgatctctcttggggatcacataacaaccacactcctcctctaaagaagcccctggagcacagctcatcaccatggactggacctggcggttcctctttgtggtggcagcagctacaggtgtccagtcccaggtgcagctggtgcagtcgtggggctggaggtgaagacgccgtggtcctcggtgaaggtctccgtgcgaaggtcttcgtggacggctaccttcttcagtcttatgttcttttagtttgggtcgtaccgacgtacggtcccctaggaccgtaagggtcgtttaggagggtggtcggttaggggagggtacttccgaacgtttaccccttagtttccgttttagggtcgtaccgtaacgttaccggtaaactttaccggacctaaacgtaaggttaaaacggtttaccgaaacgggtaacgtaagggtaccgttacccgaaaccgtaacgtttacccggacggaaacgtaaccgtacccgaacggtaacgtaaccgacgtacccgtaagtacgtacgggaacgtcgtacggacggacgtaacgggtccgtaagggtaaccgttacgtacgtaacggaaacggtacccgacggtaccctaagtttccgtttaacgtttccgtggttacggaccggtaacccggtccgttacccccgttacggttaacccgttaaccttttaccgaaccgttaccccgttacccc

SEQ ID NO: 291475 - DNA, 804 bp, Homo sapiens
  misc_feature: GYAE6OF01B2H3K.44.36.D03.1.454.CMB.1.raw
  modified_base (333)..(333): a, c, t, g, unknown or other
  misc_feature (333)..(333): n is a, c, g, or t
tcagacagtatatacacgaccggtgctcgatttagctgcgtcacgatctctcttggggagctctgagagcggagccccagccccagaattcccaggttgttttcatttggtgatcagcactgaacacagaggactcaccatggagttcgggctgagtcgttgggttttccttgttgtttattttacaaggtgtccagagtgaagtgctaggttgggtggaggtccgggggagtacgttggtccaggccgtgggacgggtccctgagactctccgtgtcgtccgcctctggacttccaccatcagtcgaccactatagtggacgtcgggtcccnccgaggcctaccggaagggggacgggcgtgggaggtcgggcgttcgggacccgacgaaaaggtaaaaaacgtaaggttcgaccctaaggttacttttaagaccaacgtaaggtacggtaacccggcccggtcgttacgtaggtaacggaaaacgcccgtaaagtacctttaccccaaccccttacgtaacgaaaaggacgtaacgttacggtaaaccctttaaccgaaaacgttaaacccttcgtaacgtttacggtaacttttccgaacgggtaaccgtaaacttacgggtaaaccccttaaacccggtaaccgggaaaaaacccggacggggtaaacccgaccggggtaaccttaaaggtttcggtttaaattttaacggttttcgggtttagtttttaaggttttaaggtttttaaacttaacgttaaccgggtaaacgggtttaaacccgttcggttaacccccggg

SEQ ID NO: 291476 - DNA, 626 bp, Homo sapiens
  misc_feature: GYAE6OF01EJ1NQ.44.36.D03.1.454.CMB.1.raw
tcagacagtatatacacgaccggtgctcgatttagctgcgtcacgatctctcgttgggggggagacgagcccagcactggaagtcgccggtgtttccattcggtgatcatcactgaacacagaggactcaccatggactttgggctgagattgggtttttcctcgttgcttcttttaagaggtggccagtgtcaggtgcagctaggtggagtcgtgggggagagcggcccagccgtgggaactccctgagactctcctgtgcagcctctggattcattcttcaggacctatcgccatgcacgtcggggtcccgccgaggcctccgagggcgaaagggggctagggaggtggggtggactaagtttatatcgaaggaaagtagtaggaatttaggaaagtaaacacgtaacggagacgtaccggaaggaacgggccgtattcacccgtctaccgagacgactaacgttaccgaacgaacacactgacatctacgacaaatacgtaaccaacctacaacgtaaacgtaggaacggaaccgtacggtcgtacgttacgttaatttagttgtacggaccggtaacggtacccgaccccccgtacggaccggtacccgggttaccccccgg

SEQ ID NO: 291477 - DNA, 722 bp, Homo sapiens
  misc_feature: GYAE6OF01CMIIN.44.36.D03.1.454.CMB.1.raw
  modified_base (284)..(284): a, c, t, g, unknown or other
  misc_feature (284)..(284): n is a, c, g, or t
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtcgttgggttttccttgtttgtttattttacaaggtgtccagtagtgaagtgcaggttggtggaggtccgggggagtacgttggtccagccgtgggacggtccctgagactctccgtgtcgtccgcctntggtattccaccatcagtcgaccatatagtggacgtcggtccgccgaggcctccggaagggggacggggcgtgggaggtcgggcgttcggacccgacgtaaaacggtaaaaaacgtaaaggttccgaccctaaggtacctttaacgacgaaccgaggaacggtacccgccgtacggttctagggtaacggaaacgaccctaagtacctttaccccgaacccttactaaccgaaaggagtacgttacgtaaccctttaacgaaacgttaacctagtaatttcgaactttcgtacggtaactaaacgttacgaaaaccctttaaccggaacggaaaaaccggcgggaaccgaacgggtctaagttagttaacttttaaggttggtttagttttagtttattttaacgtaattaccggaaacggtcgttcgttaaccccgg

SEQ ID NO: 291478 - DNA, 603 bp, Homo sapiens
  misc_feature: GYAE6OF01BLFRW.44.36.D03.1.454.CMB.1.raw
  modified_base (184)..(184): a, c, t, g, unknown or other
  misc_feature (184)..(184): n is a, c, g, or t
tcagacagtatatacacgaccggtgctcgatttagctgcgtcacgagtcgtctccgttggggggacacgagtcccagcactggaagtcgccgtgttccattcgtgatcactcactgaacacagacggactcgaccgtagtggactttgggctgtagtattgggttttcctgttgctctttaagnggtgcagtgtcaggtgcagcgtagtggagtcgtgggggagacggccggccgagcctacgggaactcctagacgacttccgtcgtgtcgcacgtcctgtaggactttcattccgttagacggtaccttacgtcgaccctaagtcgaccgacggtcgggtccacgtacgggtctaccgaggtacgtaggggtctaggacggttggaccgagttaaatttcagtacgagaaagtacgaggtaactaggaaacgacgtacgtaaggaccgtacgtacgaaggacggactactacgaccgtactacgagactagactcgaagacacgactgacatcacgactaagtacgacactacaagatacggaactcgagtactgtactatgtgtagacgtacgacccgaccgtacgcggtacccgtccgg

SEQ ID NO: 291479 - DNA, 744 bp, Homo sapiens
  misc_feature: GYAE6OF01DVLQL.44.36.D03.1.454.CMB.1.raw
tcagacagtatatacacgaccggtgctcgatttagctgcgtcacgatctctcttggggagctctgagagcggagccccagccccagaattcccaggttgttttcatttggtgatcagcactgaacacagaggactcaccatggagttcgggctgagtcgttgggttttccttgttgttattttacaaggtgtcagagtgaagtgcgtaggttggtggaggtccggggagtacgttggtccgagccgtggacgggtcctgacgactctccgtgtcgtcgccgtcgtgtcttcaccatcagtcgaccatatagtggacgtcggtccgccgacggccgtaccggaaggggaagggtcgtgggtaggtcgggtaccgttcgggaccgaacgtaaaacggtaaaaaacgtaaggtttcgaccgtaagttacttttaacgtaccgaaacgaacggtaacggtacccggacccggtaccgttaccgttaggtaacggaaaaccgtccgtaaacggtacctttaccccgacccctttacgtaaacgaaacggacgtacgttacgtaaccttacgaaaacgtacttacgtaagttacgtaatttcgagtaaccgtaaagtacgtaaacccgtaaaccgtaacggaaaacccgacgggtaaccgaaccggtagaacgttaggttaatttacggttggttacgtttagtttacgtttaataggttaacgtaaccgggtaattccggggtaacccg

SEQ ID NO: 291480 - DNA, 592 bp, Homo sapiens
  misc_feature: GYAE6OF01BDYZC.44.36.D03.1.454.CMB.1.raw
  modified_base (328)..(328): a, c, t, g, unknown or other
  misc_feature (328)..(328): n is a, c, g, or t
  modified_base (387)..(387): a, c, t, g, unknown or other
  misc_feature (387)..(387): n is a, c, g, or t
  modified_base (523)..(523): a, c, t, g, unknown or other
  misc_feature (523)..(523): n is a, c, g, or t
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgtgggttttccttgttgttattttacaaggtgtccagagtgaagtgcagttggtggaggtccgggggagtacgttggtccaggccgtgggacgggttccctggacgtactctccgtgtgtcgcctgtggattcaccattcagtcgacctactactagtcggacgtgggtccncgaggctcgaggggagggctgggagtggcgtggcgacaagtaaaacagtgcagctttanctacgagtacgtacgcgcgtcgtgtagaacgccagtacttacccacctctaacaagacgagttacgacttacgaaagacctataattgtacttacgcgtacgtaagtacgtaaccctaacgtaacggaaaacccgnggaacgtacgggactaagttgttaattagttcgtgttattaggttactatacgtaaggacttgtacccg

SEQ ID NO: 291481 - DNA, 570 bp, Homo sapiens
  misc_feature: GYAE6OF01AGEJP.44.36.D03.1.454.CMB.1.raw
  modified_base (220)..(220): a, c, t, g, unknown or other
  misc_feature (220)..(220): n is a, c, g, or t
tcagacagtatatacacgaccggtgctcgatttagctgcgtcacgatctctcttgggacagagctctggggaggaactgctcagttaggacccagacggaaccatggaagccccagcgcagcttctcttcctcctgctactctggctcccagataccactggagaaatagtgatgacgcggtctccagcccaccctgtctgtgtctccgaagggggaaancgcccaccctctcctgccagggccagtcagagtgttagcagcaacttagcctcgtaccagcagaaatcgtggccaggcctcccgaggtcctcctcatctatggtgcactcccaccgacggccacgtggtactcccagccgtaggttcaggtcggcgtaggtcgggtcgtaggggactagtacgttcactctaccacctactcacgcacgtcctgctagtcgtagtaagttgttttcgacgttagtttacttacgtgtacacgtactagtaatagtcgtacgtcgtcccttcccgtacggccgaacgggtaccacggtacgtaggtaagtaacttaaacggacgttacggg

SEQ ID NO: 291482 - DNA, 619 bp, Homo sapiens
  misc_feature: GYAE6OF01BMLMH.44.36.D03.1.454.CMB.1.raw
  modified_base (223)..(223): a, c, t, g, unknown or other
  misc_feature (223)..(223): n is a, c, g, or t
  modified_base (351)..(351): a, c, t, g, unknown or other
  misc_feature (351)..(351): n is a, c, g, or t
  modified_base (430)..(430): a, c, t, g, unknown or other
  misc_feature (430)..(430): n is a, c, g, or t
  modified_base (437)..(437): a, c, t, g, unknown or other
  misc_feature (437)..(437): n is a, c, g, or t
  modified_base (582)..(582): a, c, t, g, unknown or other
  misc_feature (582)..(582): n is a, c, g, or t
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttatttacaaggtgtccagagtgaagtgcagttggtggaggtccggggganacgttggtccagccgtgggagggtccctgagactctcctgtgtcgcctctggattcacatcagtgaccactatatggactgggtccgccaggctccgagggacgggctagggagtggcgttggccganaagtaaaaacaagttcgacagtctttagcaacgagacgtacgccgtcgtctagtagaaacgccaagtacttccaccctntacaagngatgacttacaagtactctaattgactttcgagacgtaaatacgtaaaccgttaaaccgtacggaaaaacccggtagggaaccgacggggtaactaagttacgtttaagtttagtttcgggttagttttagttacgtttttaaanacgttacggaagggttaaacccgttcggtaaccccgg

SEQ ID NO: 291483 - DNA, 629 bp, Homo sapiens
  misc_feature: GYAE6OF01BSHZ8.44.36.D03.1.454.CMB.1.raw
  modified_base (409)..(409): a, c, t, g, unknown or other
  misc_feature (409)..(409): n is a, c, g, or t
  modified_base (460)..(460): a, c, t, g, unknown or other
  misc_feature (460)..(460): n is a, c, g, or t
  modified_base (468)..(468): a, c, t, g, unknown or other
  misc_feature (468)..(468): n is a, c, g, or t
  modified_base (543)..(543): a, c, t, g, unknown or other
  misc_feature (543)..(543): n is a, c, g, or t
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtcgttgggttttccttgtttgtttattttacaaggtgtccagagtgaagtgcaggttgggtggaggtccgggggagacgttggtccagccgtgggacgggtccctgacgactctccgtgtgtcgcctcgtgacttcaccatcagtgaccactatagtggacgtgggtccgccgaggccgtccggaaggggaggggcgtgggagtggtcgttcggccgacaaagtaaaaacgtaaggttcgacctagtactttanacacagtagtacgccgtcgtcgtgtacgaaacgcctagtacttccaccctnacgaaganatcgaacttacaacgtactactattagtacttcgacgacgtaatacgtaacctaaaccgtaacggaaaacccggnggtaaccgaccgggtactaagttagttaagtttagtttggttagtttgttagttttactagttacgaacggtaacttcggtacccg

SEQ ID NO: 291484 - DNA, 581 bp, Homo sapiens
  misc_feature: GYAE6OF01AFYQ4.44.36.D03.1.454.CMB.1.raw
  modified_base (216)..(216): a, c, t, g, unknown or other
  misc_feature (216)..(216): n is a, c, g, or t
  modified_base (226)..(226): a, c, t, g, unknown or other
  misc_feature (226)..(226): n is a, c, g, or t
  modified_base (432)..(432): a, c, t, g, unknown or other
  misc_feature (432)..(432): n is a, c, g, or t
tcagacagtatatacacgaccggtgctcgatttagctgcgtcacgatctctcttggggcagagctctggggaggaactgctcagttaggacccagacggaaccatggaagccccagcgcagcttctcttcctcctgctactctggctcccagataccactggagaaatagtgatgacgcagtctccagccaccctgtctgtgtctccgaggggaangcccacctcncctgcagggccagtcagagtgtaccagcaacttagcctggtaccaccagaaccgtgggcaggcctcccgaggcctcctcatctatggaacactcccaccacgggcctacgtcggtactccccacccgtaggttccagtggcgtaggtcgggtctgggacaggtaccttcgacctctcaccatcagcagactggacgcctagaagtnttttgctagtagttattacgtgtcacgtcacgtccgttccctcgaccggtcccgtcgttccgtaccggtttccgggggaccgggggtaccgtaagggtcgggaacgtagtaccggtaacggaccgtaacgttcggtgggtccgtaccgg

SEQ ID NO: 291485 - DNA, 687 bp, Homo sapiens
  misc_feature: GYAE6OF01A7V5X.44.36.D03.1.454.CMB.1.raw
tcagacagtatatacacgaccggtgctcgatttagctgcgtcacgatctctcttgggggggagacgagcccagcactggaagtcgccggtgtttccattcggtgatcatcactgaacacagaggactcaccatggactttgggctgagatgggttttcctcgttgcttcttttaagaggtgccagtgtcaggtgcagctagtggagtcgtgggggagagcggcccagcctgggaactccctgagactctcctgtgcagcctctggattcatcttcaggacctatgccatgctacgtgggtccgccaggcctccgaggcaaggggctgggaggtgggtggctaatttatatacgaagaagagtagggaaattaggaaacgaaacaaccgtacggggaacgtaccgtaccggaaggaacggggaccgtagttacccgacccgttaccgtacccgaacgaacgtaacctaaacgttacccgaaacgggaaaccaacctaacgtacgacctaacgttcctagtaacctaaaacgttacgtaaacctaaaccctaaccaaccgtaaaggtacggaacgggaaccgaccgggtaccgttacgggttactttaagtttacgtttaggttacggaccggtacggaacccggttacccccccgtacgggtaccgggtaccccgggttaccccccgg

SEQ ID NO: 291486 - DNA, 838 bp, Homo sapiens
  misc_feature: GYAE6OF01BX70A.44.36.D03.1.454.CMB.1.raw
  modified_base (172)..(172): a, c, t, g, unknown or other
  misc_feature (172)..(172): n is a, c, g, or t
  modified_base (210)..(210): a, c, t, g, unknown or other
  misc_feature (210)..(210): n is a, c, g, or t
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgtggtttcgtgtagtnttacagtgtcagagtgagtgcagtgtggagtcgggganactgtccagcctggagggtcctgagactctcctgtgtcgcctctggattcaccatcagtgaccactatatggactgggtccgccaggcctccggaggggaacggggtctgggagtgggtccgttcgggccgacgtaaagtaaaaaaccgtaaggttacggaccctaaggttaccttttaataccaaaccgtacggtaacgttaacccgggcccgtccggttaccgttggttaacggaaaacggtccccgaaggttaacctttacccgtaaccccccgttacttaacccgaaaaggtaccggtaaacttaccggtaacccgttttaaccaaaaggttaaacccttaccgtaacgttttaggtaacttttccggtacggtaaacccggtaaacgttaacgggttaaacccctttaaaacccggttaaaccgggtaaaaaacccccgggaagggggtaaaccccgaaacccggggggtaacccttaaaacggttttagttttaaacggttttaaacggtttttcgggtttacgggttttttaacgggttttaggttttttaaaacgtttaacggttaacccgggttaaaaaccggggttacccgtttaacccggggtttaaaccccccggg

SEQ ID NO: 291487 - DNA, 759 bp, Homo sapiens
  misc_feature: GYAE6OF01C6BUB.44.36.D03.1.454.CMB.1.raw
tcagacagtatatacacgaccggtgctcgatttagctgcgtcacgatctctcgttggggggagacgagcccagcactggaagtcgccggtgtttccattcggtgatcatcactgaacacagaggactcaccatggactttgggctgagattgggttttcctcgttgcttcttttaagaggtggccagtgtcaggtgcagctagtggagtcgtgggggagagcggccagcctgggactccctgacgactctcctgtgcagcctcgtggattcattccttcgacggtacctatcgaccatgcctacgtcgggtcccgccgaggcctaccgaggcgaacggggctaggggacggtgggtggactaattagtagtcgaagaagtgtaggtaagtagaacgtaacacgtaacggacgtaccgtacgaaggaacgggtaccgtacgttaccgacccgttacctaccgtaaggaacgaaccgtaacttacccgaaacggaaccaaccgaccgttacgaccgtaacgttaccgtaacggtaacctaaagttaccgtaaacccgtaaacccgtaaccgaaaccgtaaacggttaacggaaaccgggtaaacccgtaaccgggtaccgtttaacgggttacccgttttaaagtttaacgggttttaccgggtaccgggtaacccgggttaaccgggtaacccccggttaccccccccgggttaaacgggttaaccccggggtaacccccccgggttaacccccccgggg

SEQ ID NO: 291488 - DNA, 595 bp, Homo sapiens
  misc_feature: GYAE6OF01CHIW1.44.36.D03.1.454.CMB.1.raw
  modified_base (434)..(434): a, c, t, g, unknown or other
  misc_feature (434)..(434): n is a, c, g, or t
  modified_base (451)..(451): a, c, t, g, unknown or other
  misc_feature (451)..(451): n is a, c, g, or t
  modified_base (459)..(459): a, c, t, g, unknown or other
  misc_feature (459)..(459): n is a, c, g, or t
tcagacagtatatacacgaccggtgctcgatttagctgcgtcacgatctctcttggggagctctgagagcggagccccagccccagaattcccaggtgtttcatttggtgatcagcactgaacacagaggactcaccatggagttcgggctgagctgggttttccttgttgttattttacaaggtgtccagagtgaagtgcagttgggtggagtccgggggagacgttggtccagccgtggacgggtccctgagactctcctgtgtcgcctctggattcaccatcagtgaccactatatcggacgtcgggtccgccgacggctccgaggggaagggctgggagtggcgttggccgacaagtaaaaacaagttagaccagtcttatcacagagtacgcgcgtctgtacgaaagcagacttcaccctctacaaganatgacttacgaagactnattgcttncgtacgaattacgaacctaaccgtacgaaaaccggaggaccgacgggacctagttacgttaatttagttcggttaggtttagtttacggttttaaattaacgttaggtaaacggttaaccgttggttaaccccggg

SEQ ID NO: 291489 - DNA, 648 bp, Homo sapiens
  misc_feature: GYAE6OF01BBY9L.44.36.D03.1.454.CMB.1.raw
  modified_base (334)..(334): a, c, t, g, unknown or other
  misc_feature (334)..(334): n is a, c, g, or t
tcagacagtatatacacgaccggtgctcgatttagctgcgtcacgatctctcttgggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggcccagcctgggaactccctgagactctcctgtgcagcctctggattcatcttcaggacctatgccatgcacgtgggtcccgcaggctccgaggcaaggggctgggagtgggngacaattatagtcgagaagagtaggaattagaaagtaacacgtaacggagaccgtaccggaaggaacgggtaccgtacgttaccgaacccgttcctaccgaacgacgaactaaacttcccgaaagggaaaccaccaacgtacgactagtacctacgaccaaaagttccgtaaactaccctaacaacgtaaacggtcgaaacgggacctaccgggtacctacggttaccttaagtttaacgtttacggtacgacccgggtaacggtaccccgaaccccccgttcgggaacccgggtaccccgggttaccccccgg

SEQ ID NO: 291490 - DNA, 578 bp, Homo sapiens
  misc_feature: GYAE6OF01CNJ9A.44.36.D03.1.454.CMB.1.raw
  modified_base (164)..(164): a, c, t, g, unknown or other
  misc_feature (164)..(164): n is a, c, g, or t
  modified_base (219)..(219): a, c, t, g, unknown or other
  misc_feature (219)..(219): n is a, c, g, or t
  modified_base (316)..(316): a, c, t, g, unknown or other
  misc_feature (316)..(316): n is a, c, g, or t
  modified_base (447)..(447): a, c, t, g, unknown or other
  misc_feature (447)..(447): n is a, c, g, or t
  modified_base (462)..(462): a, c, t, g, unknown or other
  misc_feature (462)..(462): n is a, c, g, or t
tcagacagtatatacacgaccggtgctcgatttagctgcgtcacgatctctcttggggcagagctctggggaggaactgctcagttaggacccagacggaaccatggaagccccagcgcagcttctcttcctcctgctactctggctcccagataccactgganaaatgtgatgacgcagtctccagcccaccctgtctgtgtcctccgaaggggaaancgcccaccctctcctgcagggccagtcagagttcgttaccagcaacttagcctaggtaccacagtaaccgtgggcctaggcctcccgaggtcctccncatctagtaggaactactcccacgacgggcctaacgtcggtaactcccaccgtaggttcaggtggctagggtcggggtaccggatagtacgttcacgtctcaccatcacgtcgctgactgtctagtaggtntttcgacttagtttnttacgtgtacagtctaagttactaattacgtcggtacctctacgtacgttcggggacggggtaacctaagggtgaacgtactaccgaaaacgtcgtggtacgactaggccaggtac

SEQ ID NO: 291491 - DNA, 798 bp, Homo sapiens
  misc_feature: GYAE6OF01CLE32.44.36.D03.1.454.CMB.1.raw
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagtagtgaagtgctaggttggtggaggtccgggggagtacgttggtccagccgtggacgggtccctgacgactctccgtgtgtccgcctctggacttcacctatcagtgaccactatagtcggacgtcgggtccgccgacggccgtccggaaggggaacggggcgttagggaggtgggtccgttacgggaccgtacgtaaaacggttaaaaaaaacgtaaacggtttcgaccctaagttccgtttaactaccgaacgtaggtaacgtaacccgggcccggtccggttacgtaggtacggaaaacgtccccgtaagtaccgtttaccccaccccttacttaaccaaaggtagtaacgttacggtaaccctttacaaacggtaacctacgttaacgtttcgtaactttaccgtaggtaacccgtaaacgttacgtaaacccgttaaaaccgtacggaaaaaacccgggtacgggaaccgaaaccggggtaactaacggtttaggtttaaacttttaaggttttcgggttttagggtttagtttttacggtttttaaacgttacgttaaacccgggtaagggtttaacccgttacgggttaacccccggg

SEQ ID NO: 291492 - DNA, 662 bp, Homo sapiens
  misc_feature: GYAE6OF01DIWYW.44.36.D03.1.454.CMB.1.raw
tcagacagtatatacacgaccggtgctcgatttagctgcgtcacgatctctcttggggagctctgagagcggagccccagccccagaattcccaggtgtttcattggtgatcagcactgaacacagaggactcaccatggagttcgggctgagctgggttttccttgttgttattttacaaggtgtccagagtgaagtgcaggttggtgggaggtccgggggagtacttggtccagccgtgggacgggtccctgagacctctcctgtcgtcgcctcgtggacttcaccatcagtcgaccactatagtcggacgtcggggtcccgccgaggccgtccgaaggggaacggggctaggggacgtgggcgttgggccgacgaaaggtaaaaaacaaaggttcgaccgtaagtacctttaatccgaacgtaggaacgttaccggccgtcgtacgtggtacgaaacgccgaagtacttcccaccctctacgaagtagatcgtaaccttacgaaagtaacctctaagtttgaactttcgtacggacgtaaatcggtaaacccttaaccgtacggaaaaacccggtaggaacccgtaacggggactagtttacgtaattttaggttggttagtttgttagtttaatagtacgtaaaggtacgtgtacccg

SEQ ID NO: 291493 - DNA, 690 bp, Homo sapiens
  misc_feature: GYAE6OF01ECKDC.44.36.D03.1.454.CMB.1.raw
  modified_base (292)..(292): a, c, t, g, unknown or other
  misc_feature (292)..(292): n is a, c, g, or t
  modified_base (627)..(627): a, c, t, g, unknown or other
  misc_feature (627)..(627): n is a, c, g, or t
tcagacagtatatacacgaccggtgctcgatttagctgcgtcacgatctctcttggggatcacataacaaccacactcctcctctaaagaagcccctgggagcacagctcatcaccatggactggacctggcggttcctctttgtggtggcagcagctacaggtgtccagtcccaggtgcagctggtgcagtcgtggggctggaggtgaagagcgtggtcctggtagaggtctcgtgacgaaggtcttcgtggacggcctaccttctcgagtctatgttctttagttgggtncgacgcggtcccgtggacgtagggtcttaggacgtggcgtaggggacgtacgtcgtacttccctagttccgtttggcgacgtacgtacggtaaacttaccggactaacgtacggttaacgtttccgaaaggtacgtaacggtaccgttacccaaaccgtaacgtttaccccgggaacgtaacccgtaaacgttacccggaaacggtaaccgttaacgaacccggttaccgtaaacgtagggtacgggtaaccgtcgtacgggacgtacgaacgggtcgtagggaacgtacgttcgaaggtaacgaccgccggtactagtttccgttaagttcggngtaccggacgtaccgtaccgtaccctttacggacccttaagttccgtacgttccccgtacccg

SEQ ID NO: 291494 - DNA, 899 bp, Homo sapiens
  misc_feature: GYAE6OF01B0V2H.44.36.D03.1.454.CMB.1.raw
tcagacagtatatacacgaccggtgctcgatttagctgcgtcacgatctctcttggggagctctgagagcggagccccagccccagaattcccaggtgtttcatttggtgatcagcactgaacacagaggactcaccatggagttcgggctgagtcgttgggttttccttgttgttatttacaaggtgtccagagtgaagtgcgaggttggtgggaggtccgggggatacgttggtccaggtccgtgggacgggtccctggacgtactctccgtgtcgtccgcccttcgtggtacttccacctatccaggttacgaccctacttaatagtcggtaccgttcggggtcccgccgtacgggtccgtaccggaaggggggaacggggtccgtaggggtacggtcgggtccgtttacgggacccgtaacgtaaaacggtaaaaaaaccgtaaaggttccgtaacccaacggtttacctttaacgaccgtaaacgaagggtaccggttaaccccggcccggttacgttacccggttaaggtaacgggtaaaaccgacccgtaacggtaccttttacccccccgaaccccgtttacggtaaaccgtaaagggtaacgggtaaccttacgggttaaacccctttaacggaaaacggtaaccctttacgtaaacgttttcgttaaacgtttcccgtaaggtaaacccgttaaacgttaacggaaaaccccgtttaaacccgtaaaccgggaaaaaacccgggtagggtaaccccgggaaaccggggttaccttaaaggttttacggtttaaacttttaggtttggggtttacttttcgggttttaaaggtttttaataacccgtttaacgggaaaacgggtttaacttccccggggttaaaccccgg

SEQ ID NO: 291495 - DNA, 717 bp, Homo sapiens
  misc_feature: GYAE6OF01CASNB.44.36.D03.1.454.CMB.1.raw
  modified_base (223)..(223): a, c, t, g, unknown or other
  misc_feature (223)..(223): n is a, c, g, or t
  modified_base (252)..(252): a, c, t, g, unknown or other
  misc_feature (252)..(252): n is a, c, g, or t
  modified_base (359)..(359): a, c, t, g, unknown or other
  misc_feature (359)..(359): n is a, c, g, or t
  modified_base (392)..(392): a, c, t, g, unknown or other
  misc_feature (392)..(392): n is a, c, g, or t
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgtttatttacaggtgtcagagtgaagtgcagttggtggaggtccggggganacgttggccaggccgtgggacgggtcccngagactctccgtgtgtcgcctctggattcacatcagtgaccactatatggactcggggtccgccgaggctaccggaggggaacgggctgggagtggcgttggccganaaagtaaaaacaaggttcgacctagtactttanacacagacggtaccgccggcgttcgtcgtagaaacgccaggtacttccaacccttctaacgaagtagtaacttcgggtaacctttacgaaacggtaaccttacgtaagttttacgtacttttaccgtaacgtaaccgttaaaactccggttaaaaccttaaacccggttaaacggaaaaaacccccgggtagggaaaacccggtaaaccgggggacccttaaggttacggtttaaagttttacggtttgggtttacgttttaggttttaagttttaacttaacgtttacgggtaaacggttacgtttcccgggttaaaccccggg

SEQ ID NO: 291496 - DNA, 678 bp, Homo sapiens
  misc_feature: GYAE6OF01EAHHU.44.36.D03.1.454.CMB.1.raw
tcagacagtatatacacgaccggtgctcgatttagctgcgtcacgatctctcttggggagctctgagagcggagccccagccccagaattcccaggttgttttcatttggtgatcagcactgaacacagaggactcaccatggagttcgggctgagcttgggttttccttgttgtttattttacaaggtgtccagagtgaagtgcaggttggtggaggtccgggggagacgttggtccgacgccgtggagggtcccgtgagactctcctgtgtcgcctctggacttcaccatcagtgaccactatatggacgtgggtccgccgacggcgtccgagggaagggcgtggaggtgggcgttcggccgacgaaagtaaaaaacgtaaagttcgaccagtactttactacaacgagtaacggtaccgccgcgtcgttaggtaggaaaacgccaaggtactttacccaaccccttctaacaaaggacgtatacgtaacctttacaaagtaaaccttctaagtttacgattttccgtgaaccgtaaattcggaaaccttaaacccgtaggaaaaaaccccgggaggacccgtaccgggactaagttagtttaatttagtttcggtaggtttcgttttaaggttttaattaacggtaccgtaaaggggttaaccttggtaaccccg

SEQ ID NO: 291497 - DNA, 805 bp, Homo sapiens
  misc_feature: GYAE6OF01AFTK7.44.36.D03.1.454.CMB.1.raw
  modified_base (223)..(223): a, c, t, g, unknown or other
  misc_feature (223)..(223): n is a, c, g, or t
  modified_base (376)..(376): a, c, t, g, unknown or other
  misc_feature (376)..(376): n is a, c, g, or t
tcagacagtatatacacgaccggtgctcgatttagctgcgtcacgatctctcttgggcagagctctggggaggaactgctcagttaggacccagacggaaccatggaacgccccagcgcagcttctcttcctcctgctactctggctcccagactaccactggagaaatagtgatgacgcagtctccagcccacctgtctgtcgtcctccgaagggggaaacncgccccacccttcctccgtcggccacggggcccaggtcaggacggttcttacccagcctaacttacgcccgttaggtacccaccgaacgaaaccgtgggacctacggccgtccccgagggtccctccgtacacttaccgtagtaccggaaacncttccccgaacggtaccgggccccttaacggttaccggtaacccttacccccgggaacccgttaggggtttaccccaagggttcgggcccgtaagggggtttcccggggaaaccccgggacggtaagttaccccggttcctaacccgttccgtaacccgtaaccgtaccgttacgaccggggtaccccggtacccttcgggaccgtacggtttaccggtaacgtaacgtttattttacccgggattttacgggtttaaactttccgtagtaccaacggttacttaaggttaactaaacgttcggtaacccgttcgggttacccctcccggttacgggtacccgaaacggggtacctacggtacggtaagggtaaacgtaacgtttaaaacgggtccttaggtcggtaccgacttaccccggaattaccg

SEQ ID NO: 291498 - DNA, 728 bp, Homo sapiens
  misc_feature: GYAE6OF01B7HVT.44.36.D03.1.454.CMB.1.raw
  modified_base (319)..(319): a, c, t, g, unknown or other
  misc_feature (319)..(319): n is a, c, g, or t
tcagacagtatatacacgaccggtgctcgatttagctgcgtcacgatctctcttgggggggagacgagcccagcactggaagtcgccggtgtttccattcggtgatcatcactgaacacagaggactcaccatggactttgggctgagattgggttttcctcgttgcttcttttaagaggtggccagtgtcaggtgcagctaggtggagtcgtgggggagagccggcccagcctgggaacctccctgagactctcctgtgcagcctctggacttcatcttcgaggtaccctagtcgcctatcgactacgtcgggtcccnccgaggcctccgaggacgaaggggtctgggaggtgggtaggactaaagtttatacgtacgaagaaacggtagttagggtaaattaggaaacgaaacgtaacgtaccgggaacgaccgtaccggaaggtaaccgggaccgtaacttacccgtaacccggtccgtaacccgaagaaccgtaaccgtaaacgttaccccgaaacgggtaaacccaacgtaaccgtacggtaccctaacgttaccgtaacgaacctaaagttaccgtaaaccctaacccgtactaaccgaaacgggtacggtaacggacccgtaacgggtacctttacgttacttaacgtttgttacgtacggacccgtaacgggtaccccgtacccccggttacggaaccccgggtcccggttaccccccgg

SEQ ID NO: 291499 - DNA, 731 bp, Homo sapiens
  misc_feature: GYAE6OF01BEUW1.44.36.D03.1.454.CMB.1.raw
tcagacagtatatacacgaccggtgctcgatttagctgcgtcacgatctctcttggggatcacataacaaccacactcctcctctaaagaagcccctgggagcacagctcatcaccatggactggacctggcggttcctctttgtggtggcagcagctacaggtgtccagtcccaggtgcagctggtgcagtctggggctgaggtgaagagcctgggtcctcggtgaaggtctcctgcaaggcttcgtggaggcaccttcttcagctatgtcttttagttgggtgtcgacgacggtccccgtggacgtaagggtcctttggacgttgggcgtggggaggattcaacgttccccttaagttcgtttgggtagtacctaagtccggtaaatttacgacctaacgtaaggtaaacgttttccgaaagggtaacctaaggtaacgttaccgaaacccgttaacgtttaaccccgggaccgggtaaaccgaaaccgttcccgaaaccggtaacggttaacccgacggtaaccccgttaaacaacggttacgggaacggtccgtagggtaacggcccgtaagggtccctaagggtaaccgtaacttcggttaaggaacggtaaccgaccgggtaccctacgtttaaccttacgttttcgtagggttacgtaccggtacgacccgttcccccgttaggttacccttaaaccgttttcgaaccgttccgttaccccccg

SEQ ID NO: 291500 - DNA, 686 bp, Homo sapiens
  misc_feature: GYAE6OF01DBGRX.44.36.D03.1.454.CMB.1.raw
  modified_base (296)..(296): a, c, t, g, unknown or other
  misc_feature (296)..(296): n is a, c, g, or t
  modified_base (319)..(319): a, c, t, g, unknown or other
  misc_feature (319)..(319): n is a, c, g, or t
  modified_base (588)..(588): a, c, t, g, unknown or other
  misc_feature (588)..(588): n is a, c, g, or t
tcagacagtatatacacgaccggtgctcgatttagctgcgtcacgatctctcttggggagctctgagagcggagccccagccccagaattcccaggttgttttcatttggtgatcagcactgaacacagaggactcaccatggagttcgggctgagtctgggttttccttgttgttatttacaaggtgtccagagtgaagtgcaggttggtggaggtccgggggagtacgttggtccagccgtgggacggtccctgagactctcctgtcgtcgccttctggacttcaccatcagtnaccactatagtggactgggtccnccgagggcctaccggagggggaacggggtctaggggacggtgggcttgggaccctacgaaaaggtaaaaaaactaaaggtttcgaccctaaggttccttttaagaccaacgtaggaacgttaccgcccgtacgttcgtaggtacgaaacgccaaggtacctttcccgacccttactacgaaagagtacttacggaacctttacaacgtaactctaatttcgaatttcagtaacgtaatcgaaaccttaaacccgtaggaaaaaacccgngggtaaacccgacggggtctaaagttggttaaattttgtttcgggttagtttagttaacggttttaattaacgtcgaaacgggtacttcggtaacccg

SEQ ID NO: 291501 - DNA, 586 bp, Homo sapiens
  misc_feature: GYAE6OF01CYRIY.44.36.D03.1.454.CMB.1.raw
  modified_base (214)..(214): a, c, t, g, unknown or other
  misc_feature (214)..(214): n is a, c, g, or t
tcagacagtatatacacgaccggtgctcgatttagctgcgtcacgatctctcttgggcagagctctggggaggaactgctcagttaggacccagacggaaccatggaagccccagcgcagcttctcttcctcctgctactctggctcccagataccactggagaaatagtgatggcgcggtctccagccacctgtctgtgtctccaggggaaangcccaccctctcctgcagggccagtcagagtgttagcagcaacttagcctgtaccagcagaaactcgtggccaggcctccaggcctccgtcatccttagtcggtcgcactcccgaaccgtagggcccaacgttggtacctccccgaggcccagggtttccaggtggaccagggttcgggtcgtggggactaggtacgttcctacctccgttacaccctatcacgcacgccctgccagccgtaggagtactttcgcgtactttattaccgtgaccctaatacttaatttcctttttactccgttactacggtttacggccgtaacgggtacccacgtcgtacggtacgactacgtaaacggtcgttggtacgg

SEQ ID NO: 291502 - DNA, 803 bp, Homo sapiens
  misc_feature: GYAE6OF01C76TJ.44.36.D03.1.454.CMB.1.raw
tcagacagtatatacacgaccggtgctcgatttagctgcgtcacgatctctcgttgggggggagacgagcccagcactggaagtcgccggtgtttccattcggtgatcatcactgaacacagaggactcaccatggactttgggctgagtagttggggttttcctcgttgtcttacgttttaaggaggtggccagtgtcgaggtgcagtcgtaggtggaggtcggtgggggaggacggccggcccaaggccgtagggaacctcccgtggtaacgtcctccgtcgtgtcgcgacgtcctcgtaggtctctattccgtacgaacggtacttagcgtccctaagtcgccgtaccgggttccgggacccgacccggaacggtcccgtacccggaagggtcccgggtaaagggggtccgtaggggtacgggttacggggaaggtacctaaaaaggtttctaagtacgtaaagaaaggtaacgtaaggtaaacttaaggaaaacggaacgtaacggaaacggaccgtaacgaccgggaacgggaacggtaccgtaacgtcccgtacgtaccaacgtaaggaactacgtaaccgtaccgaaacgaacccacgtaacgtacgacctaacgtaccgtacggtaaaccaacgttaccgtaaacccgtaaaccgtaaccccgtaaaggtaaacgttcggggaaaaccgtacccggggtaattacccggtttaggttaattaacctttaggttccggtacgaaccggtacggtacccgtaccccggaacgtcccggggtacccgttacccccggg

SEQ ID NO: 291503 - DNA, 699 bp, Homo sapiens
  misc_feature: GYAE6OF01CMHFR.44.36.D03.1.454.CMB.1.raw
tcagacagtatatacacgaccggtgctcgatttagctgcgtcacgatctctcttggggatcacataacaaccacactcctcctctaaagaagcccctgggagcacagctcatcaccatggactggacctggtcggttcctctttgtggtggcagcagctacgaggtcgtccagtcccgaggtgcaggctggtgctagtcgtggggctggaggtagaagagtccgtgggtccgtcggtaggaacggttcctccgtgcgtaacggtcttacggtagggacggcctacctttctcgagtcttagtgttacttttaggttgggtcgcggacgacggtcccgtaggaacgtaacgggtctaggaggttggcggtggggaggtatcgtacgttccttagttcggtttggtcgactagtacgtagtacgactaacgtaggtaacgttagaaggtacgaaggtacggtacctaaaccggtacgttaacccgggacggttaaacgaaacgttcccggaaacggtacgttaacccgacgtacccgttaaagacggttcgggaacgtcgtaaggaacggtccgaagggtcgtaaggtaacgttaccgtaacgttaagggaaccgaccgaccggtacttaacgttcttaggttccgtagggtcacggtacgacgttccctacggtaacttaaccgttcaacgttcccgtcc

SEQ ID NO: 291504 - DNA, 513 bp, Homo sapiens
  misc_feature: GYAE6OF01CBMZC.44.36.D03.1.454.CMB.1.raw
tcagacagtatatacacgaccggtgctcgatttagctgcgtcacgatctctcttggggatcacataacaaccacactcctcctctaaagaagcccctgggagcacagctcatcaccatggactggacctggcggttcctctttgtggtggcagcagctacaggtgtccagtcccaggtgcagctggtgcagtctggggctgaggtgaagaagcctgggtcctcggtgaggtctcctgcaaggcttctggaggcaccttcttcagctatgcttttatttgggtgtcgacaggcccctggacaagggcttgagtggctggggagggatcgatccctatctttggtgctatcgaattacgcacagaagtttcaggtacagagtcaccattaccggcgacgaatccaagagtacagcctacatggagctgacgcgaggcctggagatctagaagcgacggcattctatttctagtcgcggagacgtccccttcggtccaactttccattcgttcccc

SEQ ID NO: 291505 - DNA, 830 bp, Homo sapiens
  misc_feature: GYAE6OF01AYMRS.44.36.D03.1.454.CMB.1.raw
  modified_base (217)..(217): a, c, t, g, unknown or other
  misc_feature (217)..(217): n is a, c, g, or t
  modified_base (511)..(511): a, c, t, g, unknown or other
  misc_feature (511)..(511): n is a, c, g, or t
tcagacagtatatacacgaccggtgctcgatttagctgcgtcacgatctctcttggggagctctgagagcggagccccagccccagaattcccaggttgttttcatttggtgatcagcactgaacacagaggactcaccatggagttcgggctgagtcttgggtttttccttgttgtttattttacaaggtgtccagagtgaagtgctaggttgggnggaggtccgggggatacgttggtccaggtcccgtgggacgggttcccctggacgtacctccttccgtggtcgtccgcccttcgtcggtacttccaaccctattccaaggttacgaacccctaattaagttacgtcggggtaaccgttccgggggtaccccgcccggtaacgggtcccgtaccgggaaggggggtaacggggtcgttagggggacggttcggggtccgttcgggacccggtaacgaaaacggttaaaaaaaccgtaacggttcggacctaaggttacctttaacnccgaaacgtacgtaacggtacccggcccggtcgttacgtaggttaacggaaaaccgtcccgtaaggttaccttacccctaccccgtactaaccgaagtacgtataccgtaactttacgaaacgtacctagtatttacgtactttaccgtaggtaacctaagttaaccgtaaacccttaaaccggtaacgggaaaaacccggaccgggtaaacggacccgggtaactaaggtttacgttaagttttaacggtttggtttaacgtttaggtttaacgtttaattacgtaacggtaacggttaaccgttccgggtaacccgg

SEQ ID NO: 291506 - DNA, 699 bp, Homo sapiens
  misc_feature: GYAE6OF01EV13S.44.36.D03.1.454.CMB.1.raw
  modified_base (260)..(260): a, c, t, g, unknown or other
  misc_feature (260)..(260): n is a, c, g, or t
  modified_base (273)..(273): a, c, t, g, unknown or other
  misc_feature (273)..(273): n is a, c, g, or t
  modified_base (292)..(292): a, c, t, g, unknown or other
  misc_feature (292)..(292): n is a, c, g, or t
tcagacagtatatacacgaccggtgctcgatttagctgcgtcacgatctctcttggggaggctctgcttcagctgtgggcacaagaggcagcactcaggacaatctccagcatggcctggtctcctctcctcctcactctcctcgctcactgcacgagggtcctcgggcccactctgtgctgacgcacgcccgccctcaggtcgtcggtccgggggccccgggcaggacgggtccaccatcctccgtgccacgtgggacncagactaccaacngtacgggacagtacttcgngacttcgtacctacgtacggtaacccaacgtacccttaccgaacggaacccacccgaaccccctaaactccctactacgtttaccgtttaacggtaaacctaacgttacgtcccgggtaccccttaccgggtaaccggggttcccctacggacccgttactttccgtccgtacgggtccttacccgtaacgttccgtaccgacctacccgtcgtaccgtccctcccgacgacctactccgacgtcggcctaccggacggtgtaacgagtaacgtgggacggttattacgtttacttaccgacgtaccgtactccgttagacgaaccgtgacccgtacggtcccgttagggtagggtttcgggttcggggttacggtacggggaccgggtaccgggtaacctacgggg

SEQ ID NO: 291507 - DNA, 656 bp, Homo sapiens
  misc_feature: GYAE6OF01EBW2P.44.36.D03.1.454.CMB.1.raw
  modified_base (223)..(223): a, c, t, g, unknown or other
  misc_feature (223)..(223): n is a, c, g, or t
  modified_base (351)..(351): a, c, t, g, unknown or other
  misc_feature (351)..(351): n is a, c, g, or t
  modified_base (362)..(362): a, c, t, g, unknown or other
  misc_feature (362)..(362): n is a, c, g, or t
tcagacagtatatacacgaccggtgctcgatttagctgcgtcacgatctctcgttgggggggagacgagcccagcactggaagtcgccggtgtttccattcggtgatcatcactgaacacagaggactcaccatggactttgggctgagattggggttttcctcgttgcttcttttaaggaggtggccagtgtcaggtgcagctagtggagtcgtgggggagngccggcccagcctgggacctccctgagacctctcctgtgcagcctcgtggattcatcttcgaggacctatcgccatgctacgtcgggtcccgccaggcctccgaggcgaaggggctagggaggtgggnggactaattanagtacgaggtaaagagtaggtaattggaaacgtaacaacgtacggaacgtacgtacggaaggacgggacgtacgttaccgacccgtcgtaccgaagacgaactaacttaccgaacggaacaccacgtcgactatacgtacaacgtaaacgtacgtaacctaacctacgaacgaacggtacggaacggtaccgacggtcgtacgtttacttaacgtttaggttacgtcggaaccgggtaacgtaaccccggaccccccggttaacgggtacccgggtccccgggttacccccggg

SEQ ID NO: 291508 - DNA, 745 bp, Homo sapiens
  misc_feature: GYAE6OF01AHR75.44.36.D03.1.454.CMB.1.raw
  modified_base (178)..(178): a, c, t, g, unknown or other
  misc_feature (178)..(178): n is a, c, g, or t
tcagacagtatatacacgaccggtgctcgatttagctgcgtcacgatctctcttgggggggagacgagcccagcactggaagtcgccggtgtttccattcggtgatcatcactgaacacagaggactcaccatggactttgggctgagattgggttttcctcgttgctcttttaaggnggtggccagtgtcagggtgcagctaggtggagtcgtggggggagagccggcccaggccgttggggaacctcccgtaggacgaccttctcccgtggtcgccgacgtcctcgtgggtacttcgtacttccttacgaacggtacccttagtcggccctagtcggacctaccggtcggggtcccgccgaggcctaccggaggcggaaggggctgggaggtgggtgactaattacagtacgaaggaagtagtaggaattacggaaagaaacgacgtaacgggacgtaccgtacgggaggaaccgggtaccgtacgttacccgacccgtacgtaccgaaggtaacgtaaccgtaaacgttaccgaacggtaaaccaccgtaacgtacgacctacgtactaacggactaaacgttaccgtaaacctaaacctacgaaacgtaacggtaacgggaaccggaccggtaaccggtacgttacgtttaaccttagttacggttacggtacggtacccgtaacgggttacccccggtaccccggtaccgggaaccccggggttccccgggttaccccgg

SEQ ID NO: 291509 - DNA, 727 bp, Homo sapiens
  misc_feature: GYAE6OF01AVX4T.44.36.D03.1.454.CMB.1.raw
  modified_base (213)..(213): a, c, t, g, unknown or other
  misc_feature (213)..(213): n is a, c, g, or t
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttgggtggnggtccgggggagacttggtccaggcctgggacgggtccctgacgactctcctgtgtcgcctcgtggatcaccatcagtcgaccactatagtggacgtcgggtcccgccgaggcctccgagggggaagggcgtagggaggtgggtcgttcggccgtacgtaaacgtaaaaaaccgtaaaggtttcggaccctaaggtaccttttaacaccgaacgtaaggtaacggttacccggacccggtcgttaccgttagtaggaaaaccgccgaagtaccttaccctaaccccgttctaaccgaaaggtacgtaacgttacggtaaccctttaacgaaacggttaaccctacgttaatttacggtaactttaccgtacggtaccgttaaactacgggtaaaccttaacccgtaacggaaaaacccggacgggtaaccgacgggtacctaaggttacgttaatttacgtttggttagtttagtttagtttaactagttacgtaacggtagttcggtacccgg

SEQ ID NO: 291510 - DNA, 778 bp, Homo sapiens
  misc_feature: GYAE6OF01DB5G6.44.36.D03.1.454.CMB.1.raw
  modified_base (296)..(296): a, c, t, g, unknown or other
  misc_feature (296)..(296): n is a, c, g, or t
  modified_base (330)..(330): a, c, t, g, unknown or other
  misc_feature (330)..(330): n is a, c, g, or t
tcagacagtatatacacgaccggtgctcgatttagctgcgtcacgatctctcttggggagctctgagagcggagccccagccccagaattcccaggtgtttcatttggtgatcagcactgaacacagaggactcaccatggagttcgggctgagcttgggttttccttgttgtttatttacaaggtgtccagagtgaagtgctagttggtgggaggtccgggggagtacgttggtccagtccgtgggacgggtccctggacgactctcctgtcgtccgcctctggtacttccaccntcgagtcgaccactatagtcggacgtcgggtccnccgaggccgtacggaggggaagggcgtgggaggtcgggcgttcggccgacgtaaagtaaaaaacgaaggttcgaccctaggtctttaacgtcacgaaggacgtaccggcccggtcgtcgtaggtaacgaaaccgcccgtaagtaccttaccccgaaccccctttagtaaccggaaaaggcgtaacgtttacggtaaaccctttaaccgaaaacgttaacccgttactaagttttccgaattttcccggaacggtaacttaaaccgttacgttaaaccccttaaacccggtaaccgggaaaaaacccgggcgggtaaaacccggacggggttaactaaggtttaggtttaaacgtttttaggtttggggttttaattttacgggttttaagttttaaactttaacggtaccgttaaaacgggttaaccctttccgggtaaacccccggg

SEQ ID NO: 291511 - DNA, 619 bp, Homo sapiens
  misc_feature: GYAE6OF01DPU7X.44.36.D03.1.454.CMB.1.raw
tcagacagtatatacacgaccggtgctcgatttagctgcgtcacgatctctcttgggggactcctgtgccccccaccatggacactctttgctacacactcctgctgctgaccaccccttcctgggtcttgtcccaggtcaccttgaaggagtctggtcctgtgctggtcgaaacccacagagaccctcacgctgacctgcacatctctgggttctctctcaacgatattagaatgggtgtgagctggatccgtcacgccccgagggaacgccctggagtggcttgcacacatcttctcgaatcgaaacgaaaactcctaacagtacaatctctagaagacgactaagtttaaccatacctaccaaaggaccacctaacgaaaacggcgaggttaggttactttaagtactacgaacccaactacgtacgaccctgacgaacacgaggcagatattactgtacgcgtaagggtaagtaggaacgggaaagaaacgtcgtacgtttcgtttacgtagttaaacttaagttacgttaccttacgacgttccgtagggtaccggttcgggtacgggaccaaacgggggtaccctaacgggtcctacccgtcctcccgtaccg

SEQ ID NO: 291512 - DNA, 662 bp, Homo sapiens
  misc_feature: GYAE6OF01E3YBY.44.36.D03.1.454.CMB.1.raw
  modified_base (543)..(543): a, c, t, g, unknown or other
  misc_feature (543)..(543): n is a, c, g, or t
  modified_base (647)..(647): a, c, t, g, unknown or other
  misc_feature (647)..(647): n is a, c, g, or t
tcagacagtatatacacgaccggtgctcgatttagctgcgtcacgatcgtctcttgggggactcctgtgccccaccatggacactctttgctacacactcctgctgctgaccaccccttcctgggtcttgtcccaggtcaccttgaaggagtctggtcctgtgctggtacgaaacccacagacgaccctcacgctgacctgcaccatctctcgggttctctctacaacgtattattagtaagtgggtgtgagcgtggtactccgtacgacgaccccgagggaacggccgtaggagtggctgcacacatcttctacgtaatacgaaacgaaaactaccgtaactagtacactcgtacgtagaacgacgtactaacgtttaaccactcctacgaacggaccaaccgtaacgaaaacggcgtaaggttagtttactttagtacgtacgaacccaactaggtaccgaccgtcggaaccggaacacgacggacaagttaacttacgttacgtgtaccgtacggtaagggtaatcggggaaacggaaanaaccgtagttccgtttagtttactagtttaagttattaaacgtttcctaacgagttcggtagggtaccgtcggacggggtaacaaccgggtacgacggtacccnccgttccgcctacgg

SEQ ID NO: 291513 - DNA, 599 bp, Homo sapiens
  misc_feature: GYAE6OF01BBA80.44.36.D03.1.454.CMB.1.raw
  modified_base (353)..(353): a, c, t, g, unknown or other
  misc_feature (353)..(353): n is a, c, g, or t
  modified_base (380)..(380): a, c, t, g, unknown or other
  misc_feature (380)..(380): n is a, c, g, or t
  modified_base (512)..(512): a, c, t, g, unknown or other
  misc_feature (512)..(512): n is a, c, g, or t
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggggtccgggggagacttggtccagcctgggagggtccctgagactctcctgtgtcgcctctggattcaccatcagtgaccactatatggactggggtcccgccaggctccgaggggaaggggctgggagtggcttgggcccgngaagtaaaaacaagttgccagctttancaacagagtaccgccgcgtctggtagaaacgcccaagtactttcccaccccttcaccaaagagatgaaccttcaaagtacctcaattgaatttctagacgtaatcgaaaccttaaccgtaggaaaacccggnggaaccgacgggactaagttggttaatttagttggttgtttggttagttttaatattacgaaggtaaccttggtacccgtaacgggg

SEQ ID NO: 291514 - DNA, 630 bp, Homo sapiens
  misc_feature: GYAE6OF01AJKRH.44.36.D03.1.454.CMB.1.raw
tcagacagtatatacacgaccggtgctcgatttagctgcgtcacgatctctcttgggggactcctgtgccccaccatggacactctttgctacacactcctgctgctgaccaccccttcctgggtcttgtcccaggtcaccttgaaggagtctggtcctgtgctggtgaaacccacagagaccctcacgctgacctgcaccatctcgtggttctctctcaacgatatagaatgggtgtgagctggactccgtcacgccccgagggaacggcccgtggagtggcttgcacacatcttctacgaatagaacgaaaatcctaacagtacatctctagaagagactaacgtttaaccatacctaccgaacggaccaaccgtaaccgaaacggcgtaggtcgttactttagtagtacgaccaagagtccggaccctggaccggacacgaggactactatacttacgtgtacgacgtaacgggtatacgggaacgggaaagaacgtagcgtttaggtttacgtaggttaactttaagtacgttaccttaaccgtagttccgtagggttaccgtcgggtacgggggtaaccgaacggggtaacccgacgggtacctaccccggttcctcccgtaccg

SEQ ID NO: 291515 - DNA, 828 bp, Homo sapiens
  misc_feature: GYAE6OF01EEITH.44.36.D03.1.454.CMB.1.raw
tcagacagtatatacacgaccggtgctcgatttagctgcgtcacgatctctcttggggagctctgagagcggagccccagccccagaattcccaggttgttttcatttggtgatcagcactgaacacagaggactcaccatggagttcgggctgagtcgttgggttttccttgtttgtttattttacaaggttgtccagtagtgaagtgctaggttggtggaggtccggggatacgttggtccagccgtgggacgggtcctgacgtactcctccgtgtcgtccgcctgtggacttcacctatcagtcgaaccacttatagtgggtacgttcgggtcccgaccgagggtccctaccggaggggtaagggtcgtaggggacggttcgggacctttcgggaccgtaacgtaaaaggttaaaaaaccgtaaggtttcggaaccctaggttaccttttaacgccgtaaaccgtaaggtaccggttacccggacccggttcggttacgttacgggtaaacggaaacccggtcccgtaaaggttaccctttaccccaaccccgttacgtaaacccggaaaagggtacgttaacgtttaacgtaaccgttttaaacgaaacggttaaaccttaccgttaagtttacggtaactttacgtcggtaacgtaaacgtttacgaaaccttaaacccgtaagggaaaacccggttagggaaccgtaccggggtaactaaggtttacggtttaaagtttacgttttaggttacggttttagtttaacgtttttaacgtaacgtttacggaaacgggtttaaccgttcggttaaacccccggg

SEQ ID NO: 291516 - DNA, 578 bp, Homo sapiens
  misc_feature: GYAE6OF01BZOG1.44.36.D03.1.454.CMB.1.raw
  modified_base (350)..(350): a, c, t, g, unknown or other
  misc_feature (350)..(350): n is a, c, g, or t
  modified_base (448)..(448): a, c, t, g, unknown or other
  misc_feature (448)..(448): n is a, c, g, or t
tcagacagtatatacacgaccggtgctcgatttagctgcgtcacgatctctcttggggatcacataacaaccacactcctcctctaaagaagcccctgggagcacagctcatcaccatggactggacctggcggttcctctttgtggtggcagcagctacaggtgtccagtcccaggtgcagctggtgcagtctggggctgaggtgaagaagcctgggtcctcggtgaaggtctcctgcaaggcttctggaggctaccttcttcagctatgtcttttagttgggtgcgacgacggccctggacgaagggtcttggagtggcgtgggaggatcactccctatcgtttggtncatcgaattacgcactagtaagttcgaggacagacgtcaactagttaccgacggacaactccgaagtacgtaccacgtacctaacgagtacgggaacncgtaggacgcgaggtccgtaggtaagtactacgagaacggaccaccgggtcctaattacgttagtttccgtagtcggacgtacgtacccgtcccttccgttaactaaccgttttcaagtttcccgttccc

SEQ ID NO: 291517 - DNA, 656 bp, Homo sapiens
  misc_feature: GYAE6OF01DOGTN.44.36.D03.1.454.CMB.1.raw
  modified_base (347)..(347): a, c, t, g, unknown or other
  misc_feature (347)..(347): n is a, c, g, or t
  modified_base (376)..(376): a, c, t, g, unknown or other
  misc_feature (376)..(376): n is a, c, g, or t
  modified_base (519)..(519): a, c, t, g, unknown or other
  misc_feature (519)..(519): n is a, c, g, or t
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtcccctgagactctcctgtgtcgcctctggattcaccatcagtgaccactatatggactggggtccgcaggctccgagggaagggctgggagtggcttggccgnaagtaaaaacaaggttgaccagtctttancacgagacgtacgccgacgtctagtagaaacgccagtacttccaccctctacaagagtatgaacttcaaagacttcgaatttgaactttctacggacgtaaattcggaaaccctttaaacccgtacgggaaaaaaaccccggngggaaacccgaaccgggggtacctaaaggtttcggtttaaagttttaaggttttgggttaaggttttttggtttacggtttttttaaacaagtttaccggaaaggggtttaaacccgttcgggttaaaccccccggg

SEQ ID NO: 291518 - DNA, 677 bp, Homo sapiens
  misc_feature: GYAE6OF01C0MJ3.44.36.D03.1.454.CMB.1.raw
  modified_base (112)..(112): a, c, t, g, unknown or other
  misc_feature (112)..(112): n is a, c, g, or t
  modified_base (172)..(172): a, c, t, g, unknown or other
  misc_feature (172)..(172): n is a, c, g, or t
  modified_base (192)..(192): a, c, t, g, unknown or other
  misc_feature (192)..(192): n is a, c, g, or t
  modified_base (197)..(197): a, c, t, g, unknown or other
  misc_feature (197)..(197): n is a, c, g, or t
  modified_base (206)..(206): a, c, t, g, unknown or other
  misc_feature (206)..(206): n is a, c, g, or t
  modified_base (218)..(218): a, c, t, g, unknown or other
  misc_feature (218)..(218): n is a, c, g, or t
  modified_base (228)..(228): a, c, t, g, unknown or other
  misc_feature (228)..(228): n is a, c, g, or t
  modified_base (232)..(232): a, c, t, g, unknown or other
  misc_feature (232)..(232): n is a, c, g, or t
  modified_base (236)..(236): a, c, t, g, unknown or other
  misc_feature (236)..(236): n is a, c, g, or t
  modified_base (278)..(278): a, c, t, g, unknown or other
  misc_feature (278)..(278): n is a, c, g, or t
  modified_base (281)..(281): a, c, t, g, unknown or other
  misc_feature (281)..(281): n is a, c, g, or t
  modified_base (304)..(304): a, c, t, g, unknown or other
  misc_feature (304)..(304): n is a, c, g, or t
  modified_base (311)..(311): a, c, t, g, unknown or other
  misc_feature (311)..(311): n is a, c, g, or t
  modified_base (331)..(331): a, c, t, g, unknown or other
  misc_feature (331)..(331): n is a, c, g, or t
  modified_base (335)..(335): a, c, t, g, unknown or other
  misc_feature (335)..(335): n is a, c, g, or t
tcagacagtatatacacgaccggtgctcgatttagctgcgtcacgatctctcttgggagctctgagagcggacgccccagccccagaacttcccaggttgtttcatttggtnatcagcactgaacacagaggactcaccatggagttcggctgagcggtgttcgtcgtagtntacaagtgcagagcgatgcngtggngagcgggancgtgcagcgtgnggtcctgacnctcnctgngtcgctgtgaactcacagtcatcgacatgagcgacgtggccncgnggcttcgagggacggtctagggngtcgcgngacctaataaaacgtaaagngtcncctaagtcttacacgacgacggtacgccgtccgtacgtataggaaacgtacgtaccgtaataccgttacccaccgttaacgtaacgaaagtcgtaattaccgtaacgttaaccgtaaacgttccttagtaaagtttacgtaccgtttaaccggacggttaaaccgacgttaacccggtaaaacccgttaaacggaacccgggaaaacccggttaacgtaaacccgggaaccggttaaccttaaaggtttactttaacggttacggttttcggttacggttttaacgtttaaacgttttacgaacgtttaacccgggtaagttaacccgttcccgggaaccgg

SEQ ID NO: 291519 - DNA, 691 bp, Homo sapiens
  misc_feature: GYAE6OF01DOZXK.44.36.D03.1.454.CMB.1.raw
tcagacagtatatacacgaccggtgctcgatttagctgcgtcacgatctctcgttggggggagacgagcccagcactggaagtcgccggtgtttccattcggtgatcatcactgaacacagaggactcaccatggactttgggctgagattgggttttcctcgttgcttcttttaaggaggtggccagtgtcaggtgcagctaggtggagtcgtgggggagagccggcccagcctgggaacctcccgtgagactctcctgtgcacgcctcgtggtattcattcttacgacggtacctatcgccatcgacacgttcggggtcccgacgaggcctccgaggtacgaaggggtctgggagtgggtacgactaaagtttacgtaatcgaaggaagagtaggtaaacttagggaaaagtaaaccgacggttaacgggaacgtacccgtaccggaaacggaaccgggtaccgtaacgttacccgaaccccggtccgtaaccgaaggaacgtaaccgtaacgttacccgaaacggaacctaccgtaactcgactacttacgtacgaaccgtaaagttacgtaaaccaacccgtacaacgtaacggtaggaacggaccgtaacggtcgttacgtattagtttacgtcggttacgaccggtacgtacccgccccgttacggaccgtccccgggtaccccg

SEQ ID NO: 291520 - DNA, 672 bp, Homo sapiens
  misc_feature: GYAE6OF01E2JEV.44.36.D03.1.454.CMB.1.raw
tcagacagtatatacacgaccggtgctcgatttagctgcgtcacgatctctcttgggggggagacgagcccagcactggaagtcgccggtgtttccattcggtgatcatcactgaacacagaggactcaccatggactttgggctgagatgggttttcctcgttgcttcttttaagaggtggccagtgtcaggtgcagctagtggagtcgtgggggagagcggcccagccgtgggaacctcccgtgacgacctctcctgtgcacgcctctggattcattcttcgacggacctagtcgcctatcgcctacgtcggggtcccgccgacggcctccgacggacgaagggggctagggaggtggggtgactaaagttagtatacgaagaacgagtaggtaattaggaaagaacgtacgtaacggacgtaccgtaccggaaggaacgggaccgtacgttccgaacccgttccgtaccgaacgaacgaactaacgttaccgaaggaaccacacgtacgactatctacgactaaatacgtaaccaacctacaacgtaaggtacggacggaaccgtacgggtaccgttacggttagtttaacgtttagttacggttggaacccggtaacggtaccccggtacccccggtaccggaaccgggtcccgggttaaccccccgg

SEQ ID NO: 291521 - DNA, 648 bp, Homo sapiens
  misc_feature: GYAE6OF01CQWP1.44.36.D03.1.454.CMB.1.raw
tcagacagtatatacacgaccggtgctcgatttagctgcgtcacgatctctcttggggatcacataacaaccacactcctcctctaaagaagcccctgggagcacagctcatcaccatggactggacctggaggttcctctttgtggtggcagcagctacaggtgtccactcccaggtccagctggtgcaatctgggcctggaggtgaagaggccgtgggtcctcggtgagggtctccgtggtaaggtctaccggaagcagtgtgttcgtcagacagtacactcaccgtgggtccgcaggcctcgtggaacgtgggcctgaggtgggtacggtacgactacggaaccgcacggcggaacacgagacggtcgcacatacgagtttacacgggtcagacgttcctaaccgttttccggaggaacctaacggtccgaacgggctacgaaggtatacgtaagtacggaaatccgtacaacgtcgaacctggtaccgtagtttcggacgggtacgaccgggtacgttaacttacgttacgttacggttacgtaccggaaaggtaaaacggttacgtaccgttacggtaacccgtaacgtaaaacggtccgtaacgaacggtccgtacggtcccgtacccgggtacccccgggg

SEQ ID NO: 291522 - DNA, 813 bp, Homo sapiens
  misc_feature: GYAE6OF01BWETM.44.36.D03.1.454.CMB.1.raw
  modified_base (199)..(199): a, c, t, g, unknown or other
  misc_feature (199)..(199): n is a, c, g, or t
  modified_base (222)..(222): a, c, t, g, unknown or other
  misc_feature (222)..(222): n is a, c, g, or t
tcagacagtatatacacgaccggtgctcgatttagctgcgtcacgatctctcttggggagctctgcttcagctgtgagcgcagaaggcaggactcgggacaatcttcatcatgacctgcctcccctctcctcctcacccttctcattcactgcacgagggtcctcgggcccagtctgtgctgacgcacgccgccctcgngtcgtcggtcgggggccccgggngaggacgggtccacctacgtcctccgtgaccgacggtggggacgacaaggactaccaaacgacggtccggggaacaggtacttcgtagtacgtcgtacccgaacgttcggtaaacccctaaaccctacccgttaccgaacgggaacccaacccgtaccccccctaaaacttccccgtactaacgtttaccgttttaaaccggtaaaacctaaccgttaaccggttccccgggtaccccgttaccggggtaacccggggttacccctacggtaacccgttactttcccgtacgttcgggtacccttacccggtaacgttcgtccgggtacctacccgtaccggtaccctcccccgttacccgtaccgggtaccctacgttacccgtaccgggtacccgggtaccgtacccggacgggttacgtaacgggtaaacgttacgggttacgggtaaggggttacctttaacgtttaacgttaccgtacggtaccttacgttacctagtaccgacgtacgcgtacgtcgtacggttgggttacgggttcgggttacggtacggggtcgggaacggtaacgtccgggtcgttcccggg

SEQ ID NO: 291523 - DNA, 770 bp, Homo sapiens
  misc_feature: GYAE6OF01ARFL2.44.36.D03.1.454.CMB.1.raw
tcagacagtatatacacgaccggtgctcgatttagctgcgtcacgatctctcttgggggactcctgtgccccaccatggacactctttgctacacactcctgctgctgaccaccccttcctgggtcttgtcccaggtcaccttgaaggagtctggtcctgtgctggtcgaaacccacagacgaccctcacgctgacctgcaccatctctgggttctctctcaacgtatattagaagtgggtgtgagctggactccgtcacgccccgagggaacggcccgtgggagtcggtcttggcacactattccttacgtacgaatacggaaacgtaaaaactcctaacaacgtacaactctacgtaggaagacgtaccgtaagtttaaacccagttacctaaccgaaacggtaacctaacccgtaacccgaaaaaggtccgtaacgggttacggttacttttaaggtacgttaacggaaccctaaacgtacgtaccggtaacccgtacggaccggtaacacgtaacgggacctaacgttaacttacgttaccgttggtaccggacgtaaacgggtaacgtcgggaaaacgggtaaacgaaccggtacggttacggtttacggtttaaccgttaggtttaaacgttaacggttaaccgttaccttaacgtacggttaccggttagggttaacccggttcgggtaacgggggtaacccgtaaaaccgggggtacccgtaccgggttaaaccctacccggtttccgtcccgttaacccgg

SEQ ID NO: 291524 - DNA, 713 bp, Homo sapiens
  misc_feature: GYAE6OF01CD5HE.44.36.D03.1.454.CMB.1.raw
  modified_base (228)..(228): a, c, t, g, unknown or other
  misc_feature (228)..(228): n is a, c, g, or t
  modified_base (651)..(651): a, c, t, g, unknown or other
  misc_feature (651)..(651): n is a, c, g, or t
tcagacagtatatacacgaccggtgctcgatttagctgcgtcacgatctctcgttgggggctctgcttcagctgtgggcacaagaggcagcactcaggacaatctccagcatcggcctggtcctcctctcctcctcactctcctcgctcactgccacgacgggtcctcgggccctactcgtgtcgctgaccgcacgcccgcctcgagtcggtcggccggggcccgggnaggacggtcaccgtatccgtacgtgaccgacggtggacgactaacggtacctaaccgaacgacggtaccgggaatacggtattcgagacgtttcgacctacgtacgtaacccaaccgtaccgtaccgaacgaaccaccccgaaccctaactccgttactacgtttaccgttaacggtaaacctacgtaccgtcccggtacccgttacggaaccgggttcctaacgggttacctaccgtttacgtccgtacgggtaccttaaccgtaggttaccgtacggacctaacggttaccggacgttaccgttacgaccgtaccttacgtaccgttcgtaaccgtccttaacggtcgtaggtacgaggttactggtaacgtctaacgttaaccgttgtacgtcgacgtagtacgcgtaaggtcggtaacncggttacggacgggtaccggtaggtcgggtggtacggtacgggaaccgacggacgtaccggg

SEQ ID NO: 291525 - DNA, 830 bp, Homo sapiens
  misc_feature: GYAE6OF01C4S3G.44.36.D03.1.454.CMB.1.raw
tcagacagtatatacacgaccggtgctcgatttagctgcgtcacgatctctcttggggagctctgagagcggagccccagccccagaattcccaggttgttttcatttggtgatcagcactgaacacagaggactcaccagtggagttcgggctggagtcgttgggttttccttgttgtttattttacgaaggtgtccagagtgaagtgctaggttgggtggaggtcccgggggagtaccgttgggtcccaggtccgtgggacgggtccctggacgactccttccgtgtcgtccggcctcgtggacttccaccatcgagtcgaccactatagtcggactcgggtccgccgaggcctaccggaaggggaacggggtcttaggggaggtcgggtccgttcgggacccgtaacgtaaaacgggttaaaaaaaaccgtaaaggtttcggacccctaaaggttaccttttaacgaccgaacgtaaagggaccggttaaccggccccggtcggtttcgtacggggttaacgaaaaccgggtcccttaaacggtacctttacccccgtaacccccgttacgttaaacccgaaagggttaacggtaaacttaaccgggtaacccttttaacgaaaacgtttaacccttcgtaaacgtttacggtaaccttttaccggtaggaaccgttaaagttaccgtaaaccctttaaacccgtacgggaaaaaccggtacggtaaccggaaccgggtactacgttaaggttaattttagttcgggtttagttttagtttaagttttaactacgttacgtaaagggtaaccttcggtaaccccggg

SEQ ID NO: 291526 - DNA, 760 bp, Homo sapiens
  misc_feature: GYAE6OF01EDDUD.44.36.D03.1.454.CMB.1.raw
  modified_base (333)..(333): a, c, t, g, unknown or other
  misc_feature (333)..(333): n is a, c, g, or t
tcagacagtatatacacgaccggtgctcgatttagctgcgtcacgatctctcttggggatcacataacaaccacactcctcctctaaagaagcccctgggagcacagctcatcaccatggactggacctggcggttcctctttgtggtggcagcagctacaggtgtccagtcccaggtgcagctggtgcagtctggggctgaggtgaagagccgtggtcctcggtgaaggtctcctgcaaggcttcgtggacggctaccttcttcagtctatgtcttttagttgggtgcgacgacggcccgtggacgagggtcttggagtggcgtgggaggtntcactccgtattcgtttggtgctatcgtaattacgacacagtaacgtttcgaggtacagacgtacgtacctacgaccgttttttttttaccggaacgtaacgtaccgaacgtaacgtacgtaacgtaccgtaaccgtacgtacgggtacgtacgtacggtacggaccggtaaccgggtaccggtaacgggtaacggttaaccggttaaccggttaacgggtaaaccgggtaaacccggtaaacccgggtaaccccggttaaaccgtttaacccgttttaaccggtttttaccggtttacgggtttaccggggttaacccgggtaaaccgggtaaccccgggttaacccccggtttacccggtttaaccccgtttaaaccccgtttttaacccgtttaaacccggtttaacccggtttaacccccccg

SEQ ID NO: 291527 - DNA, 819 bp, Homo sapiens
  misc_feature: GYAE6OF01EO02T.44.36.D03.1.454.CMB.1.raw
  modified_base (216)..(216): a, c, t, g, unknown or other
  misc_feature (216)..(216): n is a, c, g, or t
  modified_base (248)..(248): a, c, t, g, unknown or other
  misc_feature (248)..(248): n is a, c, g, or t
tcagacagtatatacacgaccggtgctcgatttagctgcgtcacgatctctcgttgggggggagacgagcccagcactggaagtcgccggtgtttccattcggtgatcatcactgaacacagaggactcaccatggactttgggctgagattgggttttcctcgttgcttcttttaaggaggtggccagtgtcaggtgcagcgtaggtggagtcgngggggagcgcggcccagccgtaggacctcccngactactctcctgtcgcacgccttcgtaggacttccattccttacgaacgggtaccctagtcggaccctaagttcggaccctacggttccggggtcccgacccgaacgggcccttaccgggacgggacgggtaaacgggggtcgttacggggggacggttagggggtaccggtaacttaaaagttttacgtaacgtacgaaagggtaaaggtaacggttaaggttaaaagttacggaaaacggtaaaccgtaacggtaacgggaacgtaacccggttaccgggaaagggtaccggggtacctaacggtttacccgaacccgttacctaacccgtaagggtaaccaacgtaaaccgttacccggaaacgggaaacctaccgaacgttacggacctaacgttaccgaacgtaacgtaaacgttaccggtaaaccaacccgttactaaacggaagtacggaaccggtacgtaaccggttcgttaacgttacgttaaggttacgttacgggttaccgaacggttaccgaacccggttacccccggtacggtaccgggtacccccggttaccccgg

SEQ ID NO: 291528 - DNA, 701 bp, Homo sapiens
  misc_feature: GYAE6OF01BACY6.44.36.D03.1.454.CMB.1.raw
tcagacagtatatacacgaccggtgctcgatttagctgcgtcacgatctctcgttgggggggagacgagcccagcactggaagtcgccggtgtttccattcggtgatcatcactgaacacagaggactcaccatggactttgggctgagattgggtttttcctcgttgcttacttttaaggaggtggccagtgtcaggtgcagctagtggagtcgtgggggagagccggcccagccgtgggaacctcccgtgagacctcctcctgtcgcaggcctctggattcattcttcgaggtaccctatcgccagtcgcctacggttcgggtcccgccgagggtcctaccgagggccgaagggggtcctagggggacgggttggggtaggtaacctaaagtttactaacgtacgaaaggaaaggtagttagggtaaagtttagggaaaacgtaaacctaccggtaacgggacgtaaccgtaccgggaaggaaccggggtacctaacgtttacccgaaccccggttaccgtacccgaaggtaacgaaccctaacgttaccgaaacggaaccacgacgtacgactagtctacgactaaagtcgtaaccacctaacacgaaggacggacggaccgacggtcctgttacttagttacgttcgacgacggtacggacccgtacccccgtacggaccggtacccgggttccccg

SEQ ID NO: 291529 - DNA, 785 bp, Homo sapiens
  misc_feature: GYAE6OF01BFA8A.44.36.D03.1.454.CMB.1.raw
tcagacagtatatacacgaccggtgctcgatttagctgcgtcacgatctctcttgggggactcctgtgccccaccatggacactctttgctacacactcctgctgctgaccaccccttcctgggtcttgtcccaggtcaccttgaaggagtctggtcctgtgctggtagaaacccacagacgaccctcacgctgacctgcaccatctctggttctctctacaacgtatattagaagtgggtgtgagcgtggactccgtcgacgccccgagggaacggccgtggagtcggtcttcgcacgactactcttacgtacgaatacgaaacgtaaaactcctaacgaacgtaactacttactactagaacgtaacgtactaacgtttaaacctacttacctaaccgtaaacggaaccctaaacctaaccgtaaaacggtacgtaagggttacggttacgttttaagtacgtaacggtaaccctaaacgtacggtaccggtacccgtacggaccgggtaaccaacggtacggaaccctaagttaagtttaacgttacgtggtaacgtacgggtaacgggtaaactacggggaaaccgggtaaaactaaaccggtaggttaccgtttaggggttttacctaaggtttaaactttaacggtaacgtttaccgttaaacccttagttaacccgggttacggtaacgggtttaccgggaacggggggtaaaccgtaaaacccggggtcccgtaaacccgggttacctaacccccgggttcttccccggtaacccgg

SEQ ID NO: 291530 - DNA, 780 bp, Homo sapiens
  misc_feature: GYAE6OF01EL4TD.44.36.D03.1.454.CMB.1.raw
  modified_base (141)..(141): a, c, t, g, unknown or other
  misc_feature (141)..(141): n is a, c, g, or t
tcagacagtatatacacgaccggtgctcgatttagctgcgtcacgatctctcttggggatcacataacaaccacactcctcctactaaagaacgcccctgggagcacagctcatcaccatggactggacctggcgttcctntttgtggtgcagcagctacgaggtcgtccacgtcccgaggtcgcagtcgtggtcgcgtaggttcggtgggggtctaggagggttaggaaacggtaaccggtccggttcggggttcccgtaggggttacggtaacggttccttcccgtaggaccgtaacggtcctttcggacgggacgttcccttacctttcttacgacgttcttacgtttcgtttacgtttttaggttgggtacgaccggtaccggtacccggggtccccgtaaggggtaaccggttacggggtcctttaggggacggttcggggtccgggtaaggggggtacggtacctaccgttacccggttaccgtttaggtttccggtttgggactaccgtagttaaccgtaacgttaccgataacggtagttaacggttagacggtaactagtaccgtaccgtaaccgttacgtacccggacgtaaccaacgaccgaagtaccgacgaccgtacacgtaggtcgacttgcgacggagaccgtgagtaccgtagtaaccgtaacggacctccggtagttaaccgttctttacgttaggttcgaacggtcggaacgtaaccgttcccgtaccgttacttaccttaacgttctacccgtccttaacc

SEQ ID NO: 291531 - DNA, 781 bp, Homo sapiens
  misc_feature: GYAE6OF01AHG7A.44.36.D03.1.454.CMB.1.raw
tcagacagtatatacacgaccggtgctcgatttagctgcgtcacgatctctcttggggggagacgagcccagcactggaagtcgccggtgtttccattcggtgatcatcactgaacacagaggactcaccatggactttgggctgagattgggttttcctcgttgctcttttaagaggtggccagtgtcaggtgcagctaggtggagtcgtgggggagagcggcccagccgtgggaactccctgacgacctcgtcctgtgcgtacgccttcgtcggtattcctattcctttaccgaacggtaccttagtacgaccgtatccggccgtacggttccggggacccgcccggtaacggtcccgttacccggaacgggtacgggaaacggggggttcgttaggggtaacgggggttcgggtaccggtacttaaaagtttaacgtaacggtaccgaaaaggaaaacggttagtaagggtaacgtttaaacggaaaaccggtaaaccgtaaccggtaacgggaacctaacccggtaaccgggtaaggaaccgggtacccgtaacgttacccgtaccccgtaccgtaccgaaggtaccgtaactaacgtaaccgaacgaaccacgacgtgactactactacaagtaaccgtacgaaccgtaaccacgacgaaggtcgaacggtaccgtaccggtacgtcgtttaacgttagtttacgtacggttaggacccgtaaccggtaccccgtacccccggaaccggtacccgggtaccccggttacccccggg

SEQ ID NO: 291532 - DNA, 672 bp, Homo sapiens
  misc_feature: GYAE6OF01AJNLF.44.36.D03.1.454.CMB.1.raw
  modified_base (535)..(535): a, c, t, g, unknown or other
  misc_feature (535)..(535): n is a, c, g, or t
  modified_base (588)..(588): a, c, t, g, unknown or other
  misc_feature (588)..(588): n is a, c, g, or t
  modified_base (646)..(646): a, c, t, g, unknown or other
  misc_feature (646)..(646): n is a, c, g, or t
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttatttacaaggtgtccagagtgaagtgcagttggtggaggtccgggggagacgttggtccagcctgggacgggtccctgagtactctcctgtcgtcgcctcgtggattcaccatcagtcgaccactatagtggacgtcgggtcccgccgagggtcctaccggaagggggaacggggtcgtaggggtaggtcgggtccgttcgggacccgacgtaaacggtaaaaaaacaaggttcgacccgtaggtacttttaagtaccgaacgtaacggtaacggtaccggccgtacgttcgtaggtacgaaacgccaagtacttccccaacccttctacgaagagtacgtacgaccttacgaagtacctntaagtttgactttcgtagacgtaatacgtaacctaaccgtaaggaaaacccgnggaaccgaacgggtactaagttcgttaatttacgttggttcgtttagttacgtttaanacgttacgaaggtacctcggtacccg

SEQ ID NO: 291533 - DNA, 809 bp, Homo sapiens
  misc_feature: GYAE6OF01ALAST.44.36.D03.1.454.CMB.1.raw
  modified_base (178)..(178): a, c, t, g, unknown or other
  misc_feature (178)..(178): n is a, c, g, or t
tcagacagtatatacacgaccggtgctcgatttagctgcgtcacgatctctcttgggggactcctgtgccccaccatggacactctttgctacacactcctgctgctgacccaccccttctgggtcttgtcccaggtcaccttgaaggagtctggtcctgtgctggtacgaaacccanagacgaccctcacgctgacctgcaccatctcgtggttctctctacaacgtattatagagtgggtagtgagtcgtggactccgtacgaccgaccccggaggggacggccgtggacggtggtctcgcacactacttcgttacgacgaatacggaaacgtaaaactacctaacgaacgtacctacttcctacgaagtaacgtacgtaaccttaaacgttaacctacgtaccgtaaccgaaaccggtaacccaacccgtaaaccggaaacgggtacgttaacgggtttacggtttaacgtttaacgtaacgtacccgtaacctaaacggtacggtacccggtaccccgtaggaacccgaaccgacggaacggtaccctaacgttaacgttaacgttacggtacggtaaccggtaaccgggttaaacggggtaacgggtaacgggaaaaccgggtaaacggtaaccgttacgggtttaccggtttacggtttacgttaagtttaacgttaacgttaaccgtttacctacggttaacggttccggttagggttacccgggtaggggtaaaccggggaaccggtaaaccgggtacccggttccgtaaaccccggttccgttcccgtaccgtaacccgg

SEQ ID NO: 291534 - DNA, 1025 bp, Homo sapiens
  misc_feature: GYAE6OF01E1LWE.44.36.D03.1.454.CMB.1.raw
tcagacagtatatacacgaccggtgctcgatttagctgcgtcacgatctctcgttgggggggagacgagcccagcactggaagtcgccggtgtttccattcggtgatcatcactgaacacagaggactcaccatggactttgggctgagtattcgggttttcctcgttgcttcgttttaagaggtggccagtgtcaggtgcagctagtggagtcgtgggggagagccggcccagccgtggaacctcctgacgctctcctgtcgcacgcctcgtggtactttcgaattccttacgaaggtacccttatcgtacccaatcggacctaccggttcgggggttcccccgaccccgaacgggtcccttacccggaaggggacccgggtaaagggggggtccgttaggggggtaacgggtttcgggggggttacggggtaaacccttaaaaagttttaacgtaaacggttaaccggtaaaaggggtaaaaaggttacgggtttaaaggggtaaaagttttaaacggggaaaaaacggtaaaacccggtaaccgggtttaaacccgggggaaacgtaaaccccggtaaccccgggaaacgggggtaaaccgggggtaccccgggttaaaccgttttacccggtaaacccccggtttaccccgttaaacccggtaaacggtaaacccggttaaacccgtaaaaccgttttaaccccggaaaaccgggtaaaacccctaaacccgtaaacccgtttacccgggtaacccttaacgttaaccggtaaccggtaaacccgtaaaaaccgttaacccggttaaaacccgtaaaaccccgttaaccccgtaaaaccggtaaaccggtaaacggggaaaccgggtaaaaccccggtaacccggggttaccgtttacggtttaaacgtttaacgttttacggtttacgggttaccggtaaccggtaaacccgggtaccccgtaacccccccggttacccggggtaaacccggttaccccccgggggttaacccccccggg

SEQ ID NO: 291535 - DNA, 1019 bp, Homo sapiens
  misc_feature: GYAE6OF01BSYD8.44.36.D03.1.454.CMB.1.raw
tcagacagtatatacacgaccggtgctcgatttagctgcgtcacgatctctcttggggagctctgagagcggagccccagccccagaattcccaggttgttttcatttggtgatcagcactgaacacagaggactcacagtggagttcggctgagtcttggttttccttgttgttatttacaggttgtcagtagtgaagtgctaggttgggtggaggtccgggggtagtaccgttggtccgagtcccgttgggacgggttccctaggacgtacctccttccgttggttcgttccgcccttcgttacggtactttcccgaaccctaattccgaacgttcggaacccctaacttaagtaacgtcgggtaaccgttcgggggtccccgtacccgagggtcccgttacccgggaaggggggtaaagggggtcccgttaagggggtacggtcggggttaccgttttaccggggaccccgtaaacggtaaaaacgggttaaaaaaaaaccgtaaacggggttttccggaaccccgtaaaggtttaccgttttttaaacaacccgtaaaccgtaacggggtaaaccgtttaacccgggccccggttccggttaaccggttaacgggttaacgaaaaacccgggtcccgaaacggttaacccttttaacccccgaaacccccgtttacgtaaaccgtaaacggtaacggtaactttaacgggtaacccttttaaacggaaaaccgttaaaccttaccgtttaagtttacggttaaaccttttccggttaaggtaacccggttaaagttaccgggttaaaaccccttaaacccggtaaaccgggaaaaaaacccccggttaaggggtaaaccccgaaccgggggtaactttaaacggtttaaacgggttttaaagttttacggtttttagggtttaacgggttttcggttttttaaacgttttaaacgtttaaccggttaaacggttaaacccggtttaaccggtttaacccgggttaaccccccggg

SEQ ID NO: 291536 - DNA, 700 bp, Homo sapiens
  misc_feature: GYAE6OF01AIIEW.44.36.D03.1.454.CMB.1.raw
  modified_base (286)..(286): a, c, t, g, unknown or other
  misc_feature (286)..(286): n is a, c, g, or t
  modified_base (640)..(640): a, c, t, g, unknown or other
  misc_feature (640)..(640): n is a, c, g, or t
tcagacagtatatacacgaccggtgctcgatttagctgcgtcacgatctctcttggggatcacataacaaccacactcctcctctaaagaagcccctgggagcacagctcatcaccatggactggacctggcggttcctctttgtggtggcagcagctacaggtgtccagtcccaggtgcagctggtgcagtctggggctgaggtgaagagccgtgggtcctcggtgaaggtctccgtgcaaggcttcgtggaggctaccttctcagctatgtcttttagttgggngcgacgacggtccctggacgacgggtcttggaggtcgggcgtgggggagggtactacgacgttaccccgttagttccggttttgggtcgtactaacgttaccggtaaacgtttaccggaccgtaacgtaacggttaacggttttaccgaaacggggtaactaagggacgtaccgtaaccgtacggtttaaccccggacgggtaaccgaaacgttacccgaaaccggttacggtaaaccgtaccgtacccgtaacgtaggtacgggtacgacccgttagggaacggcggtaacggccgtagggacgtacgtacgttaaggaacgaccggtaacgcctacgttcttacgttttcgnggttacgcggacgtaccggtcccttaccgtacttaaacctttcgtacttcccggttaccc

SEQ ID NO: 291537 - DNA, 775 bp, Homo sapiens
  misc_feature: GYAE6OF01CL76V.44.36.D03.1.454.CMB.1.raw
  modified_base (346)..(346): a, c, t, g, unknown or other
  misc_feature (346)..(346): n is a, c, g, or t
  modified_base (373)..(373): a, c, t, g, unknown or other
  misc_feature (373)..(373): n is a, c, g, or t
tcagacagtatatacacgaccggtgctcgatttagctgcgtcacgatctctcgttggggggagacgagcccagcactggaagtcgccggtgttccattcggtgatcatcactgaacacagaggactcaccagtggactttgggctgagtagttgggttttcctcggttgctttacgtttttaaggagggttcggccctaaggttcggtcgaggggttcgcgaagtcgttaaggtgggaggttcggtgggggggagacggccgggcccaggccgtagggaacctcccgtgacgtacctcgtcgtggcgcacgcctcgtggtacttcgattccgtacgaggtaccctntcgacctagtccgactcgtcgggcccncgaggtcctaccggaggaccgaggggctgggaggtgggtacgactaagttagtagacgtaaggtaagtagttaggtaagttaacgaaacggttaaccgaacggtaacggacgtaacccgtacggaacgggtaaccgggtaccgtaacgtttacccgaacccgttaccgtaaccgaaacgggtacgaaacccgttaacgtaacccggaaaccggtaaaccaccgtacgtaggaccctagtacctacgtaacgtaaactacggtaaaccaccgttaacgaacgtaaggtacgaacggacccttagggtaccgttacgttagttaactttcgggcgttaaccggacggtaccccggtaaccccgtacccccggttggaaccccgggttcccccgggttaccccgg

SEQ ID NO: 291538 - DNA, 554 bp, Homo sapiens
  misc_feature: GYAE6OF01DHYOV.44.36.D03.1.454.CMB.1.raw
  modified_base (328)..(328): a, c, t, g, unknown or other
  misc_feature (328)..(328): n is a, c, g, or t
  modified_base (449)..(449): a, c, t, g, unknown or other
  misc_feature (449)..(449): n is a, c, g, or t
tcagacagtatatacacgaccggtgctcgatttagctgcgtcacgatctctcttgggggactcctgtgccccaccatggacactctttgctacacactcctgctgctgaccacccttcctgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctcgaatgacgaaaatcctacagtacatctctgaanagctaagtttaaccatctacaaggacacctacaaaggcaggtgtcttagtatgacaacatcggaccctgcgaacacacggcacatattactgtgacacgggtaatcgacgggaaacgaaanacgcgttggtttctagttaattaagtaagtccttacagttcgtaggaccggtcggtaggggtaccaaaggggtaccctacgggtcctaaccgtccgtccgtaccg

SEQ ID NO: 291539 - DNA, 661 bp, Homo sapiens
  misc_feature: GYAE6OF01D7HA2.44.36.D03.1.454.CMB.1.raw
  modified_base (222)..(222): a, c, t, g, unknown or other
  misc_feature (222)..(222): n is a, c, g, or t
  modified_base (238)..(238): a, c, t, g, unknown or other
  misc_feature (238)..(238): n is a, c, g, or t
  modified_base (398)..(398): a, c, t, g, unknown or other
  misc_feature (398)..(398): n is a, c, g, or t
  modified_base (495)..(495): a, c, t, g, unknown or other
  misc_feature (495)..(495): n is a, c, g, or t
  modified_base (654)..(654): a, c, t, g, unknown or other
  misc_feature (654)..(654): n is a, c, g, or t
tcagacagtatatacacgaccggtgctcgatttagctgcgtcacgatctctcgttggggcagagctcgtgggggagaactgctcagttaggacccagacggaaccatggaacgccccagcgcagcttctcttcctctgctactctggcctccagactaccatggaagaaatgtgatgacgcggtctccagccacctgtctgtcgtctaccgaaggggaaacncgcctaccctctccgnggcacgggcctaagtcaagtgtgtagcagactaacgttagccttacgaaccagactaaacgaaacgttcgacggaccacgggtcctaccccggaggtcctacctctaacgttctagttcggacacctaactcccgaacgtacggacctacggtgttaccnccgacgtaccgtaggttcagggttcggacgtagggttcgggtcgtacggggaacacggtacgttaccacgttctaccaccgaatcgacgcacgtccncgacagttctaaggtaattgttttacgacgttaagttttacgtaaccgttggtaactagaacctaagttaataacgtgaaccgttcgggtaccccttacggttacggaaccggtaaagggacctaacgtacgtacgggtaaagtaaacgtttaaacggngtacggg

SEQ ID NO: 291540 - DNA, 637 bp, Homo sapiens
  misc_feature: GYAE6OF01EX4K3.44.36.D03.1.454.CMB.1.raw
  modified_base (383)..(383): a, c, t, g, unknown or other
  misc_feature (383)..(383): n is a, c, g, or t
tcagacagtatatacacgaccggtgctcgatttagctgcgtcacgatctctcttgggggggagacgagcccagcactggaagtcgccggtgtttccattcggtgatcatcactgaacacagaggactcaccatggagtttgggctgagctgggttttcctcgttgctcttttaagaggtgtccagtgtcaggagcacttggtggagtcgtgggggagcgtggtccagcccgggagtccctgagactctctgtgtagcctctgggttctcattcgattaggattttggtttgcgtacgtggggtcccgccgaggcctccgaggcgaaggggccggaggtgggtgcagtcatctaccgacgagtggaagtgaagtaagtattacngagtactccggtaggaacgggccgtattacaccacttcctaccgagacgaacaacttaccaaagtaatatgcttagtatttagaactaatagaacgagacgtaggaggtagttaggaaccgacgtacgttcgttagttttatacgttggtacggtaccgggtaacgggggtacccgtaccggaaaacggggtaaaccggggttacggggtaaacttaccgtaaactttaaacccgttaacgtaacgtttaacgg

SEQ ID NO: 291541 - DNA, 908 bp, Homo sapiens
  misc_feature: GYAE6OF01D1LVS.44.36.D03.1.454.CMB.1.raw
tcagacagtatatacacgaccggtgctcgatttagctgcgtcacgatctctcgttgggggggagacgagcccagcactggaagtcgccggtgtttccattcggtgatcatcactgaacacagaggactcaccatggacttttgggctgagtattcggggtttttcctcgtttgcttacgtttttaaggagggttggcctagtgtcgaggtgcagtctaggtggagtcgtggggggagacggccggcccgaggcccgtaggggaacctcccgtagacgtaccttccgtccgtggtcgacctacgtcccttcgtaggtacttacccgtaaccttttaacgacgtcttaagtcgtacctaagtacggtaaccggttcggggtaccccgacccgagggtcccgttacgggtagggggaaacgggtttccgtaggggtacgggttcggggttacctaccggttaagggttaaccgggtttaaacgtagggggttttcgggggtaagttaaccgtttaaccgaaccgttaacgtaaccccggtaacgaccgtaaacggtacccggtttaccgggtaaaacgggtaacccggggttacccggtttaacccaacccgtaacttacccgtaaccgtaaggtaaacgtaaacgtaaaccgttaccggaaacggtaacctaccttacccttaacttacggttacttaaccgaaacgtaaacgtacggtaaaaccgcggtaaccggtagggaacggtaaccgggtaacggaacccgggtaccgggaaccggttaccgtttaaagttaccgttacggttaggtaacggtaaaggaaaagggttcgggttaaccggggttaacgttcggtaacgggttacgggtttacgggtttagggggtttcgggtaacggtttaccggg

SEQ ID NO: 291542 - DNA, 679 bp, Homo sapiens
  misc_feature: GYAE6OF01C1PAE.44.36.D03.1.454.CMB.1.raw
  modified_base (220)..(220): a, c, t, g, unknown or other
  misc_feature (220)..(220): n is a, c, g, or t
tcagacagtatatacacgaccggtgctcgatttagctgcgtcacgatctctcttggggcagagctctggggaggaactgctcagttaggacccagacggaaccatggaagccccagcgcagcttctcttcctcctgctactctggctcccagataccactggagaaatgtgatgacgcggtctccagcccacctgtctgtcgtctaccgaaggggaaacncgcccaccctctcgtgcgacgggccagtcaggtagtagttacgacagactaaacttacgccctacgtaccgagacctaagaaactcgtacgggaccaacggccctaccgacggtacctcctagacttctagtcgggtcaccactcccaacgcggaccctagtaggacctcccgagtcccgaggttcaggttaggcgtagggtcgggtagtgggaacaggtacttaccgactccacgtacctagtacacggacacgtccgtagcctaaggttcctaaggttaacgtttcgttttacggacctttaaggtttttaacgtaccgttagtacgaacgtactaaagttaaactaaacgttaccgtcgtacccttaccgtaccggtttaacggttcccgggggaaccgggggtaacctaaggggttacggaaacgttacgtaaaccgaaaacgggtcgttacggg

SEQ ID NO: 291543 - DNA, 780 bp, Homo sapiens
  misc_feature: GYAE6OF01B5194.44.36.D03.1.454.CMB.1.raw
  modified_base (163)..(163): a, c, t, g, unknown or other
  misc_feature (163)..(163): n is a, c, g, or t
  modified_base (181)..(181): a, c, t, g, unknown or other
  misc_feature (181)..(181): n is a, c, g, or t
  modified_base (194)..(194): a, c, t, g, unknown or other
  misc_feature (194)..(194): n is a, c, g, or t
  modified_base (210)..(210): a, c, t, g, unknown or other
  misc_feature (210)..(210): n is a, c, g, or t
  modified_base (225)..(225): a, c, t, g, unknown or other
  misc_feature (225)..(225): n is a, c, g, or t
  modified_base (618)..(618): a, c, t, g, unknown or other
  misc_feature (618)..(618): n is a, c, g, or t
tcagacagtatatacacgaccggtgctcgatttagctgcgtcacgatctctcttggggcagagctctggggaggaactgctcagttaggacccagacggaaccatggaacgcccagcgcagcttctcttcctctgctactctggctcccagataccactgganaatagtgatgacgcgtcncagccacctgtcngtgctcgaagggaaancgtccacctctccgngcgacgggcctaagtcaaggtacgtgttacgcagacctaaacgttcgccttaccggtaaccaggaccaagtaaaacgttccggtacggacccgaacgggtccctaccccgaacggtcccttaccctacctaacgtttcgtaacggtcgggtacgacccttaacgtaccccgaaccggtaacgggacccctaacgttaccgggtaaacccttccccgaacggtaccccgttaacgggtttaccgaacgggttccggggaccggttaggggttaccggggtacggtacggggtaacgtaacgggttaacgttaccctaaccgttcctacccgtaaccgtactaccggacgaccgtaaccggtcccgtaagcgtaacgttacttaaggaacgtttnttttacggaacctttagtttaactaccgtagttaacgtgtaaccgtaattaacgttacgtacgtaccggtaccggtccccttaccgggtacggacccggaaacggtaacccacgggttaaaccggtagtaaaacggttaacgtaaaacgggtacgttacggg

SEQ ID NO: 291544 - DNA, 934 bp, Homo sapiens
  misc_feature: GYAE6OF01AEMP0.44.36.D03.1.454.CMB.1.raw
tcagacagtatatacacgaccggtgctcgatttagctgcgtcacgatctctcttggggggagacgagcccagcactggaagtcggcggtgtttccattcggtgatcagcactgaacacagaggactcaccatggagtttgggctgagcgtgggttttcctcgttgctcttttaagaggtgtccagtgtcaggtgcagctggtggagtcgtgggggagcggtggtccagccgtggggacggtcccctgacgacctccgtccgtgtcgcaggcgtcgtggtacttccaccctttcacggtttaaccctagttcggcctaagtcggccgaaccgttcgggggttacccccgccgaaggggtccctacccggaagggcccgtaaaggggggtcttacgggggtaagggttcggggtacggaccttaaacgtttagtaaggtttcggggtaagttagggtaagttagggtaaaaagtttaaaacttaaaacgttaaccgttaaaggttcgaaccgaacgggttaaccccgttccggggtaacgggtaaaccgggggtaccccgttaaacgtttccccgaaacccgttaacgttaccccgtaacccggtaaaggtaaacccggttaaacctaaaacccgtttaaaccccgaaaaccgggtaaaaccccgtaacccgggtaccgtttaaccgttaaccgttaccggtaaccgtaaaccccggttaaaaacgttaaccggtaaaacccgaacggttaaccccgggtaagggtaaaccgggtaaaccgggaaccccggggtaaacggggtaaacccccggtaaccgggttacccgttacggggtttacgtttaaacccggtttaaccggttacgggttaccggtaccgggtaaacggttaaacgtttaaccggttttaacgtttaacgggtttaaaacccccg

SEQ ID NO: 291545 - DNA, 669 bp, Homo sapiens
  misc_feature: GYAE6OF01CF1Z5.44.36.D03.1.454.CMB.1.raw
  modified_base (351)..(351): a, c, t, g, unknown or other
  misc_feature (351)..(351): n is a, c, g, or t
  modified_base (626)..(626): a, c, t, g, unknown or other
  misc_feature (626)..(626): n is a, c, g, or t
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttatttacaaggtgtccagagtgaagtgcaggttgggtggaggtccgggggatacgttggtccagtcccgtgggacggggttcccctaggacgtaccttcgtaccgttggttacgtccgccttcgtggtacttccacctatcaagtcgaacctactatagtcggtacgttcgggcccnccgaggcctccggaaggggaacgggtctagggaggtcgggtccgttgggaccgtacgtaaaaggtaaaaaacctaaggttcgacctagttactttaacgcacgtaggaacgtccgccgtcgttcgtagtagaacgacgtacgtacttacctaccctcgtacaagagtatacgtactactaacgtaactactattagtactcgtacgtacgtaacgtacgtaactaacgtaacgaaaccgacggaacgacggacgtagtacgtatttttttttagngtttagttaggtttagttattacgtagtacgtagtcgtaccgg

SEQ ID NO: 291546 - DNA, 647 bp, Homo sapiens
  misc_feature: GYAE6OF01E1F4O.44.36.D03.1.454.CMB.1.raw
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgctaggttgggtggaggtccggggggagtacgttggtccaggcccgtgggacgggtccctggagactctcctgtgtccgcctcgtggattcaccatcagtgaccactatatggactgggtccgcaggctccgaggggaacgggcgtgggagtgggcttcgggccgacgaagtaaaaacgaagttgaccagtctttatcaacgagacgtcgccgcgtctgagaaacgccagtacttccaccctctacgaagagtattacgactttacgaaacgtaacttactaatttgtacttacgtgtaaccgtaagttactaacctaaaccgtaacggaaaacccggtagggaacccgtaaggggaccttaaggttagtttaagtttaagttgggttagttttacggtttagttttaaatacgttacggaaacggttaaccgtcggtaaccccgg

SEQ ID NO: 291547 - DNA, 689 bp, Homo sapiens
  misc_feature: GYAE6OF01CBVNR.44.36.D03.1.454.CMB.1.raw
  modified_base (155)..(155): a, c, t, g, unknown or other
  misc_feature (155)..(155): n is a, c, g, or t
  modified_base (258)..(258): a, c, t, g, unknown or other
  misc_feature (258)..(258): n is a, c, g, or t
  modified_base (428)..(428): a, c, t, g, unknown or other
  misc_feature (428)..(428): n is a, c, g, or t
tcagacagtatatacacgaccggtgctcgatttagctgcgtcacgatctctcgttgggggactcctgtcgccccaccatggacactctttgctacacactcctgctgctcgaccaccccttcctgggtcttgtccccaggtcctaccttgaaggngtctggtcctgtgctggtacgaaacccacaagacgaccctcacgctgacctgcaccatctctgggttcctctctacaacgattagttagagtgggtgtgagtntggactccgtcgaccgccccggaagggaccgccgtagggcgtggtctgaccacactactccttctacgtaactagaaaccgaaaactcctaacacgtacattacctacgtacgaagacgtacgtaacgtttaacctactactacgaaacgtaccaaccgtaacgaaacgngtacggttacgttattacgtataccgaacctaacgtagtaccggacgtcgacgaacacgagcctaagtattacgtacgtacggacgttaccgtaacggggtagtaacggaacgggttaaaacgaacggtgtttaccggttacggtttacttaggttaaagttaaacgttacttacccgtttaacgtcgtaccggttaggacggttacgggtaccgggaacgaaccgggtccgaccgggttcctaccgtccgtccgtaccgg

SEQ ID NO: 291548 - DNA, 565 bp, Homo sapiens
  misc_feature: GYAE6OF01AJWON.44.36.D03.1.454.CMB.1.raw
  modified_base (188)..(188): a, c, t, g, unknown or other
  misc_feature (188)..(188): n is a, c, g, or t
  modified_base (312)..(312): a, c, t, g, unknown or other
  misc_feature (312)..(312): n is a, c, g, or t
  modified_base (316)..(316): a, c, t, g, unknown or other
  misc_feature (316)..(316): n is a, c, g, or t
  modified_base (439)..(439): a, c, t, g, unknown or other
  misc_feature (439)..(439): n is a, c, g, or t
  modified_base (449)..(449): a, c, t, g, unknown or other
  misc_feature (449)..(449): n is a, c, g, or t
  modified_base (453)..(453): a, c, t, g, unknown or other
  misc_feature (453)..(453): n is a, c, g, or t
  modified_base (457)..(457): a, c, t, g, unknown or other
  misc_feature (457)..(457): n is a, c, g, or t
  modified_base (462)..(462): a, c, t, g, unknown or other
  misc_feature (462)..(462): n is a, c, g, or t
  modified_base (470)..(470): a, c, t, g, unknown or other
  misc_feature (470)..(470): n is a, c, g, or t
tcagacagtatatacacgaccggtgctcgatttagctgcgtcacgatctctcttggggagctctgagagcggagccccagccccagaattccccaggtgttttcatttggtgatcagcactgaacacagaggactcaccatggagttcgggctgagctgggttttccttgttgttattttacaaggtntccagagtgaagtgcagttggtggaggtccgggggagacttggtccagccgtggacgggtccctgagactctcctgtgtcgcctctggattcaccatcagtgaccactatatggactgggtccnccgnggcctcgaggggaagggctgggagtgggcttgggccgtacaagtaaaaacgaaggttcgccaagtctttatcaacagacgtaccgccgtgtctggtagaacgcagtacttcaccctctcaagnatgactcaanactnagtntatcngacgtaangaacctaactagaaaccgtggacgaccggcaagttcgtatttagttggttagtttagttagtttactagttaccgaggttaacctggttaacccg

SEQ ID NO: 291549 - DNA, 632 bp, Homo sapiens
  misc_feature: GYAE6OF01BTEUQ.44.36.D03.1.454.CMB.1.raw
  modified_base (333)..(333): a, c, t, g, unknown or other
  misc_feature (333)..(333): n is a, c, g, or t
  modified_base (352)..(352): a, c, t, g, unknown or other
  misc_feature (352)..(352): n is a, c, g, or t
tcagacagtatatacacgaccggtgctcgatttagctgcgtcacgatctctcttggggatcacataacaaccacactcctcctctaaagaagcccctgggagcacagctcatcaccatggactggacctggcggttcctctttgtggtggcagcagctacaggtgtccagtcccaggtgcagctggtgcagtcgtggggctggaggtgaagagccgtgggtcctggtgaggtctcctgcagcttcgtggacggctaccttcttcagtctatgtcttttagttgggtgcgacgacggtccccgtggacgaagggcttggagtggcgtgggaggntcactcctagttcgttggngtcacgtacgtaacttacgactacgagtaagtttcgaaggtacaggtacgtaccaaccgtacgttacccggacggtaaccgtaactcccgtaacgacgtaaccgacgtacctaacgagtggacgcgtaggacgcggaaggtcgtaggaacgtattacgtaggaaacgtccggaaccggccttaacgttccgtttaagtttccgttaggtacggaccggtaacggtacccgtccccgttacgttacccttaaacgtttcctaacggttcccgttacccccg

SEQ ID NO: 291550 - DNA, 937 bp, Homo sapiens
  misc_feature: GYAE6OF01CTATX.44.36.D03.1.454.CMB.1.raw
tcagacagtatatacacgaccggtgctcgatttagctgcgtcacgatctctcttggggatcacataacaaccacactcctcctctaaagaagcccctgggagcacagctcatcaccatggactggacctggcggttcctctttgtggtggcagcagctacgaggtgtccagtcccgaggtgcagctggtgcagtcgtggggctggaggtagaagagccgtggtccgtcggtagaacggtcctccgtgcgtaaggtcttcgtggacggtcctacctttctcgagtacttagtcgttcgtttttagtttgggtcgaccggacgtaccgggtcccccgttaggggaaccgtaacgggggtcgttttacgggaacgggttcggggtaccgggttaggggggtaacgggggtaccgtttaccccggtaaccgtttaccccccggtttaacgtttttccgggtttttacgggggttacggttaacccgtaaccggtttaacccgggtttaaaaccggtttaacccggtaaacgtaacccgttaaaaggggtttaaacggtttttacccggaagggtaaaccggtaacgggttaaacccggttacccgtaaaccccgttaaaccgggtttaaacccccgggaccgggtaaaaccccgttaaaccgttaccccggaaacgggtaaccgttaacccgggaaaccggttaccccttaaacggaacgtttaccgggaagtacccggttaagggaacgggtaaccggtagggacccggttaaggtaaccggtacggttaacgtaaacggaacgggaaacccgaccgggtacccttaacggtttacgttacgtttttaccggagggtaaccggtaccgggaaccgttacccggtaccccgttaaccgttaccgttaaaccttttaccgtcccgttaaccgtttacccccg

SEQ ID NO: 291551 - DNA, 794 bp, Homo sapiens
  misc_feature: GYAE6OF01CEGCN.44.36.D03.1.454.CMB.1.raw
  modified_base (166)..(166): a, c, t, g, unknown or other
  misc_feature (166)..(166): n is a, c, g, or t
  modified_base (225)..(225): a, c, t, g, unknown or other
  misc_feature (225)..(225): n is a, c, g, or t
tcagacagtatatacacgaccggtgctcgatttagctgcgtcacgatctctcttggggcagagctctggggaggaactgctcagttaggacccagacggaaccatggaagccccagcgcagcttctcttcctcctgctactctggcctcccagataccactggaanaaatagtgatgacgcagtcctccagcccacctgtcctctgtcctaccgaaggggaaacncgcccaccctctcctgcgacgggccagtcgagagtgttggcagcgagcgtacgccgttcggttaccagaccaacgaaacccgtcggacccaacgtacccgtaccccgacggtcccttcccgtacctaacttaccttaaacctaaccccaaccgtaacccgttacccccgaaacccggaccggggtacccctaaccggttacgggttaacccctacccccgtaaacccccggttaacgggtttacccgaaccggggttcgggtaccggttaacgggggttacccggggggttacccggggaaaccgtacggggttaaccgtttacccgtacccgttacccgtaaccctacccgtacgtaccgacgggtacccggtcccgtcgaccgtacggttccgtagggtacggtttacgttttcggactttaggtttactttacgtcgtactacggtataagttaacgttaacgtaccgttcggtccttccgtaccggttacgggttaccggggacggggtaaccgtaaggggcgtaacgaccggtaacgtaaacggtaggttacgtggccgtaccg

SEQ ID NO: 291552 - DNA, 785 bp, Homo sapiens
  misc_feature: GYAE6OF01AEZTI.44.36.D03.1.454.CMB.1.raw
  modified_base (170)..(170): a, c, t, g, unknown or other
  misc_feature (170)..(170): n is a, c, g, or t
  modified_base (186)..(186): a, c, t, g, unknown or other
  misc_feature (186)..(186): n is a, c, g, or t
  modified_base (203)..(203): a, c, t, g, unknown or other
  misc_feature (203)..(203): n is a, c, g, or t
tcagacagtatatacacgaccggtgctcgatttagctgcgtcacgaggtctctcgttgggggggagacgagcccagcacgtggaagtcgccggtgtttccattcggtgatcatcactgaaccacacgaggactcaccagtggactttgggctggacgattgggttttccncgttgcttctttaagnggtgccagtgtcaggtncagctaggtggagtcgtagggggagcgcggcccagccgtggggaacctcccgtgacgtactcgtccgtggtacgactagccttcgtggtattccaattcttcgaacggacctagtcgcccagtcgacgtaccgtcgggtcccgacgtaaggtcctaccgagggccgaacggggtcgtgggaggtgggtacgtactaaagttacgtactacgaaggtaagtacgttaggtaaattagggaaaacgtaaacctaaccggtaacgggtaacgtaacccgtaccgggaacggaacgggtacccgtaacgttacccggaaccccgttccgtaaccggtaacggtaacggtaaccgtaaaccgttaccgaaacgggtaaaccaaccgtacgtacgtacgtacgttaccgtaacgtaacctaaacgttaaccgtaaccgtaacccgtaacgtaacgtaaggtacgaacggtaacccgtacgggttaccgttacggttaccgtttaaggtttacgttaccggtacggtacccggtaacggtaaccccggtacccccgtacgggtaacccgggtccccgggttacccccgg

SEQ ID NO: 291553 - DNA, 659 bp, Homo sapiens
  misc_feature: GYAE6OF01AKCH0.44.36.D03.1.454.CMB.1.raw
  modified_base (423)..(423): a, c, t, g, unknown or other
  misc_feature (423)..(423): n is a, c, g, or t
  modified_base (483)..(483): a, c, t, g, unknown or other
  misc_feature (483)..(483): n is a, c, g, or t
  modified_base (521)..(521): a, c, t, g, unknown or other
  misc_feature (521)..(521): n is a, c, g, or t
tcagacagtatatacacgaccggtgctcgatttagctgcgtcacgatctctcttggggagctctgagagcggagccccagccccagaattcccaggttgttttcatttggtgatcagcactgaacacagaggactcaccatggagttcgggctgagcgttgggttttccttgttgtttattttacaaggtgtccagagtgaagtgcgtaggttgggtggaggtccgggggagtacgttcggtccagccgtgggacgggtccctgagctctccgtgtcgtccgcctcgtggacttcaccatcagtcgacctactatacgtcggacgtcgggtcccgccgaggccgtaccggaggggacgggcgtgggaggtggtcgttcgggccgaacgaaaggttaaaaacgtaagttcgacctagtctttanccaacgagtacgtaccgccgtcgtcctaggtacgaaacgtccaagtccttacccaccctntaacgaaggtacattacgtaaccttacgaaattacctntaacgttgtacttcgagtacgtaattaccgtaacccttaaaccgaggaaaacccggtaggaccgacgggtactagttacgttaatttaggtttgttaggtttattagtttactacgtagaacggtactcggtacccgg

SEQ ID NO: 291554 - DNA, 663 bp, Homo sapiens
  misc_feature: GYAE6OF01EI13L.44.36.D03.1.454.CMB.1.raw
  modified_base (234)..(234): a, c, t, g, unknown or other
  misc_feature (234)..(234): n is a, c, g, or t
tcagacagtatatacacgaccggtgctcgatttagctgcgtcacgatctctcttggggcagagctctgggggaggaactgctcagttaggacccagacggaaccatggaacgccccagctcagcttctcttcctcctgctactctcggctcccagacttccgaccggacgtaaatttgtgttgacacaatctccacgccctacccttgttctttcgtccggtaccgggggaacncgcccacctctctgcgacgggccgcagctgtacgacgacgtacgtacgtcgtacgtaaccaacgacgaacgcgtcggccgacggcctcccgacgtacctcctctactctatacgtatacttacgagtttttttttttttttacgggccgttcgtcgtctactccgacgtccgtctcgtacgtcggcgtaggtcggtcggtcggacgtacgtacttctactctactacctactaccaccacgtaccgtacgtacgtacgtacgtagttacgtttacgtacttacgtttactttacgttacgttactacgtaacgtaacgtacggtacgtacctacctaacttacgttactaccgttccggtaccgtacggtaacgtaacggtacgtaatactacgtaaacgtacgtacgtacgacgtacgcctactctcg

SEQ ID NO: 291555 - DNA, 796 bp, Homo sapiens
  misc_feature: GYAE6OF01AS4HF.44.36.D03.1.454.CMB.1.raw
tcagacagtatatacacgaccggtgctcgatttagctgcgtcacgatctctcgttgggggggagacgagcccagcactggaagtcgccggtgtttccattcggtgatcatcactgaacacagaggactcaccagtggtactttgggctgagagttcgggtttttcctcgttgtcttcgtttttaaggagggtcggcctagtggtacgaggtgcagcgtaggtgggaggtcggtagggggggaggacggcccgggacccaggtcccgtaggggtaaccctcccgtagacgtaccttccgttccgtggtacgccgtacgcccttggtaggtactttacctaagttccctacgaacggtaccctagtcgaccctagtcgactaccggtcggtaccccacgacggcctaccggagggaccggaacgggggtcgtaggggaggttcggggtgaactaattagtagacgaaagaagtagtaggaacgttagaaacgaacgacggtacggagtaccgtacggaaggtacggccgtatccgaccgtacctacggaagtacgtaactaacctacggaaggtaaaccacctacgtacgaataccgttacgtacgaaccttaaacgtccgtaaaccctaacccgtaacggtaaacccgaaaggttacccgggaaaccgggtacgttaaccccggtagtttaccgttaaaccgtttaaggtttcggttacgggtacccggtacccgtaaaccggttaccccccgaccccgggttacccgggtaaaccggtcccccggggttacccccg

SEQ ID NO: 291556 - DNA, 717 bp, Homo sapiens
  misc_feature: GYAE6OF01BB0RJ.44.36.D03.1.454.CMB.1.raw
  modified_base (236)..(236): a, c, t, g, unknown or other
  misc_feature (236)..(236): n is a, c, g, or t
tcagacagtatatacacgaccggtgctcgatttagctgcgtcacgatctctcttgggggactcctgtgccccaccatggacactctttgctacacactcctgctgctgaccaccccttcctgggtcttgtcccaggtcaccttgaggagtctggtcctgtgctggtgaaacccacagagaccctcacgctgacctgcaccatctctggttctctctcaacgatattagaatgggtntgagctggatccgtcacgcccccgagggaacggccctggagtggcttgcacactatcttctacgaatgaacgaaaatcctaacacgtacatctctaggaacgagtactaacgtttaaaccatacctaccgaaacggaacccaacccgtaaccgaaaaacgggctaaggggttacggttaccgttttaaggtaacttacgaacccctaaacgtacgttaccgggaaccccttggacccggaaccaaccgacgggaccaactattaactttacgtggtacggaccgtaacggggttaactacgggaaccggggaaaagaaccgtaacggttccgtttagggttttacctaggtttaattaagttaaaccggttccttaaaccgtaacgttccggttacgggtaccggttacgggtacgggggaaacctaaaacgggggtaccctaacccgggtacccaacccggtttccctacccgttacccg

SEQ ID NO: 291557 - DNA, 700 bp, Homo sapiens
  misc_feature: GYAE6OF01AYRAC.44.36.D03.1.454.CMB.1.raw
  modified_base (364)..(364): a, c, t, g, unknown or other
  misc_feature (364)..(364): n is a, c, g, or t
tcagacagtatatacacgaccggtgctcgatttagctgcgtcacgatctctcttgggatcacataacaaccacactcctcctctaaagaagcccctggagcacagctcatcaccatggactggacctggcggttcctctttgtggtggcagcagctacaggtgtccagtcccgaggtgcagctggtgcagtcgtggggctgaggtgaagacgccgtcgggtcccgtcggtgacggtctccgtgcaaggtcttgtggacggtcctacctttcttcagtctattcgttctttttagtttgggtcgtcggaccgaccggtccccgtaggaacgtaagggtcttggaggtggcggttggggaagggtntaccgtacttcccttatttcggtttggtcgtactacgtacgtaagttccgactaacgtagttaacgtttacgaaggtaacacggtacgtcctaacccgtacggttaacccggacgggtaacgtaaaccgtacccgtaacgaacgtaccaaccggtacccttaacgtacggtagggactccgtacgggaacgaccgacgggtccgtaggaacgtaacttcgtaacggaacgtaaccgaccggtcttaaacttccttagtttccgtaggttcggaccggtacgtaccccgttcccttaccgttacccgtttaatttacctacgtttcccgttaccccg

SEQ ID NO: 291558 - DNA, 644 bp, Homo sapiens
  misc_feature: GYAE6OF01CDKDC.44.36.D03.1.454.CMB.1.raw
  modified_base (193)..(193): a, c, t, g, unknown or other
  misc_feature (193)..(193): n is a, c, g, or t
  modified_base (207)..(207): a, c, t, g, unknown or other
  misc_feature (207)..(207): n is a, c, g, or t
  modified_base (440)..(440): a, c, t, g, unknown or other
  misc_feature (440)..(440): n is a, c, g, or t
  modified_base (510)..(510): a, c, t, g, unknown or other
  misc_feature (510)..(510): n is a, c, g, or t
tcagacagtatatacacgaccggtgctcgatttagctgcgtcacgatctctcttggggagctctgagagcggagccccagccccagaacttcccaggttgttttcatttggtgatcagcactgaacacagaggactcaccatggagttcgggctgagtcgttgggtttttcttgtttgtttattttacaggtntcagagtgaagtgngagttgggtggaggtccgggggagtacgttggtccgagccgttgggacgggtccctggacgactcgtccgtgtcgtcgcctgtgtacttcacatcagtacgacctattatagtcggtacgtcggggtccgaccgaggtccgtccgggaaggggaacggggtcgtggggtaggtcgggtcgttcgggaccgaacgtaaaacgtaaaaaacgtaggttacgactagttactttanacacgtacgagtcgcgtcgtgtagtagaacgcagtactcctaccactacagatactacgtactacgaacncttatattgtactttcgtagaacgttacaaccgtaaccttaacggtaaccgaaacggagaaccggacggtatagttacgttttagttagtttggttagtttgttagtttaatgtaagtagtacgttcgtaccgg

SEQ ID NO: 291559 - DNA, 726 bp, Homo sapiens
  misc_feature: GYAE6OF01BNMAH.44.36.D03.1.454.CMB.1.raw
tcagacagtatatacacgaccggtgctcgatttagctgcgtcacgatctctcttgggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtctgggggagagcggcccagcctgggaactccctgagactctcctgtgcagcctcgtggattcattcttcgaggacctatcgccatcgctacgtcgggtcccgcacgggcctaccgaggcgaaggggtctgggaggtgggtgactaaagttatatcgaagaagtacgtaggaaattaggaaaacggtaaactaaccggtaacgggaacgaaccgttaccgggaaacgggaaaccgggggtacccgtaagtttaccccgaaccccgggttccctaaccgaaacggtaaacggtaaacctaaacgtttaccccgaaacgggaaaccctaaccgaacgttacgacctaacgtacctacggaaccaaaagttaccgtaaacccgtaaaccctacgaaacgtaaaggtcggaaaccgggaccgtaaccggtacgttacggttacttaaaggtttcgtttaggtgaaccggtaacggtaccccgtccccccggttaacgggaacccgggtccccggttacccccgg

SEQ ID NO: 291560 - DNA, 783 bp, Homo sapiens
  misc_feature: GYAE6OF01A2XX3.44.36.D03.1.454.CMB.1.raw
  modified_base (432)..(432): a, c, t, g, unknown or other
  misc_feature (432)..(432): n is a, c, g, or t
  modified_base (589)..(589): a, c, t, g, unknown or other
  misc_feature (589)..(589): n is a, c, g, or t
tcagacagtatatacacgaccggtgctcgatttagctgcgtcacgatctctcttggggagctctgagagcggagccccagccccagaattcccaggttgttttcatttggtgatcagcactgaacacagaggactcaccatggagttcgggctgagtcgttgggtttttccttgtttgtttattttacgaaggtgtccagtagtgaagtgctagttgggtggaggtccgggggagtacgttggtccagtccgtgggacgggtccctggagtactccgtccgtggtcgtccgcctcgtggacttccaccatcagtacgaccctatatagtggtaccgtcgggccgccgaggtcccgtaccggaggggagggcgtgggacggtggtcgttcggccgaacgaaaaggtaaaaacgtaagttcgactagtacttanacagagtacgtaccgccgtacgtcttaggacgaaccgaccgtaagtacctttacccgacccttactaacgaaagacttagttaaccggtaacctttaaaggaaaccgtaccttagttaacgtttacgtacgtttaccgtaaggacccgttttaaaanaccgttaacccgttaaaacccggtaaacgggaaaaaccccggtagggacccggtaaacgggtacgtttaaacggtttaggtttaaaccgttttgggttttaaccggttttggggttttaacttttaaacggttttttaaactaacccggttaacggaaacgggtttaaacccttcccgggttaaaaccccgggg

SEQ ID NO: 291561 - DNA, 693 bp, Homo sapiens
  misc_feature: GYAE6OF01CN0FQ.44.36.D03.1.454.CMB.1.raw
  modified_base (219)..(219): a, c, t, g, unknown or other
  misc_feature (219)..(219): n is a, c, g, or t
tcagacagtatatacacgaccggtgctcgatttagctgcgtcacgatctctcttggggagctctgagagcggagccccagccccagaattcccaggttgttttcatttggtgatcagcactgaacacagaggactcaccatggagttcgggctgagtcgttgggtttttccttgtttgtttattttacaggtgtccagagtgaagtgcgtaggttgggnggacggtccgggggatacgttggccaggtccgtgggacggttccctaggacgactcttcctgtcgtccgccttcgtggtacttccaccatcgagtcgacctactatagtcggacgtcgggtccgccgaggccgtccggaaggggacgggcgtgggagtgggcgttggccgaagtaaacgtaaaaacgtaaggtcgacctagtctttacgcacgtagtacggtacgccgtcgtacgtgtaacgaaacgtcccgaaggttacccttacccgaaccctcttaaaccgaaggtactagttaacgtaccttaacgaacgtaactctaatttgtatttctaggtaacctaataccgtaaacgtaaccgtaacgaaaaccggaggacccgacgggtataacgtttagttaagtttagtttcgggtttgtttaggttttacgttttaagtaacttacggtaaggtaccgttacggtacccgg

SEQ ID NO: 291562 - DNA, 858 bp, Homo sapiens
  misc_feature: GYAE6OF01A9IBZ.44.36.D03.1.454.CMB.1.raw
  modified_base (731)..(731): a, c, t, g, unknown or other
  misc_feature (731)..(731): n is a, c, g, or t
tcagacagtatatacacgaccggtgctcgatttagctgcgtcacgatctctcttggggagctctgagagcggagccccagccccagaattcccaggttgttttcatttggtgatcagcactgaacacagaggactcaccatggagttcgggctgagtcttgggttttccttgttgtttattttacaaggttgtccagtagtgaagtgcgtagttgggtggaggttccgggggagtacgttcggtccacggccgtgggacgggttcccctagacgtactctccgttgtgtccgcttcgtggtattccaccatcagtcgacctactatacgtaggacgtcgggtcccgcgaagggtcccttaccgggaagggggaacgggggtcttagggggacggttcggggtaccgtttacggggaccccgtaaacggtaaaaacggtaaaaaaaaaccgtaaagggtttccggaacccgtaaacggtttaccctttttaaacgaccgaaacggtaacggtaaacggttaacccgggacccggttcgtttaacgttacgggtaacgaaaaccggtcccaaggtttaaacccttccccgaaaccccgttcgttaaacgaaaggtacgtattaaccggtaactttaaacgaacgttaaccttgtaacgtttcgtaacgttccgttaacgaacgttaaccgtaacgtaaaacccgttaacccggtaaacggaaaaaaccccggnggggtaacccgaaaccgggtaacttaaggtttaacgtttaaccggttttattttagggtttcggttttaacggttagtttttaactacgttaacgggtaaaggttacccgttaccgggtaaccccgg

SEQ ID NO: 291563 - DNA, 586 bp, Homo sapiens
  misc_feature: GYAE6OF01CZWP4.44.36.D03.1.454.CMB.1.raw
  modified_base (395)..(395): a, c, t, g, unknown or other
  misc_feature (395)..(395): n is a, c, g, or t
  modified_base (463)..(463): a, c, t, g, unknown or other
  misc_feature (463)..(463): n is a, c, g, or t
tcagacagtatatacacgaccggtgctcgatttagctgcgtcacgatctctcttgggggggagacgagcccagcactggaagtcgccggtgtttccattcggtgatcatcactgaacacagaggactcaccatggactttgggctgagattgggttttcctcgttgcttcttttaagaggtggccagtgtcaggtgcagctagtggagtcgtgggggagagcggcccagcctgggaacctccctgagactctcctgtgcagcctctggattcatcttacaggacctatgccatcgctacgtcgggtccgccgaggcctccgaggcgaaggggctgggacggtgggtgactaagttatatcgaagaagagtaggaattgaaagaacacgtacgganaccgtaccggaggaacgggccgtattccacccgtctaccgagacgactaacttaccgagacacactcnctactctagactaatacgtaaccaacctacacgaagtacggacgaccgacgtcgtcgttacttagtttacgtgtacgaccggacgtacccgtaccccgtacggtaccggtcccggtaccccgg

SEQ ID NO: 291564 - DNA, 769 bp, Homo sapiens
  misc_feature: GYAE6OF01D5HAI.44.36.D03.1.454.CMB.1.raw
  modified_base (195)..(195): a, c, t, g, unknown or other
  misc_feature (195)..(195): n is a, c, g, or t
tcagacagtatatacacgaccggtgctcgatttagctgcgtcacgatctctcttgggggggagacgagcccagcactggaagtcgccggtgtttccattcggtgatcatcactgaacacagaggactcaccatggactttgggctgagatgggttttcctcgttgcttcttttaagaggtggccagtgtcaggtncagctagtggagtcgtgggggagagccggcccagcctagggaacctcccgtgacgactctcctgtgcagcctctggattcattccttcgacggtacctatcgcctagtcgcctacggtcggggtccccacgaggccctaccgagggacggaaagggggtcgttaggggagggttggggtacggtactaaagtttaagtacgtaacgaaaggtaaagtagtaagggtaaattagggaaaacgtaacgtaaaccgtaacgggaacgtaccgtaccggaagggtaacgggaccgtacgttacccgaacccgttccgtaccgtaaggtaacgtaaaccgtaacgttaacccggaaacggtaaaccctaaccgtaaccgttcgaaccgtactaccgtaacggtaaacctaaacgttacgtaaacccgtaaaccctaacaaaccggtaaaggtacggaaacgggtaacccgtaaccggtaccgttacggttacctttaaaggtttacggtttacggtaccgtacggtaaccgtacccccggtacccccggtacgaccgggtacccccgggttacccccgg

SEQ ID NO: 291565 - DNA, 526 bp, Homo sapiens
  misc_feature: GYAE6OF01CXBGO.44.36.D03.1.454.CMB.1.raw
  modified_base (454)..(454): a, c, t, g, unknown or other
  misc_feature (454)..(454): n is a, c, g, or t
tcagacagtatatacacgaccggtgctcgatttagctgcgtcacgatctctcttggggatcacataacaaccacactcctcctctaaagaagcccctgggagcacagctcatcaccatggactggacctggcggttcctctttgtggtggcagcagctacaggtgtccagtcccaggtgcagctggtgcagtctggggctgaggtgaagaagccgtgggtcctcggtgaaggtctcctgcaaggcttctggaggcacctttcttcagctatgtcttttagttgggtgcgacaggccctggacaagggcttgagtggcgtgggaggatcactccctattcgtttggtcgcagtacgtaattacgctacgagtaagtttcaggacagacgtcacctattaccgacggacaactcgaacgacgtacacgacctacagtggagctgacgcaggctagngatcgtagacgacacgacatcttacttcgtgtgcgacgacgtccttcgtactacgttttacagttcgtaccc

SEQ ID NO: 291566 - DNA, 747 bp, Homo sapiens
  misc_feature: GYAE6OF01B0T4K.44.36.D03.1.454.CMB.1.raw
  modified_base (708)..(708): a, c, t, g, unknown or other
  misc_feature (708)..(708): n is a, c, g, or t
tcagacagtatatacacgaccggtgctcgatttagctgcgtcacgatctctcttggggagctctgagagcggagccccagcccccagaattcccaggtgttttcatttggtgatcagcactgaacacagaggactcaccatggagttcgggctgagcgttgggttttccttgttgtttattttacaaggtgtcagagtgaagtgcgaggttgggtggaggtccgggggagtacgttggtcccgagcccgtgggacggggttcccctggacgtaccgttcctccgttggttcgtccgccgttcgtggtactttccaccctatacgtagtcgaacccctactatagtcgggtacgttcggggtcccgccgacgggtcccgtccggaggggggaacggggtccggtagggtaggttccgggtcggttcggggaccccgtaacgtaaaacggttaaaaaaaccgtaaaggtttcggacctaagtaccgttttaacaccgtacgaagtacggtaccggccgtcgtcgtcgtagaaaccgtccagtaccttcccaacccgttcacgaaagagtacttacgaccttacgtaacgtactactaagtgtactttacgtacgacgtaataccggtaaccctaaaccggtaacgggaaaacccggtggaaaccgtacgggacttgttaagtttaatttaggtttcgttgtttaggtttnttttaaacgtacgtacggtacggtacttcggttacccgg

SEQ ID NO: 291567 - DNA, 729 bp, Homo sapiens
  misc_feature: GYAE6OF01ANFIR.44.36.D03.1.454.CMB.1.raw
  modified_base (272)..(272): a, c, t, g, unknown or other
  misc_feature (272)..(272): n is a, c, g, or t
  modified_base (713)..(713): a, c, t, g, unknown or other
  misc_feature (713)..(713): n is a, c, g, or t
tcagacagtatatacacgaccggtgctcgatttagctgcgtcacgatctctcttggggatcacataacaaccacactcctcctctaaagaagcccctgggagcacagctcatcaccatggactggacctggcggttcctctttgtggtggcagcagctacaggtgtccagtcccagggtgcagctggtgcgagtcgtggggctggaggtgaagacgctgggtcctcggtagaggtctccgtgcgaaggtcttcgtgggacggtcaccctttntcgagtctattgtctttttagttgggcgcgtacgaccggcccgtaggaactagggtctttaggacggtgggcgttaggggacggtattcacgttcccgttagttcgtttagggtcaccgtaagttacggtaaactttaccggaccgtaaacgtaacggttaaacggttttcgaaacggggtactaacggggtactaccgtaacccgtaacgtttaccccgggacggtaaaccggtaaacctacccggtaaaccggtaacgtaaccgaaccggttaacccgtaacgtacggtacgggtaaccgtcggttacgggacgggtacgaacgggttgaacgggtaacgtaccggttacgaaggaaccggtacgaccggtctaaaccgtttactacggttttcgaggttacgacggtaacgcccgttacctacgtactttaaccgttncgtttaacccgttccc

SEQ ID NO: 291568 - DNA, 781 bp, Homo sapiens
  misc_feature: GYAE6OF01DK64T.44.36.D03.1.454.CMB.1.raw
  modified_base (163)..(163): a, c, t, g, unknown or other
  misc_feature (163)..(163): n is a, c, g, or t
  modified_base (180)..(180): a, c, t, g, unknown or other
  misc_feature (180)..(180): n is a, c, g, or t
  modified_base (291)..(291): a, c, t, g, unknown or other
  misc_feature (291)..(291): n is a, c, g, or t
  modified_base (315)..(315): a, c, t, g, unknown or other
  misc_feature (315)..(315): n is a, c, g, or t
tcagacagtatatacacgaccggtgctcgatttagctgcgtcacgatctctcgttgggggggagacgagcccagcactggaagtcgccggtgtttccattcggtgatcatcactgaacacagaggactcaccatgggactttgggctgagattgggttttccncgttgcttcttttaagnggtggccagtgtcaggtgcagctagtggagtcgtgggggagagccggcccagccgtgggaacctccctgagactctctgtcgcagcctctggattcattcttcaggacctntcgccagtcgcacgttcgggtccnccgaaggcctaccgaggcgaaggggctaggggaggttggggcgtacctaaagtttaagtacgtacgaaggaaacgtagtagggaaatttaggaaaacggtaaacaccggttaacggggaataacccgtaaccggaacgggtaacggggacccgtaacgttaccgaaccccggttaccctaccgtaaggaaccgtaaccgtaaaccgttaccggaaacgggaaacctaacccgaacgttacggtacctaacggtacccttaacggtaaaccgtaaacttaaccggttaaaccctaaacccgttaacaaaccgtaacgggtaaaccggaaacgggtaaccggaaccgggttaccgttaggtttaacctttaacggtttaaacgttcggttaacggaacccggtaaccggtaacccggacccccccggttacgggtaaaccccgggtccccgggtttaacccccccggg

SEQ ID NO: 291569 - DNA, 712 bp, Homo sapiens
  misc_feature: GYAE6OF01DBG0D.44.36.D03.1.454.CMB.1.raw
tcagacagtatatacacgaccggtgctcgatttagctgcgtcacgatctctcttggggagctctgagagcggagccccagccccagaattcccaggttgttttcatttggtgatcagcactgaacacagaggactcaccatggagttcgggctgagctgggttttccttgttgtttattttacaaggtgtccagagtgaagtgcagttgggtggaggtccgggggagtacgttggtccagccgtggagggtccctgagactctcctgtgtcgcctctggacttcaccatcagtcgaccactatagtggacgtcgggtccgccaggcctccgaggggaagggcgtgggagtcggcgttgggaccgacgtaaaggtaaaaaaacctaaaggttcgaccctaaggttcctttaagaccaacgtaaggtaacggttaacccggcccggtaccggttccgtaggttacgaaaacggtcccctaaaggtacctttaccccgaacccttactacgaaagacgtaatcgtaactttacgaaagtaactctaatttgactttacctagtaccgtaattacggtaaaccttaaaccgtacggaaaaaacccggtcgggaaaccgaccggggtactaaaggttacgtttaagtttacgtttgggttagttttagtttagtttttaactacgttaccgtaaacgggtacgttccggtaaacccg

SEQ ID NO: 291570 - DNA, 732 bp, Homo sapiens
  misc_feature: GYAE6OF01BWQDL.44.36.D03.1.454.CMB.1.raw
tcagacagtatatacacgaccggtgctcgatttagctgcgtcacgatctctcttggggatcacataacaaccacactcctcctctaaagaagcccctgggagcacagctcatcaccatggactggacctggcggttcctctttgtggtggcagcagctacaggtgtaccacgtcccaggtgcagcgtggtgcgagtcgtggggctggaggtagaagaacgtccgtgggtccgtcgggtaggtaacggtcctccgtgacgtaacggtccttcggtgggaacgtcctaccgtttctcgagtctagttgttcttttaggttggcgtcgacgacggcccgtaggaacggaggtctaggacggtggtcggtagggaggtctacctacttccgttattcggttggtcactacgtacgtaacgttaccgactaacgtaaagttacggttacgacgggtactaggtaacctaccgtaccgtaacggttaacccggacggtaaccgtaaccgttaccgaaacgtacggtaacctaaccggtacctaagtacggtcgtacggcgtacgggacgtacgtacggtcgtaaggtaccgtagttaccggaagaacccggacgtacccgggtacttaaacgtttccgtttacgtttaacggttcgggtacggaacccggtacggttaaccccgttccccttaaacggtacccttttaacgtttaccgtaaccggtttacccgttccc

SEQ ID NO: 291571 - DNA, 770 bp, Homo sapiens
  misc_feature: GYAE6OF01EZUNP.44.36.D03.1.454.CMB.1.raw
tcagacagtatatacacgaccggtgctcgatttagctgcgtcacgatctctcgttgggggggagacgagcccagcactggaagtcgccggtgtttccattcggtgatcatcactgaacacagaggactcaccatggactttgggctgagagttgggttttcctcgttgcttcgttttaaggaggtggccagtgtcgaggtgcagcgtaggtggagtcggtgggggaggacgccggcccaggccgtagggaacctcccgtagacgtaccttccgtccgtggtcgccaggtccttcggtggtacttccgattccgttacgaacggtacctagtccgtacccagtcggaccgtccggtccggggtcccgaccggacggtcctaccggaggcgggaacggggtcgtaggggtaggtgggtacgtactaaagttactaagacgaaggaagtagtaggaattagaaacgtaacgacgtaacggacaccgtacggaagggaacggtacgtacgttacccggacgtaccgtacgaacggaacgtaaccgtaacgttaaccggaaacgaacctaaccgtacgtacgtaccgtaacgtccgtaacgaaccgtaaagttaccgtaaaccctaaaccgttaccgaaacgtacgggtacggtaacccggaccggtaaccggttacgtttacgtttaacgtttaggtttacgtaggttaccgaacccgggtaccggacccccggttaccccctacggggtaccccgggtccgggttacccccgg

SEQ ID NO: 291572 - DNA, 693 bp, Homo sapiens
  misc_feature: GYAE6OF01B4TPT.44.36.D03.1.454.CMB.1.raw
tcagacagtatatacacgaccggtgctcgatttagctgcgtcacgatctctcttggggatcacataacaaccacactcctcctctaaagaagcccctgggagcacagctcatcaccatggactggacctggcggttcctctttgtggtggcagcagctacaggtgtccagtcccaggtgcagctggtgcagtctggggctggaggtgaagaacgccgtgggtcctcggtgaacggtcctccgtgcaaggccttcgtggaggcctaccgtttcttcgagtctatcgtctttttagttgggtgcgacgacggtccccgtggacgtaagggtcgttggacgtgggcgtggggaggactcgacttcccgtagttccgtttggtcgctacgtacgtaacttaccgctaacgaaggttaacgtttacgaagggtaccaagggtacgtacccgaaacccgttaaggttacccccgggacggtaaacccgtaacgtccccgaaacggtaaccgtaaccacggtacccgtacgaaggtacggacgtaccgtaggacggcgtaggaccgtgggtaacgtctacggtaaggaaccgacggacccgggtacctagttacctttacgttccgttagggtaccgacgggtacgtacccgtcccctttacggtaacccttacctttacctaacgttcccgttaccccg

SEQ ID NO: 291573 - DNA, 647 bp, Homo sapiens
  misc_feature: GYAE6OF01COES9.44.36.D03.1.454.CMB.1.raw
  modified_base (308)..(308): a, c, t, g, unknown or other
  misc_feature (308)..(308): n is a, c, g, or t
  modified_base (315)..(315): a, c, t, g, unknown or other
  misc_feature (315)..(315): n is a, c, g, or t
  modified_base (453)..(453): a, c, t, g, unknown or other
  misc_feature (453)..(453): n is a, c, g, or t
tcagacagtatatacacgaccggtgctcgatttagctgcgtcacgatctctcttggggagctctgagagcggagccccagccccagaattcccaggtgtttcatttggtgatcagcactgaacacagaggactcaccatggagttcgggctgagcgtgggttttcctgttgttatttacaggtgtccagagtgaagtgcagttggtggagtccggggagacgttggtccagccgtgggagggtccctgacgctctcctgtgtcgcctgtgattcaccatcagtcgaccatatagtggactcgggtccncaggtcnccgaggggaacgggctgggagtggcttcggggccacgaaagttaaaaaaaccgaaggttcgacccgaggtaccttttaagacacgaaggaggtacccgcgtacgttctgtacgaaagcccgatacttcccaacccttnacgtaagataagtgtaacttacaaaggtaccctataagttactattccctaggtaccgtaattaaggaaacccttaaaccgacgggaaaaaacccgcggaaacgaccggggtactaagtcggtttaaataggttttcggtagttttaggagtttttaaccgattaacccggaaaggtaccgttgtacccccggg

SEQ ID NO: 291574 - DNA, 720 bp, Homo sapiens
  misc_feature: GYAE6OF01AMF8A.44.36.D03.1.454.CMB.1.raw
tcagacagtatatacacgaccggtgctcgatttagctgcgtcacgatctctcttggggatcacataacaaccacactcctcctctaaagaagcccctgggagcacagctcatcaccatggactggacctggcggttcctctttgtggtggcagcagctacaggtgtccagtcccaggtgcagctggtgcagtcgtggggctggaggtagaagagccgtgggtcctcgggtgaacggtctccgtgcgaaggtcttcgtggacggtcctacctttcttcagtccttagttcgttcgtttttaggtttggggtcggtccggtaacgaccggtccccgtagggaacgtaacgggtcgttggacgggtgggcggttaggggaggtactcgtacttcccgtagtttcggtttacggtcgtactacgtacgtaacgttacgactaacgtaagttaaacggttcgaacggtacgtaacgggtactaccgaaccgtaacggtacccggaagggtaacccgtaactacccggaacggtacgtaacccgacgtaacctacgtagtcgggaacgtccgtaagggacgcggtagggtacacggtacgtaacgttaccgtaaggaaacgtaccgtaccggactttaatccgtttaacgttcggtaggtaccggacggtaaccgtccccttacccgttaggttaaccctacctttcgtaacttccccgttacccg

SEQ ID NO: 291575 - DNA, 924 bp, Homo sapiens
  misc_feature: GYAE6OF01AGWW7.44.36.D03.1.454.CMB.1.raw
tcagacagtatatacacgaccggtgctcgatttagctgcgtcacgatctctcgttgggggggagacgagcccagcactggaagtcgccggtgtttccattcggtgatcatcactgaacacagaggactcaccagtggactttgggctggagtagttcgggttttcctcggttgcttacgtttttaaggagggttcggcctaggttgtcgagggttgacaggtcgttaggtgggaggttcggtagggggggagtacggccgggcccgaggtcccggtacgggaaccttcccggtagacggtaccttccttccgtggtcgcctacggtccttcgtaggtacttccgtacttccgttacgacggtacctacgtccgactaggtcggaccgtaccggtccgggtacccgccgtacgggtacctaccgggtaagggaccgggtaacggggtcgtacgggggtacggtggggtacggtaacgttaacttagtaacgtaaccgaaggtaaacgtaggttaagggtaagttaaacggaaacgaacccggtaaacggttaacggggaaccgttaacccggtaccgggtaaacgggtaaccggggttacccgttaacggttacccgtaaccccggtaccgtaacccgggaaacggaacgttaaaccgtaaccggttaacccgaaacgggtaaacctaccggaacgttaccggtaacctaacggttaccgtaaccggtaaacttaaaccgggttaaccgttaaaccctaacccggtaaacgtaaccggtaaacggggttaaccggaaaccgggtaccggtaaaccggttcgtttaccgttaacgtttacgttaagttacgggacgtacccgggtaaccccggtacccggtacccccggtaaccggggttacccgggtaaccccggttaccccggg

SEQ ID NO: 291576 - DNA, 707 bp, Homo sapiens
  misc_feature: GYAE6OF01AV3TA.44.36.D03.1.454.CMB.1.raw
tcagacagtatatacacgaccggtgctcgatttagctgcgtcacgatctctcgttgggggggagacgagcccagcactggaagtcgccggtgtttccattcggtgatcatcactgaacacagaggactcaccatggactttgggctgagatgggttttcctcgttgcttcttttaagaggtggccagtgtcaggtgcagctagtggagtcgtgggggagagcggcccagcctgggaactccctgagactctcctgtgcagcctctggattcatcttcgaggacctatcgccagtcgccacgtcggggtcccgaccgaggccctccgagggccgaaaggggggtcctggggagttcggggtggaacctaattataagtcgaagtaaagagtaggtaatttacgaaagaaacctacgtaacggacgtaccgtaccggaaggaacgggtaccgacgttaccacccggtacctaccgaagtaacgaacctaacttacccgaaacggtaaaccaaccgtaaccgtcgacctaacttaccgtacgaaccgtaaacttaccgtaaacctaaaccctaccaaccgtaaacggtaacggaaccggaaccgaaccgggtaccgttacgtttaccgttaagtttacgtttaggtacgtacccggtaacgtaccccggtaccccccgtacggtacccggtaccccgggttaccccccgg

SEQ ID NO: 291577 - DNA, 654 bp, Homo sapiens
  misc_feature: GYAE6OF01A6XLV.44.36.D03.1.454.CMB.1.raw
  modified_base (225)..(225): a, c, t, g, unknown or other
  misc_feature (225)..(225): n is a, c, g, or t
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttgggtggaggtccggggganacttggtccagcctgggagggtccctgagactctcctgtgtcgcctctggattcaccatcagtcgaccactatagtggactcggggtccgccgaggcctccggaaggggaaggggctgggagtggcttggccgacaagtaaaaacgaagttcgaccagtctttatcgaacagtacgtacgccgtcgtctggtagaaacgccagtacttcccaacccttctacgaacgagtactacgtaccttacgaaacgtactactatttaggactttcgtacggacgtaaagtcgtaaacccgttaaccgtaacgaaaacccggagggtaacccgacggggtactaaggttacggtttaagtttacggtttggttacggtttagtttacggtttttaactaacgttaccggtaaaggtaacccgttggtaaccccgg

SEQ ID NO: 291578 - DNA, 943 bp, Homo sapiens
  misc_feature: GYAE6OF01C5EVF.44.36.D03.1.454.CMB.1.raw
  modified_base (65)..(65): a, c, t, g, unknown or other
  misc_feature (65)..(65): n is a, c, g, or t
tcagacagtatatacacgaccggtgctcgatttagctgcgtcacgatctctcggttggggggganacgagcccagcactggaagtcgccggtgttccattcggtgatcatcactgaaccacagaggactcgaccatgggtactttgggctggaagtagttcggggtttttcctcggtttgcctttacgtttttaaaggacgggttcgggccctaaggttggttacctaaggggttcgaccgtacggtacgttaagggttggggaacggttcccgggttaggggggggaacggacgggtcccgggaccccgaacggtccccggttacggggaaacccttccccggttaggaacggtacccttccgttccgtaggtcggacctaaccggtcccgttccggtaacggttacttaccctaactttcctttaccggaacggtacctttaacgccggtaccctaaggtccgtaccgtaccggttccggggtaccccgacccgtaccggtacccgtacccgggaacgggacccgggtaaagggggtccgtacggggtagggtcgggtacggtactaaagtttagtaacgtacggaaaggtaagtaggttaaggtaaacgttacggaaaacgtaaaccgtaacggtaaaccgggtacgtaaccggaaccgggtaacgggaacccgggtaccgttaacgtaccccgtacccggtacgtaaccgaagtaaccgtaaccgttaaccgtacccggaaacgtaccctaaccgtacgtaccgctaaccgttagtaaccggaacttaaacgtccgtaaacccttacccgtaacgtaaccggaaggtaaccggtacggggacctaaccggtacgttaccgttattacgttacggtcggtaccgacggtccccgtaaccccgttccccggtaacggtccccggttccccggttaccccgg

SEQ ID NO: 291579 - DNA, 782 bp, Homo sapiens
  misc_feature: GYAE6OF01D7R1E.44.36.D03.1.454.CMB.1.raw
  modified_base (178)..(178): a, c, t, g, unknown or other
  misc_feature (178)..(178): n is a, c, g, or t
tcagacagtatatacacgaccggtgctcgatttagctgcgtcacgatctctcttggggatcacataacaaccacactcctcctctaaagaagcccctggagcacagctcatcaccatggactggacctggcggttcctctttgtggtggcagcagctacaggtgtccagtcccaggtncagctggtgcagtcgtggggctggaggtgaagacgccgtcgggtcctcgggtagaacggtctccgtggtacgaacggtcttcgtaggacggtcctacccttcgttacgacgtacttagttcgttaccgtttttaggttcggggtcgaccggtaccggtaccgggtacccccgtagggaccggtaacggggtcgtttagggagggttcgggtcggtagggggtaacgggtaacctccgtacctttcccgttagtttccggtttaggtcgtacgtacgtttaacggtaacttaccggtactaacgtaacggttaacggtttacgaacggtaacgaacggtaaccgtaccgtaacccgtaacggtttacccggaccggtaaacgtaccgtaccgaacggtacgtacgacgtacccgtagagttcggacgtacgacggagccgtaaggtcgtaaggtagtaccgtacgtaacggaaccggtacccgtacggttaaccctagttaccgtttacgttttaccggtgggtaccggtacgtaacccggtacccgttaccccgtttacgtaaacccgttttaccgtttcgtaaacccgtttcccttaaccccg

SEQ ID NO: 291580 - DNA, 801 bp, Homo sapiens
  misc_feature: GYAE6OF01CFILV.44.36.D03.1.454.CMB.1.raw
  modified_base (770)..(770): a, c, t, g, unknown or other
  misc_feature (770)..(770): n is a, c, g, or t
tcagacagtatatacacgaccggtgctcgatttagctgcgtcacgatctctcgttgggggactcctgtgccccaccatggacactctttgctacacactcctgctgctcgaccctaccccttccgtgggtcttgtcccaggtcacttgaaggagtctggtctgtgcgtggtacaacccacagacgaccctcacgctgacctgcaccatctcgttggttcctctactacaacgtattaataaggtaggtgggtgtgagcgtggctccgtcgaccggaccccggaagggacggccgtaggacggttgcgttcgacactatacttcttaccgtacgtaaacgtaacggaaaaccgtaaaaccgtaccgtaactacgttaactacgtaccgttaccgtaaggaaacgtaccggttaacttaaaccgtttaaacctaccgtaccctaacccggaaacgaaacccttaacccgaaaccggaaacggtacggtaacggttagtttaacgtttaagttaacgtaaccgaaccctaaacgtacggtaacccggacgttaccgggaccggtaacaaccggacgtacctaaagttaactttacgtttaacgtcggtaacggtaacgggtaacggttaaggtaaccgggaaaacgggaaagtaaccgtacggttcggtttaacggtttacgtttaggttaaactttaacggttaacgttccttaaacgtcgtccgggttacggtacggttacgggaaccggggtaacgaaccggggtaaccncgggttaccctacccggttccctccgtaacg

SEQ ID NO: 291581 - DNA, 747 bp, Homo sapiens
  misc_feature: GYAE6OF01E3VRG.44.36.D03.1.454.CMB.1.raw
  modified_base (375)..(375): a, c, t, g, unknown or other
  misc_feature (375)..(375): n is a, c, g, or t
  modified_base (491)..(491): a, c, t, g, unknown or other
  misc_feature (491)..(491): n is a, c, g, or t
  modified_base (559)..(559): a, c, t, g, unknown or other
  misc_feature (559)..(559): n is a, c, g, or t
tcagacagtatatacacgaccggtgctcgatttagctgcgtcacgatctctcttggggagctctgagagcggagccccagccccagaattcccaggttgttttcatttggtgatcagcactgaacacagaggactcaccatggagttcgggctgagtcgttgggtttttccttgtttgtttattttacgaaggttcgtaccagtagtagaagtgcgtaggttgggtaggaggtccgggggatacgtttggcctagtccgtgggacggggtccctggacgtacctcctccgtggtcgtccgccttcgtaggtacttaccacctattcacggttacgacccctaattaacgtagtacgggaccgttcggggtacccnccggtagggtcccgtaccgggaaggggggaacgggtccgtaggggtacggttcgggccgttacgggaccgtaaacgtaaaacgtaaaaacgtaggttccgacctagttacctttanaccgaacgtaggtacggtccgccggttacgtctaggtagaaaccgtcctaagttccttacccaccctnaacgtaagacgtacgtacgtaactacgtaaacgtacctacgttaattcggttacttacgacggaacttaagtacgtaacccgtaacggtaaacggaaaccggacggtaccggagtacctagtttagttaacgttttgttggttgttagtttagttactacttaggtaaccgttagtcccggtaacggg

SEQ ID NO: 291582 - DNA, 854 bp, Homo sapiens
  misc_feature: GYAE6OF01C7X0T.44.36.D03.1.454.CMB.1.raw
  modified_base (166)..(166): a, c, t, g, unknown or other
  misc_feature (166)..(166): n is a, c, g, or t
  modified_base (190)..(190): a, c, t, g, unknown or other
  misc_feature (190)..(190): n is a, c, g, or t
tcagacagtatatacacgaccggtgctcgatttagctgcgtcacgagtctctcttggggatcacataacaaccacactcctcctactaaagaacgcccctgggagcacagctcatcacatggactggacctggcggttctctttgtggtgcagcagctacgaggtntccagtcccaggtgcagcgtggtnctagtcgtgggctgaggtgaaacgacgtccgtgggtccctcgggtagtaacggttcctaccgtggacgtaacgggtctttacggtgggaacggtcctaccgtttcttcaagccttagttcgtttacgttttagttcgggtcgtaccggacgtacgggtccccgtagggaaccgtaacgggtcctttaggacgggttcggtcggttaggggaacgggtactaccgtacgttaccccgtttaagtttccggtttaggggtacaccgttaacgttaccggttaaacgttaccggtaaccaacggtaacggttaaacgtttacgaaacgggtaaccacgggtaaccgttaccgtaaacccgttaacggtttaccccgggaaccgggtaaacctaaccgtaaccccggtaaggtaacccgtaacgtaccgggttaacccttaacggacgggtaccgggttaacgacggtttacggaaccgggtacgtaacgggtccgttaggtaaacggtaccttacggttaaccgggaacgtaacccgggtccggttaaccctaagttttcgttaactttacgggtaccggtttcgaaacccgggttacccggtacgttacccccgttaacggtttaacccgtaacgtttttaccacgttttacccccgggttacccc

SEQ ID NO: 291583 - DNA, 752 bp, Homo sapiens
  misc_feature: GYAE6OF01BMMQY.44.36.D03.1.454.CMB.1.raw
tcagacagtatatacacgaccggtgctcgatttagctgcgtcacgatctctcttggggatcacataacaaccacactcctcctctaaagaagccccgtgggagcacagctcatcaccatggactggacctggcggttcctctttgtggtggcagcagctacaggtgtccagtcccaggtcgcagcgtggtgcgaggtcgtggggactggaggtagaagacgtccgttcgggtccgtcggtagtacggtcctccgtgacgaacggtcttcgagggacggtcctaccttcgtacgacgtcgttagttcgtttcgtttttagttcggggtacgtaccggaccggtaccggtaccccgtagggaaccggtaagggttccttagggtacgggttcgggcggtaggggacggtactccgtacgttcccttagttccgtttagggtctacgtacgtacgtaacgttacggactaacgtaaggttaacggtttacgaacggtaacggtaacgttacctacccgtaaccgtaacggttacccggacggtaaacctaacgtaccccggaaggtaaccgtacaccgtaccgtaacggtaggttacggacgtccggtaagcggaaccgtaaggggtccgtaacgtacggtaccgttaggaacgaacgggtacccacggtactttacgtacgtttacgttcgaggccggtaacgcgtacccgtcccgttaggttaacccttaagttctaaccggttccctacccg

SEQ ID NO: 291584 - DNA, 744 bp, Homo sapiens
  misc_feature: GYAE6OF01C21QP.44.36.D03.1.454.CMB.1.raw
tcagacagtatatacacgaccggtgctcgatttagctgcgtcacgatctctcgttgggggggagacgagcccagcactggaagtcgccggtgtttccattcggtgatcatcactgaacacagaggactcaccatggactttgggctgagattgggttttcctcgttgtcttcgttttaagaggtggccagtgtcaggtgcagctaggtggagtcggtgggggaggagccggcccagccgtgggaacctcccgtaggacgtacctccgtccgtggtcgcctacgcccttcgtggtacttcctattccgttcgaacggtaacctgtcgcctagttcgacacgtcggggtcccaccggtacggtccgtaccggaacgggtaccgggaaacggggggtccgttagggggtagggtcggggtacggtaacgtttaaaacgtttagttaacgtaacgaaagggtaaagtagttaagggtaaactttagggaaaacgaaccgtacggtaacgggaacgtacgtaccgggaacggtacgggaccgtactacccgtaaccgtcgtaccgaagaccgactaacgtaccgaagaaccgaactcgtacgactacgtacgtacgaactaaagtccgtaaacccaaccttacgaaccgtaaggacgaacggacgtacggtctttacgtacttaagttacggttgtccggaacgaccggtacccgtccccgtacggtaacccggtcccggttcccccgg

SEQ ID NO: 291585 - DNA, 888 bp, Homo sapiens
  misc_feature: GYAE6OF01CGOFF.44.36.D03.1.454.CMB.1.raw
tcagacagtatatacacgaccggtgctcgatttagctgcgtcacgatctctcttggggagctctgagagcggacgccccagccccagaattcccaggttgttttcagtttggtgatcagcactgaacacagaggactcaccagtggaggttcgggctgagtcgttgggttttccttgtttgtttatttacgaaggtgtccgagagtagaagtgcgtaggttgggtagggacgggtcccgggggtaagtaccgtttcgggtccacggtccgttagggacggggttacccgtaggacgtaccgttccgtccgttggtcgttccgtcccgttcggtagtacttccaccgtatcgtaagtacgaacgtaaactagtaggtcggacgtcgggtacccgacgcggtccgacggagggggaggtcggtgggaggtcggcggttacggaccgtaagtaaaacgtaaaaactaacggttacgccgtaagttactttagtacgacgtaacggtaacggtacccgggtccggtacggttccgtaggtaacggaaacgtacccgtaagttaccttaccccgtaacccttacgtaacccgaaaggtaactaacggttaccgtaaaccgtttaaccgaaaacgttaacccgtaattaacgttttacgttaaccgtttacggttacggtaaccgttaaccgtaaccgttaaaccgttaaaccccggtaaaccgggaaaaacccgggtccggaaacccgggaaaccgggttaacttaaacgggttttacggttttaaaactttagggttttaccggttttaggtttttaccggtttaacggttttaaaccgttacggttaaaccgggtaaacccgggttaccgtttaacccgggggtaaccccg

SEQ ID NO: 291586 - DNA, 739 bp, Homo sapiens
  misc_feature: GYAE6OF01E4BVV.44.36.D03.1.454.CMB.1.raw
  modified_base (160)..(160): a, c, t, g, unknown or other
  misc_feature (160)..(160): n is a, c, g, or t
tcagacagtatatacacgaccggtgctcgatttagctgcgtcacgatctctcttgggggggagacgagcccagcactggaagtcgccggtgtttccattcggtgatcatcactgaacacagaggactcaccatggactttgggctgagatgggttttccncgttgcttcttttaagaggtggccagtgtcaggtgcagctagtggagtcgtgggggaggagcggcccagccgtgggaacctcccgtgacgaccttctcctgtgccagcctctggattcatcttcaggtaccctatcgccatcgcctacgtcgggtccgcccgaggcctaccgaggtcgaaggggctagggaggtggggtgactaagtttagtagtacgaaggaaagtagtaggaaactttaggaaacgtaaaccaacggttaacgggacgtaaccgtaccggaacgggaaacggggtcccgtaacgttaccgaaccccgttccgtaaccgacgtaaacgaaccttaaagtttacccggaaaggtaaacccaaccgtaaccgtaggtaccctaacgttcccgtaacggtaacctaaacgttaacgttaaacccaaacccgttaacccaaaccgtaacggtaggaaccgggacccggtaaccggttcgttacggttaccttaagtttacggttcggtacggaccggtaaccggtaccctaccccccgggtacccgaacccgggtaccccggttccccccgg

SEQ ID NO: 291587 - DNA, 716 bp, Homo sapiens
  misc_feature: GYAE6OF01E0KJ6.44.36.D03.1.454.CMB.1.raw
  modified_base (433)..(433): a, c, t, g, unknown or other
  misc_feature (433)..(433): n is a, c, g, or t
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtcttgggttttccttgtttgttattttacaaggtgtccagagtgaagttgcgtaggttggtgggaggtccggggggagtacgttggtccaggtccgtgggacgggtccctgagtactctcctgtcgtcgcctcgtggattccaccatcagtcgacctacttatagtggacgtcggggtcccgccgacggtcctccggaaggggaaggggtccgtagggaggttcgggcgttcgggccgtaacgtaaagtaaaaaacgtaagttcgaccgagtctttanacaacgagacgtacgcccggtacgtctgacgaaacgccgagtacttacccacccttactacgaaagacgtacttacgtaaccttacaaagtaacttctagtttacgaactttcgtaggtaaccgtaagtaccgtaaacccgttaaccgtaaccgggaaaacgtcgggaaccggtaacgggaccttaaggttacgtttaacgtttagtttcggtttaggttttacgttttaaggttttaagttaacgtttaccggaagggttaaaccgtttcggtaaaccccgg

SEQ ID NO: 291588 - DNA, 766 bp, Homo sapiens
  misc_feature: GYAE6OF01DH20K.44.36.D03.1.454.CMB.1.raw
  modified_base (210)..(210): a, c, t, g, unknown or other
  misc_feature (210)..(210): n is a, c, g, or t
  modified_base (220)..(220): a, c, t, g, unknown or other
  misc_feature (220)..(220): n is a, c, g, or t
tcagacagtatatacacgaccggtgctcgatttagctgcgtcacgatctctcgttggggagctctgagagcggagccccagccccagaattcccgaggttgttttcatttggtgatcagcactgaacagagaggactcaccagtggagttcggctgagcgttgggttttcttgttagttatttacgaaggtcgtcgaagagtagaagtgngtaggttggnggaggtcggggatacgttggccagtccgtaggacggtcctgagcctctcgtgtcgtcgtcctcgtggtactaccacctatccgtagtcgaacctataagtagtcggtaccggttcgggtcccgaccgacggtccgaccggaaggggtaacgggcggtgggtaggtcggtcggttacggaccggtaaacgtaaaacggtaaaaaacgtaacgttagacccgtagtacctttaagaccaagacggtaacgtaccggcggtcgtacgtaggtaacggaaacgcgtaacgttacctacccgaaccctcgaaccgttaaggaagtacgtagtaaacccgttaagaacgtaaaccttagttaagtacgttacgtaccgtaggtaaccgtaaacgtaccggttaaaaccttaaacccggaaacggggaaaaacccgagggtaaaacccggtaaccgggttaataacggttaagttagtttaggtttggtttaggtttaggttaacgttttaaccgtaattaaccggtaaaggttaacccgttcggtaacccgg

SEQ ID NO: 291589 - DNA, 683 bp, Homo sapiens
  misc_feature: GYAE6OF01CYS66.44.36.D03.1.454.CMB.1.raw
  modified_base (235)..(235): a, c, t, g, unknown or other
  misc_feature (235)..(235): n is a, c, g, or t
  modified_base (354)..(354): a, c, t, g, unknown or other
  misc_feature (354)..(354): n is a, c, g, or t
  modified_base (600)..(600): a, c, t, g, unknown or other
  misc_feature (600)..(600): n is a, c, g, or t
  modified_base (602)..(602): a, c, t, g, unknown or other
  misc_feature (602)..(602): n is a, c, g, or t
  modified_base (628)..(628): a, c, t, g, unknown or other
  misc_feature (628)..(628): n is a, c, g, or t
  modified_base (678)..(678): a, c, t, g, unknown or other
  misc_feature (678)..(678): n is a, c, g, or t
tcagacagtatatacacgaccggtgctcgatttagctgcgtcacgatctctcttggggctggatccggcagccccagggaggggaatggagtggattggtgacatccattatactggggcgacgtactactctccgtcctcaagagtcgtctcaccatttcgagggacacgtccatgaaccgcttctccctagaaactgacctccgtgaccgccgcggacacggccgtttattcngtgcgaggcgagacttggtctttagaattctaagttcggggccgtggtccaccgttggtcaacttcgtctcctcacgtcttaccgaaccgacggccctagttccggtcccttaccccgnggccgtcccgtagccgttaccgaaggtacctccgacccgtttcgggacggggtaccacgacggccccgggtccgtttacggggcctacgggtccccgttaggggttaaccgaaaacgggtaccttttaaccgtcccgtttaagttaacgttaacgttccggttacgttaggggaaacgggtcccgggttaccgtaaggggaaccggtaaccggggtccttacgaaaacggtttagcgaaccgttananagacgacgagtacgagtacgacgctngagactagacgcgacgagtatacgcgactacacgtcgtacgtagacgtgngtacg

SEQ ID NO: 291590 - DNA, 732 bp, Homo sapiens
  misc_feature: GYAE6OF01CZZ12.44.36.D03.1.454.CMB.1.raw
  modified_base (63)..(63): a, c, t, g, unknown or other
  misc_feature (63)..(63): n is a, c, g, or t
  modified_base (188)..(188): a, c, t, g, unknown or other
  misc_feature (188)..(188): n is a, c, g, or t
  modified_base (214)..(214): a, c, t, g, unknown or other
  misc_feature (214)..(214): n is a, c, g, or t
  modified_base (240)..(240): a, c, t, g, unknown or other
  misc_feature (240)..(240): n is a, c, g, or t
  modified_base (416)..(416): a, c, t, g, unknown or other
  misc_feature (416)..(416): n is a, c, g, or t
tcagacagtatatacacgaccggtgctcgatttagctgcgtcacgatctctcgttgggggganacgagcccagcactggaagtcgccggttgtttccattcggtgatcatcactgaacacaggacggactcacatggtacgtttgggctgagtagttcgggtttcctcgttgcttacgttttaaaggnggtcgcctaggttcgtacgagggtcncgagtccgtaggtgggtaggtcgggnggggggacgacggccggcccaggtccgttacgggaaccctccgtaggacgtccttctaccgtggtacgcgacgtccgttacggtaggtacttcgtacttccgttacgaccggtaccttagtcggacctagtccgacgtcggtccgaccgccgagtccgaccgaggtcggagggtcnggggacggtgggtctaaattagttaacgacgagaaaggtaacgtaggtaagttaaacgtacgaaaacgacgaacggtaaggcgtaacgacggaagacggccgtatacccgacttacgacgagtaacgactacgtacgaaacgtacactacgtgtaactagtagtacctaataaccgttaagaaaccctaacgttaaccgaagtacggtaagacccgggacgttaacggcctttaagtagtttaacttacggtcggtacccggaacgttaccccggacccggttaccccgaacggtccgggtccccggttaaccccg

SEQ ID NO: 291591 - DNA, 905 bp, Homo sapiens
  misc_feature: GYAE6OF01D6OF9.44.36.D03.1.454.CMB.1.raw
  modified_base (124)..(124): a, c, t, g, unknown or other
  misc_feature (124)..(124): n is a, c, g, or t
tcagacagtatatacacgaccggtgctcgatttagctgcgtcacgatctctcgttggggagctctgagagcggacgccccagccccaagtaacttcccgtaggtttcgttttacagtttgggtntactcgacgactacgtagaacagacggtacgacctacaaccgtgtacgggtacggttccggactggagttcgttttcgggtttttcctttgtttacgttttaatttacgaaggtctcgtagtagtagtagcgtagtggtgggtacggtacgggtaccgggaagttcgttacggaccgtcgtccgggtacggtaccggttccaggtaccgtaccttccgttccgtggttccgaccggttacctcggttaccgacttaccgaaccttacgtaccgtaggtaaccctaaccgtaattaagttccgggtaaccggtccggttccggggacccctacggtaaccgggtaccggtaaccgggggaggggtacgggtcgggttaacggtcgggttaccgggtcgtaccgggaaccgtaaaacgtaaaacgtaaacggttaacgtccggaacctttacgttaacgtttaacacggtacgacccgttaggcccggtactacggttagtaacggtacgtaacgtactaccgttaaccgtaccctaaccgtacgtaacgaacgttaagtacgttacgtaaaccgtaacgtaccgttaacttacgttaacgttagttacccgttaagtagtaaacccgttacgtaaaccgttaaaccctaacgggaaaacggtaccggaaaccggtacggaacgttaacggttacgtttaaggttttatttacgggtttggttaacttttacgttaacgtttattaaccggttataacccggttcgttacgttaaccccgggg

SEQ ID NO: 291592 - DNA, 795 bp, Homo sapiens
  misc_feature: GYAE6OF01BXWT0.44.36.D03.1.454.CMB.1.raw
  modified_base (232)..(232): a, c, t, g, unknown or other
  misc_feature (232)..(232): n is a, c, g, or t
  modified_base (773)..(773): a, c, t, g, unknown or other
  misc_feature (773)..(773): n is a, c, g, or t
tcagacagtatatacacgaccggtgctcgatttagctgcgtcacgatctctcgttggggggagacgagcccagcactggaagtcgccggtgtttccattcggtgatcatcactgaacacagaggactcaccatggactttgggctgagattcgggttttcctcggttgcttacgttttaaggagggtggcctagtgtccgaggtgcgtagctaggtggagtcgtgggggagngcggcccgagccgtacgggaacctcccgtagacgactcgtcctgtcgcagtccctctggtacttacgtatccttacgaacggtacctagtcggaccctagtacggaccgtaacgttccgggggaccccaccggtaacggtacccgttacccggaaggggaaccccggttaaaaggggggccgttagggggtaagggttacgggggttacggaaccgttaaaagtttacgttaacttaaccggaaaagggtaacggtaaaggttaggtaaacttagggaaaaacgaacttaaaccgggtaacggaaggtaacccgttacgggaacggtaacgggaccgttaacgttccgaaccccgttactacggaaacgaacgtaacccgtaactacccggaacgtaaaccgacctagtcggaactacgtcgtaacggaactaaagtaccgtaaaccctaaccgttacaaaccggtaggtaaccggacgaacgtaccggtactacggttattagtagttacggtagaccggtaccgtacccgtaccccggnggaacccgtcccggtaccccgg

SEQ ID NO: 291593 - DNA, 835 bp, Homo sapiens
  misc_feature: GYAE6OF01A7HH8.44.36.D03.1.454.CMB.1.raw
tcagacagtatatacacgaccggtgctcgatttagctgcgtcacgatctctcttggggatcacataacaaccacactcctcctctaaagaagcccctgggagcacagctcatcaccatggactggacctggcggttcctctttgtggtggcagcagctacaggtgtccagtcccaggtgcagctggtgcagtcgtggggctgaggtgaagaagccgtgggtctcggtgaaggtctccgtgcgaaggtcttcgtggaggctaccgttctcagtctagttcgtcttttagttgggtgccgacgtacggtccccgtagggaaccgtaaggggtccttagggtaaggttcgggtaccggttggggggaagggtacttccgtaacgttccccgttaagtttccggttttaggggtacgtaccgtaagttaccggtaaaacgtttaccggaaccgtaacgtaaagggttaacgtttaccggaacgggtaactaagggtaaccggttacccaaaccgtaaccgtttaacccgggaacgggtaaaccgtaaacttacccgaacgggttaacgtaacccgtaaccggtaccgttaaaccgtaggtaaccgggaacgtacggtacggaacgggtccgtaacgggtaccggtaagggtaacggtaaccgttaacggtaaccggtaacggtaaccggtaaccggtaccttaaaccggtttaccggtttaacttttaccggggttaccgggtaacggtcccggggttaacgtaaccccggttcccccggttttaacgtaacccccgttttaaccgttttacctaaccggtttaaccccggttaccccg

SEQ ID NO: 291594 - DNA, 712 bp, Homo sapiens
  misc_feature: GYAE6OF01BBR1N.44.36.D03.1.454.CMB.1.raw
  modified_base (189)..(189): a, c, t, g, unknown or other
  misc_feature (189)..(189): n is a, c, g, or t
  modified_base (227)..(227): a, c, t, g, unknown or other
  misc_feature (227)..(227): n is a, c, g, or t
  modified_base (246)..(246): a, c, t, g, unknown or other
  misc_feature (246)..(246): n is a, c, g, or t
  modified_base (459)..(459): a, c, t, g, unknown or other
  misc_feature (459)..(459): n is a, c, g, or t
  modified_base (474)..(474): a, c, t, g, unknown or other
  misc_feature (474)..(474): n is a, c, g, or t
tcagacagtatatacacgaccggtgctcgatttagctgcgtcacgatctctcgttggggggctctgcttcagctgtgggcacaagaggcagcactcaggacaatctccagcatggcctggtctcctctcctcctcactctcctcgctcactgcacgaggtcctcgggaccctactctgtgctagacgcncgccgccctgaggtcggtcggtccgggggccccggganaaggcgggttaccaccgtntcctccgtgccgacgtgggacacgagactaccaataggacggacagtatcgtagatcgtaccacgtacggtaacccactaaccttccgaaacggtaccacgaacccccaactcctacaactttaccgtttaaggaaacctaaaccgttcgtcccgacccgtacggtaaccgggttccacggtacctagttcctcgtacgtctaacctacgtcncggtaccaacccgtnacgttcccaccgttcgactacgtaccgttacggcggtcctaccggacgtcgtaacgaacggtgtaacggggtaggttacggttaacttttaaacgtccgtaaccggtactaaccggttactacgttacgaaacgacccggtccgaattccccggttaaggtcgggttttcggggttaaaccgggggttcgttaccgggggaacggggaacccgggttaacgaaccgggttaccccggg

SEQ ID NO: 291595 - DNA, 839 bp, Homo sapiens
  misc_feature: GYAE6OF01DTYJN.44.36.D03.1.454.CMB.1.raw
  modified_base (774)..(774): a, c, t, g, unknown or other
  misc_feature (774)..(774): n is a, c, g, or t
tcagacagtatatacacgaccggtgctcgatttagctgcgtcacgatctctcgttggggggagacgagcccagcactggaagtcgccggtgtttccattcggtgatcatcactgaacacagaggactcaccatggtactttgggctgagtattgggtttttcctcgttgcttagttttaagaggtggccagtgtcgaggtgcgagtcgtaggtgggtaggtcggtaggggggaggaggccggcccgacggccgttacgggaacctcccgtaggacgtaccttccgtccgtgtgccgtacgtcccgtccgttggtacttactacttccgttacgacggtacctagtcgacctagtcgccgtacgttcgggcccgaccgtacggccctaccgagggtacgaaacgggggtcgtagggggtacgggttggggtacggtaaacctaaagttttaacgtaacgtacggaaagtaaacgttaggtaacgggttaaattaaggaaaacggtaaaccgaacggtaaaccggacgtaacccgtaaccggaaggaacgggtacccgtaacgttacccgtaacccgttaccgtaccgaaacgtaacgaacccgttaaaccgttaacccgaaacggaaacccctaacgtacgtacgaaccgtagttaccgtaagaacccctaaagttaacccccgttaaactaaccccgtaacgtaacggtaacgaggaacccgggtaaacccgaacgggttacgttcgttaatttacggtttaacggttaccggngaaccggtaacccgacccccggtaaccccggttacggtaacccgggtcccccggttaaccccggg

SEQ ID NO: 291596 - DNA, 768 bp, Homo sapiens
  misc_feature: GYAE6OF01A9ZY0.44.36.D03.1.454.CMB.1.raw
  modified_base (449)..(449): a, c, t, g, unknown or other
  misc_feature (449)..(449): n is a, c, g, or t
tcagacagtatatacacgaccggtgctcgatttagctgcgtcacgatctctcttggggagctctgagagcggagccccagccccgagaattcccaggtgttttcatttggtgatcagcactgaacacgagaggacctcaccatggagttcgggctgagcttggttttccttgttgtttattttacaaggtgtccagtagtgaagtgctagttgggtcggaggttccgggggatacgttcggtccgagtccgttgggacgggttcccctggacgtaccttcttccgtgttcgtccgtcccttcgttcggacttccaacctatccagttcgaacctactaatacgtggacgtcgggtcccaccgaggccgtaccggaaggggaggggtcctagggaggtcggtcgttcgggaccgaagtaaacgtaaaaacgaagttcgcaacgtctttanacacgagtacgaccgtccgtacgttctagtaacgaaacgtcctaaggtacctttacccgaaccccttctaaaccggaaacggaagtacgttaaccggtaacctttaacaaacggttaacccttacgtaaagttcgtaaattttccggacgtaacccgtaaattccggaaaacccttaaacggaaaccggtaaaacccggcgggaaaccgtaaacggggtacctaaagtttcggttaaattttacggttaggttcggttttaggtttatttaacgtaagttacccggtaaaggttaacccccgtttggtaaacccccggg

SEQ ID NO: 291597 - DNA, 714 bp, Homo sapiens
  misc_feature: GYAE6OF01EQ4JB.44.36.D03.1.454.CMB.1.raw
  modified_base (142)..(142): a, c, t, g, unknown or other
  misc_feature (142)..(142): n is a, c, g, or t
  modified_base (147)..(147): a, c, t, g, unknown or other
  misc_feature (147)..(147): n is a, c, g, or t
  modified_base (166)..(166): a, c, t, g, unknown or other
  misc_feature (166)..(166): n is a, c, g, or t
  modified_base (189)..(189): a, c, t, g, unknown or other
  misc_feature (189)..(189): n is a, c, g, or t
  modified_base (197)..(197): a, c, t, g, unknown or other
  misc_feature (197)..(197): n is a, c, g, or t
  modified_base (663)..(663): a, c, t, g, unknown or other
  misc_feature (663)..(663): n is a, c, g, or t
  modified_base (677)..(677): a, c, t, g, unknown or other
  misc_feature (677)..(677): n is a, c, g, or t
  modified_base (688)..(688): a, c, t, g, unknown or other
  misc_feature (688)..(688): n is a, c, g, or t
tcagacagtatatacacgaccggtgctcgatttagctgcgtcacgatctctcttggggatcacataacaaccacactcctcctctaaaagaacgcccctgggagcaacagctcatcaccatggactggacctggcgttcctnttggnggtgcagcagctacaggtntccagtcccgaggtgcagctggncagtcggngggctggaggtagaacgacgtccgtggtccgtacgggtaggtacgtcctccgtaggaccgtaaggtccgtttcggacgggtacggtacccttaccgttttccgtacgtaacggtaccttagtttacggttttacgttttttaacgggttcgggggttacgaacccggtaaccggtaccccggtaccccggtaggtaaccggtaacgggtcgttacgggtcggtcggtcgggtaggggacgttacgtacctacggttccttagttcgttcgctagacgttaaccgtaagtccgacgtaacgtagttacgtacgacgtacgacgtactaccgtacgtaacgtaccggacgtaaccgtacctacgtacgacgtaacgcgtaacgtacgtacgtacggacgtacggtacgacggaggtacgtacggacggtaaccgtagacggttaacgacgtacacggtactaacggtnttacgcgtggtacncggtaccgtcncgttaacgcttaagactcgtacctcg

SEQ ID NO: 291598 - DNA, 864 bp, Homo sapiens
  misc_feature: GYAE6OF01D1U4K.44.36.D03.1.454.CMB.1.raw
  modified_base (267)..(267): a, c, t, g, unknown or other
  misc_feature (267)..(267): n is a, c, g, or t
tcagacagtatatacacgaccggtgctcgatttagctgcgtcacgatctctcttgggggactcctgtgccccaccatggacactctttgctacacactcctgctgctcgaccaccccttctgggtcttggtcccaggtcacttggaaggagtctggtcctgtgcgtggtacgaaacccagagacgtaccctcgacgctacgacctcgaccacctattcgttcgttcgggttctctactacgaacgtatagttaagaggtgggtgagngtcgtggtactccgtaccgacccggacccggaagggaccggtccggtgggtacgttcggtccttcggaccaaccacgtactttccgttacgtaacgtaagtaacgaaaaccgttaaaactcccgtaactaacgttaactacttaccgttacgtaaggtaaacgaacgttaaccgtttaaaccgtttaaaccctactaaccccgtaaccggtaaacgtaaacccgtaacccgtaaaccgaaaacgggtccggttaacgggtttaacggtttacgttaaggttacgaaccgtaaccaacggttacgacccggtacccgtacgggaccgaacgtaacggacgtaaccgaattaacggttactttaacggacggtacggtaacgggttaaccgggaaggtaagggtaaaaccggggaaactaaacgggtacgtttacgtttacgtttaacggttaacttacggttttaaatttccggtaaacctttagtaaccggtttcgggtacgggttaaccggttcggggtaaaccggggttaacccggaaacggttaaccccgggtacggttaaacccggtccccttaacgttccccgggtaacccg

SEQ ID NO: 291599 - DNA, 723 bp, Homo sapiens
  misc_feature: GYAE6OF01BJ6K6.44.36.D03.1.454.CMB.1.raw
  modified_base (180)..(180): a, c, t, g, unknown or other
  misc_feature (180)..(180): n is a, c, g, or t
tcagacagtatatacacgaccggtgctcgatttagctgcgtcacgatctctcttggggatcacataacaaccacactcctcctctaaagaaccccctgggagcacagctcatcaccatggactggacctggcggttcctctttgtggtggcagcagctacaggtgtccagtccccaggtncagctggtgcagtcgtggggctggaggtgaagagccgtggtcctggtgaaggtcctcctggcgacggtcttcgtggaggctacttctacgaagtaaactatcttatccgtacgtggtcgacgaccgaccggtcccgtaggaacgaggtcgttggaggtgggtaggtggggtcggtccgttccgtaccccgttaggtttacggaacgtaacgactaaaccgtacgaactacgtaaacgtaacgtccggaggacgacgtaccgtacgtacgtaacgtacccggacgaacgtaacgtaccgaacggacgtacgaccgacgtaccgtagttaacggtacgggtacgtccgtacggtaccgaccgtaacggtagaacggtactacgggtacggaacggtaacccgaccggttacccttagtttacgttccgtacggtaccggtacgtaaaccgttaaaccgtttaaaaccgtttcccgttaacccgtttaacgggttttacggggaacggtttacggttacgttaacggttacgttacggtttaacgg

SEQ ID NO: 291600 - DNA, 671 bp, Homo sapiens
  misc_feature: GYAE6OF01ET8Z7.44.36.D03.1.454.CMB.1.raw
  modified_base (257)..(257): a, c, t, g, unknown or other
  misc_feature (257)..(257): n is a, c, g, or t
  modified_base (333)..(333): a, c, t, g, unknown or other
  misc_feature (333)..(333): n is a, c, g, or t
  modified_base (594)..(594): a, c, t, g, unknown or other
  misc_feature (594)..(594): n is a, c, g, or t
tcagacagtatatacacgaccggtgctcgatttagctgcgtcacgatctctcttggggatcacataacaaccacactcctcctctaaagaagcccctgggagcacagctcatcaccatggactggacctggcggttccttcgtttggtggtggcagcagctacgaggtcgtccagtcccgaggtgcagcgtggtgcagtcgtgggctggaggtagaagacgcgtcgggtccgtggtagaggtctctgcgaggcttgnggacgctaccttcttcagtctattgttcttttagttgggtcgcgacgtcggcccgtggacgaggtcttggagtggngtgggaggtactcacgtcccgttagttcgtttggtgacgtatacgtaacgttaccgagaaacgtaaggttaacggtttcgaaaggtacgaggtaacgtaccaccgtaacgttacccgggacggaaaccgtacgtaaccgaacggtaacgtaaccgacgtaccgtaacgtaggtaggtaccgtaggtacggaacggtcgtacgggtccgtaggaacgtacgttacgaacggacgtacggaccggtacctaccttacgttttnttccgttaggcgtaccgggtacgacccggttacccgttacggttacttaaccggttttccaaaggttccccttaccc

SEQ ID NO: 291601 - DNA, 703 bp, Homo sapiens
  misc_feature: GYAE6OF01BW2G2.44.36.D03.1.454.CMB.1.raw
  modified_base (469)..(469): a, c, t, g, unknown or other
  misc_feature (469)..(469): n is a, c, g, or t
tcagacagtatatacacgaccggtgctcgatttagctgcgtcacgatctctcttggggagctctgagagcggagccccagcccccagaattcccaggtgttttcatttggtgatcagcactgaacacagaggactcaccatggagttcgggctgagtcttgggttttccttgttgtttattttacaaggttgtccagagtgaagtgcaggttgggtgggaggtccgggggagacgttggtccgaggccgtggggacgggtcccgtaggacgaccgtcgtccttggtcgtccgcccgttcgtagggtacttccaaccattccgaggtacgaccctaactatacgtcggaccgtcggggtccgaccgacgggtccgtaccggaggggaacggggtcgtagggtaggtcggtcgttcgggaccgtaacgaaacggtaaaaaacgtaaggttcgaccgtaaggtactttaacncgaacgtacggtacgtaccggtacccgtcgtacgtcggtaacgtaaacgccgtaagtaccttacccgtacccttctaacgaaagtacgattacgtaacctacgaacgtaaccttatagttcgtacttgtacgacgtaatacgtaaacctaacgtaacgaaacccgtaggaccgtacggtatagtagtattagttgttgttagttagtttatacgtagacgtacgtgtaacccgg

SEQ ID NO: 291602 - DNA, 656 bp, Homo sapiens
  misc_feature: GYAE6OF01BRGDH.44.36.D03.1.454.CMB.1.raw
tcagacagtatatacacgaccggtgctcgatttagctgcgtcacgatctctcttgggggactcctgtgccccaccatggacactctttgctacacactcctgctgctgaccaccccttcctgggtcttgtcccaggtcaccttgaggagtctggtcctgtgctggtagaaacccacagacgaccctcacgctgacctgcaccatctctgggttctctctcaacgtatattagaagtgggtgtgagcgtggactccgcgaccgccccgaaggggacggcccgtggagtggtctgacacactacttcttactacgaatacggaaacgtaaaactcctaacaagtactagtctactaggaagacgacgtaagttaaccacttacctaccgaaacggaacctaacccgtaaaccgaaaaggacgtaaggttcggttacgtttacgtaacgtacgaaccctaatacgtaccggacctaggaaccgtacgacgacgtactaagtaacttattacgagtcgaccgtaaggtagacggaaggaaagacgacgttgttacgtttagtatttaactagtaacgtttccttaacagttcgtaggacggttacggaacgggacgaaaacccgggtccgaaccggttacccaccttccgtccgtacccg

SEQ ID NO: 291603 - DNA, 593 bp, Homo sapiens
  misc_feature: GYAE6OF01AREFQ.44.36.D03.1.454.CMB.1.raw
tcagacagtatatacacgaccggtgctcgatttagctgcgtcacgatctctcttgggatcacataacaaccacactcctcctctaaagaagcccctgggagcacagctcatcaccatggactggacctggcggttcctctttgtggtggcagcagctacaggtgtccagtcccaggtgcagctggtgcgagtcgtggggctgaggtgaagagcctgggtcctcggtgaaggtctcctgcaggcttctggaggctaccttctcagctatgtctttttagttgggtgcgacgacggccctggacgagggtcttggagtggcgtgggagggatcacttcccgttagttcgtttggtcgctaatacgtaattacgtacacgtaagtaacgtttcgaaggacaggtacgtaccaccgtacgttaccggacggaaccgtaactccgaacgagtaccacgtcctacagtggagcgtagagccgtaaggcgtagtagactgtacgaacgaccgaccggcctagtctttaacgtttcgtaggtcggcgtaggccgtccccgttaccggttaccttaaccttttccaagttcccggttacccc

SEQ ID NO: 291604 - DNA, 655 bp, Homo sapiens
  misc_feature: GYAE6OF01EZ8HH.44.36.D03.1.454.CMB.1.raw
  modified_base (149)..(149): a, c, t, g, unknown or other
  misc_feature (149)..(149): n is a, c, g, or t
  modified_base (177)..(177): a, c, t, g, unknown or other
  misc_feature (177)..(177): n is a, c, g, or t
  modified_base (187)..(187): a, c, t, g, unknown or other
  misc_feature (187)..(187): n is a, c, g, or t
  modified_base (225)..(225): a, c, t, g, unknown or other
  misc_feature (225)..(225): n is a, c, g, or t
  modified_base (238)..(238): a, c, t, g, unknown or other
  misc_feature (238)..(238): n is a, c, g, or t
  modified_base (243)..(243): a, c, t, g, unknown or other
  misc_feature (243)..(243): n is a, c, g, or t
  modified_base (286)..(286): a, c, t, g, unknown or other
  misc_feature (286)..(286): n is a, c, g, or t
tcagacagtatatacacgaccggtgctcgatttagctgcgtcacgatctctcttgggggactcctgtgccccaccatggacactctttgctacacactcctgctgctgaccaccccttcctgggtcttgtcccaggtcaccttgaaggngtctggtcctgtgctggtgaaaccccanagagaccctnacgctgacctgcaccatctctgggttctctctcaacgntattagatgggtntgagntggactccgtcacgccccagggacggccctggagtgctgcacncatctctcaatgaacgaaaatcctacagtacatctcctgaagagtctacgtttaaccattacctaccgaaaggaccaaccgtaccgaaaacggctagggttacggttacttttaaggtaacttacggaaccctaaaccgtacgtcggaacccgttcgaccgggaaccacgacgggctaactacttaatactaggtgaccggtagggtaacgtcgggaacgggaaaagaacgtacgtacgttacggttacttagttaacttagttaaacgttcgtaacctagttccgttagggtacggttaccggtacggggtaaccgaaacgggtaccgtaacccgggtaccctaacccggttcctacccgttaccccg

SEQ ID NO: 291605 - DNA, 919 bp, Homo sapiens
  misc_feature: GYAE6OF01BCOSU.44.36.D03.1.454.CMB.1.raw
tcagacagtatatacacgaccggtgctcgatttagctgcgtcacgatctctcttggggagctctgagagcggagccccagccccagaacttcccaggttgttttcatttggtgatcagcactgaacacagaggactcaccagtggagttcgggctgagtcgttgggttttccttgtttgtttatttacgaaggtcgtccagtagtgaagtgcgtaggttggtggacgggtccggggagtacgttcggtccacggtccgtgggaccgggttccctaggacgtccttccgtcgtgtcgtccgtcctcgtgtactcacctatcgagtacgacctactataggtcggtaccgtcgggtcccgccgacgggtcccgtacgggaagggggacgggtcgtaggggtacgggttcgggtccggttaccgggacccggtaaacgtaaaacgggtaaaaaaccgtaacgggttccgaccgtaacgttaccttttaaccgtaacgaacggtaacgtaccggtaccggtcccggtacgtttcggttaacggtaacggtaaaccggaccgtaacgtaaccttaccccgtaaccccgttacgtaaccgtaacgtaacgtacgtaacgttaaccgttaacgtaaaccggttaacttacgtaacgtttacgttaacccgtttacgttacggtaaaccgtaaacggttaacccgttaaaacccgttaaaccggtaaaccccgggttaaaaaccgggtaacccggggtaaaccccgggtaaaccgggttaaacccgttaaaggtttaaacgggtttttaacgttttaacgggtttttacggttttaggtttttaaggttttaaacggtttttaattaaccgggggggtttaaccttaaacgggtttaaacccgggttcccggtttaaacccccgggg

SEQ ID NO: 291606 - DNA, 887 bp, Homo sapiens
  misc_feature: GYAE6OF01BRZCB.44.36.D03.1.454.CMB.1.raw
  modified_base (254)..(254): a, c, t, g, unknown or other
  misc_feature (254)..(254): n is a, c, g, or t
  modified_base (874)..(874): a, c, t, g, unknown or other
  misc_feature (874)..(874): n is a, c, g, or t
tcagacagtatatacacgaccggtgctcgatttagctgcgtcacgatctctcgttggggcagagctcgtggggaggaactgctcagttacggacccagacggaaccatggaacgccccagcgcagtcttcctcttcctcctgtctactcgtgcctcccagtactaccagtaggaagtaaagtgtagagtcggacgtccgtcctaccgacgccctccgttgtcgtcgttcgtaccgtaacggaaaggggaaaccnccgtaccccttcctcctaccgtcggaccggtaccggacgtacgtacggtaggtacggttacgtaccgaacgtaaccgtacttaaccgtaccgtacccgtaaccgaacgaacggtaaccggaaagttaaccggtccggtacccggtacccgggtacccgttcccggtacccgtacccggttacctacccgttaacttacggttacggtaacggttccgaccgtaaccctaccggaccccggtaaccggttaccccgtaccggttaaccccgttacccgtaaccccgtaacccgggtttacgggtaccggtaggggtaccggtcgggtaacggggtccgggtaaccgaccggttaggtaccttcgtacctaccttccgaactcccgtagtacccggcgttaccggctcgggttaacgtttgggtaacgtttggttactttcggtttaacgtttaacgtttctaacggtttagacgtaaacgtttaagtaacgtttaacgtaaccggttccgtacccgttaaccggggtttggtcccgggttaaaccggggcgggttaaacggggtaagtaaaccggttcgtaaacgaaccgttaagggtaccggttacggaccggtttacgngtacccgttaacg

SEQ ID NO: 291607 - DNA, 820 bp, Homo sapiens
  misc_feature: GYAE6OF01AKPXM.44.36.D03.1.454.CMB.1.raw
tcagacagtatatacacgaccggtgctcgatttagctgcgtcacgatctctcttggggagctctgagagcggagccccagccccagaattcccaggtgttttcatttggtgatcagcactgaacacagaggctcaccagtggagttcgggctgagtcgttgggttttcctttgttgtttatttacgaaggtgtccgagtagtgaagtgcgtaggttgggtagggacgggtccgggggagtacgttcgggtccaggtccgtgggacgggtccctgacggtaccttctccgttggtcgtccgccttcgtggtacttcacctatcgacgtcgacctatatagtcggtacgttcggggcccgccggacgggtaccgtaccggaagggggtacggggtcggtagggtacggtacgggtcgttacgggccggtaacgtaaaacggtaaaaaacgtaaggttccggaccgtaacgttactttaactaccgaaacgtacggtaaccggtacccggcccggttacggtacggttacggtaaggaaacggtcccgtaacggtacctttaaccccgtaccccgttacctaacggtaagtaacggttacttacggttaaccctttaaccgaaacgttaaccgttacttaagtttacgttaactttccggtacgtaacgtaacgttaaccgtaaaccgttaaacccgtaacggaaaaccggtaccgggtaaccggtaaccgggtacgtaacgtttagtttagtttaggtttcgtttagggttttggtttacgtttaacgtttacgtagttaacgtccgttacggttacccggg

SEQ ID NO: 291608 - DNA, 765 bp, Homo sapiens
  misc_feature: GYAE6OF01CA8JB.44.36.D03.1.454.CMB.1.raw
  modified_base (162)..(162): a, c, t, g, unknown or other
  misc_feature (162)..(162): n is a, c, g, or t
  modified_base (203)..(203): a, c, t, g, unknown or other
  misc_feature (203)..(203): n is a, c, g, or t
  modified_base (560)..(560): a, c, t, g, unknown or other
  misc_feature (560)..(560): n is a, c, g, or t
  modified_base (707)..(707): a, c, t, g, unknown or other
  misc_feature (707)..(707): n is a, c, g, or t
tcagacagtatatacacgaccggtgctcgatttagctgcgtcacgatctctcgttggggagctctgagagcggacgccccagccccagtaacttcccgaggttgtttttcagttttggtgatcgagcactgaacacgagaggactcaccagtggagttcggntgagtcgttgggttttcctgttgtttactttacgaaggttntcgagtgtagaagtgacgtaggttgggtacggacgggttccggggataccgttcgggtccagtcccgttagggtaccgggttccctaggtaccgtaccttccgttccgtggtcgttacccgccgtttccgtaggtacttacccgtaacctagtaccgtacgggttacaacccgtaacttaagttaacggtaccgggttaccgtccggggttacccgaccggtaacggtccgtaccggtagggggtaacgggtccgtgggacgttcgggtcgttaccgggccgtaagtaaacgttaaaaacgtacggttcgacctaggttacttacgtacaacgtagacggtaccgccggtcttacgnggtaacgaacgaccgaagttaccgtacccaccgttacgtaacgaacgtagacgtacgtaacttacgaatactatacttgtacttacgacgtacgtagtaccgtaacctaacggtaccgaaacggtcggaccgaggtactaacggttnttactttaggttgtttcgttagttacgtttactacgtaagtacggtacttggtacccg

SEQ ID NO: 291609 - DNA, 752 bp, Homo sapiens
  misc_feature: GYAE6OF01DV667.44.36.D03.1.454.CMB.1.raw
  modified_base (399)..(399): a, c, t, g, unknown or other
  misc_feature (399)..(399): n is a, c, g, or t
tcagacagtatatacacgaccggtgctcgatttagctgcgtcacgatctctcttggggggagacgagcccagcactggaagtcgccggtgtttccattcggtgatcatcactgaacacagaggactcaccatggactttggctgagattgggttttcctcgttgcttacgttttaagaggtggccagtgtcaggtgcagctagtggagtcgtgggggagagccggcccagccgtagggaacctcccgtagacgtacctctcctgtcgcagcctcgtggacttcagttccttacacggtaccttatcgacctagtcgcgtaccgtcggggtccccgaccgtacgggtcctaccgagggacgaacgggggtctaggggaggtggggtcgactaaagtttanaatacgaaggtaaagattagggtaaacttggaaaacgtaaaccgtacgttaaacgggaacgtacccgtaaccgggaaggaaccgggtaccgtaacgttacccgtaccccgttaccgtaccgaacgaacgtaacgtaaacgttaacccgaaccggaaacctaaccgacgtacgtacgtaacttaccgtaggaacctaaagtaccgtaacctaaccctacgtaaccgtaagtacgaacggaccgtaccggtaccgttacgttacgtttacgttacgttacggttacggaccggtaaccgggtacccgtacccccccggttaacggtacccgggttaaccccgggttacccccggg

SEQ ID NO: 291610 - DNA, 889 bp, Homo sapiens
  misc_feature: GYAE6OF01BD28N.44.36.D03.1.454.CMB.1.raw
  modified_base (60)..(60): a, c, t, g, unknown or other
  misc_feature (60)..(60): n is a, c, g, or t
tcagacagtatatacacgaccggtgctcgatttagctgcgtcacgatctctcttgggganctctgagaggcggacgccccagccccagaacttcccagttgtttcatttggtgatcagcactgaacagagaggactcaccgagtgggtacgttcgggctggacgtccggttgggtttttccttggtttagttttaacttttacgaacgggttccgtccgagtaggtggtaacggttcgcctaggtttcgggtagggtaccgggttaccggggggaataccggtttcgggaccgacggtcccggtagggtacccggttaccctaggacggtacccttccgtccgtggttcggtccgtccgttacgttaggtaacctttaccgaaccctaagtaccgtaaggttaaccgaaacccttaaagttaacgtttaacggtaccgggtaaacccgtttccggggggtccccctaaccggaacgggtccccggttaaccgggaagggggtaacggggtcttaggggacgttcgggtccttcgggacccgtaagaaaaagttaaaaaacgaacgttacgacgtaacgttactttaacgaccgtaacgaaggtaaccggtacccggccgtacgttacggtagtaacgaaacgtcgaacgttaccttaccccgacccttacgaagaaagtactaagtaccgttaaactaagaaacgtaccttaacgttacgttaggtaactttaccgagtaacccgtaaatttaaccggaaaccttaaacccgggtaaggaaaaacccggtcggaaaccgaacggttacgttaaagttacggtttaatttaggttggtttagttaccgttagttaaccttagtaacgtaacgttacgtcggttaacccgg

SEQ ID NO: 291611 - DNA, 969 bp, Homo sapiens
  misc_feature: GYAE6OF01AIQ1N.44.36.D03.1.454.CMB.1.raw
  modified_base (195)..(195): a, c, t, g, unknown or other
  misc_feature (195)..(195): n is a, c, g, or t
  modified_base (844)..(844): a, c, t, g, unknown or other
  misc_feature (844)..(844): n is a, c, g, or t
tcagacagtatatacacgaccggtgctcgatttagctgcgtcacgatctctcgttgggggggagacgacgcccagcactggaagtcgccggtgtttccagttcggtgatcatcactgaacacagaggacctcacagtggtacgtttggctagagtacgtttcgggttttcctcgttgtctttacgttttaaaggngggtcgccgtaggttcgtgacggtgctagtcgttaggtagggtcggtacgggtggggggacggaccggcccgggtacccgacggtccggttaccgggaacccgttcccgtaggtaccttcccgttccgtcccgtggtccgactaccgtccgttacggtgtaccttctaccgttcgttaaccgacggttacctacgtcgtaccgtacgtccggtaccggttcccgggtccgggttcccgaccggtaccgggttcccgaaccggacggggtacggggtaacgggtcggttagggggtacggggttacgggttaacgttaacgttaacgtttaacgtaacggaaccgggtaaaagtaacggttaaacgggttaaacggttaaaggtaaaacccggttaaaccggaaacggttaacccggggtaaacggtaacccggtacccggggtaaaccgggtaaccgggtaaccgggtaacccgttaacccggtttacccgtaaccccgggttaacccgtaaccgttaaagggtaaacccgttaacgttaaacccccgggttaaggaaaccccggtaaaccttcccggtaacttaccgaaccttaacgtaccgttaaaacgggacttaaaacccgtaacgttaaacccgtacccgtaanaaaccgggtgtaaccgggaacttccggggtaccttaggttaccgttagtttagtttccggacggttaccgaccggtaccccggttaacccgacccgggtcccgtaacccgggtcccgttacccgg

SEQ ID NO: 291612 - DNA, 611 bp, Homo sapiens
  misc_feature: GYAE6OF01AJM62.44.36.D03.1.454.CMB.1.raw
  modified_base (382)..(382): a, c, t, g, unknown or other
  misc_feature (382)..(382): n is a, c, g, or t
tcagacagtatatacacgaccggtgctcgatttagctgcgtcacgatctctcttggggatcacataacaaccacactcctcctctaaagaagcccctgggagcacagctcatcaccatggactggacctggcggttcctctttgtggtggcagcaactacaggtgtccagtcccaggtgcgtctggtgcaatctggggctgaaatggaagaagcctgggtcctcggtgaaggtcctcctgcacggcttcgtggaggcatcttcagaactatcttatcaccgtgggtgacgacacggcccctaggacaaggggtcttgaggtggagtgggtacgggcttcggtacccctaagtttcgggaacagacaaacgtacgtcaacganaaacgttcccgaggcaggacctcgacgacttaccggcggaacgtactccacggagtacgcgacgtcctatagtggactcgtagccgaccacccgtaggacgtagtcgtagacggtaccgacccggtacctagttacttcgcgccgtacgaacgtaaaccttaaaaccgtttccgttaccgttacggtttttcggggacggttacggtacgtatcggttattagttacgg

SEQ ID NO: 291613 - DNA, 776 bp, Homo sapiens
  misc_feature: GYAE6OF01DNT8G.44.36.D03.1.454.CMB.1.raw
tcagacagtatatacacgaccggtgctcgatttagctgcgtcacgatctctcgttggggggagacgagcccagcactggaagtcgccggtgtttccattcggtgatcatcactgaacacgagaggactcaccagtggtactttgggctgagtagttcgggtttttcctcgttgtctttacgtttttaaaggaggttcggacctaggttcgttaccgaagggtgaccgaggtacgttaaggtgggtacggtcgggtaggggggacggacggcccggcccaggcccgtagggaacctcccgtagacgtacctccgtcctggcactcgtacctgtagtacttcgattctacgacgtactagtcgaccagtccgacgtaccggttccgggccgaccgacgtccgtacccggagggtacggacggggtcgtaaggggtggtacgggtagaccttaaagttctaacgtacgaaggtaaactgtaacggttaaagtacgaaaccgtaaacgtacggtaacggaacgtaccggtaacggaacgggtaaccgggtacctaagttacccggtacccgttcctaacggtaaacgaaccgtaacgttaaccgtaaccggaaaccgaaaccgtacctacggtacaacctacttaacgtagtaaacttaaacgtaccgtaacctaacaacgttaacggaagtaacggacgtacggacgttgttacgtacgtttattagtacgggcgaacgtaaccgtcccgacccgtacggacccggtcccgtaacccgg

SEQ ID NO: 291614 - DNA, 754 bp, Homo sapiens
  misc_feature: GYAE6OF01BXJW9.44.36.D03.1.454.CMB.1.raw
  modified_base (148)..(148): a, c, t, g, unknown or other
  misc_feature (148)..(148): n is a, c, g, or t
  modified_base (165)..(165): a, c, t, g, unknown or other
  misc_feature (165)..(165): n is a, c, g, or t
  modified_base (183)..(183): a, c, t, g, unknown or other
  misc_feature (183)..(183): n is a, c, g, or t
  modified_base (257)..(257): a, c, t, g, unknown or other
  misc_feature (257)..(257): n is a, c, g, or t
  modified_base (286)..(286): a, c, t, g, unknown or other
  misc_feature (286)..(286): n is a, c, g, or t
  modified_base (339)..(339): a, c, t, g, unknown or other
  misc_feature (339)..(339): n is a, c, g, or t
  modified_base (359)..(359): a, c, t, g, unknown or other
  misc_feature (359)..(359): n is a, c, g, or t
tcagacagtatatacacgaccggtgctcgatttagctgcgtcacgatctctcttggggatcacataacaaccacactcctcctctaaagaacgcccctgggagcacagctcatcaccatggactggacctggcggttcctcgtttggnggtggcagcagctacgnggtgtccagtcccaggtncgagcgtggtgcgaggtcgtggggctaggacggtagaaggacgtccgtagggtcctcgggtagtaggtcctcgngacgagtcttgtacggaggtcctacgttntacgagtacctattggttcttttaggtcgggtcgacgtacggccggtacccgngggaacctagggtcgttggngggtgggtacgtaggggaggtactcgtactaccgttagttcgttcgggtacggtaactggtaacggtacttaaccggacgtaaacggacgttaacgttcggaaacggacgtaacggtaacgtaccgtaaacctacggttaccggacgggtaacccgtaagtacccggaacgttacgtaaccgaacgtccgtaaacggtaaggtcggaccgtaaggtcgaacggaacggtggtacccgggtataacggtaccggtaacgtaacggaaacacccggtaaaccggacgttaaacgtttcccgttaacggttttcaccggggttgtaacccggggtaacgtcccgttaaacccgtttccgtaaccttaacccgggtttaacgcgttttccgtacccccg

SEQ ID NO: 291615 - DNA, 783 bp, Homo sapiens
  misc_feature: GYAE6OF01DERYR.44.36.D03.1.454.CMB.1.raw
  modified_base (188)..(188): a, c, t, g, unknown or other
  misc_feature (188)..(188): n is a, c, g, or t
tcagacagtatatacacgaccggtgctcgatttagctgcgtcacgatctctcgttggggggagacgagcccaagcacgtggaagtcgccggttgtttccattcggtgatcatcactgaacacagagctcacgtatggcgtttgggctagagtgtttcgggttttcctgtttgctttacgttttaaagngggtcggtacctaggtgtcgaggtgcgagtcgtaggtggaggttcggtagggggaacgcggccggtcccgaacggtcccggtaacgggacctcccgtaggacgtcctccgtcgtggtcgacgcgtccgttcgtggtacttcgttactcgttacgaacggtaccttagtcgaccgtacgtacgtaccggtaccggtccgggtacccgacccggtaacggtccctaccgggacgggaaccgggtaacgggtcgtaggggttacggtgggtaggtaacttaaagttacgttacgaagacggtaaaagtggtaaggtaacgttaaacggaaccgaaacggtaacggtaaccggtaagtacccgaccgggaagtaaccgggtcccgtaaccgtcccggtaaccctccgtaaccgaagtaccgggtaaacctaacgttacccggaaacgaacacccgtagtacgacctaagttacaacgtaactaacgacctaacctaacctacgaagacggtaagaccggtacggtacgtagtaccgttaagtttagtcgttaggatacccggtacaccccggtcccgtaacggccccgttccggtcccg

SEQ ID NO: 291616 - DNA, 950 bp, Homo sapiens
  misc_feature: GYAE6OF01E2FGU.44.36.D03.1.454.CMB.1.raw
tcagacagtatatacacgaccggtgctcgatttagctgcgtcacgatctctcttggggatcacataacaaccacactcctcctctaaagaagcccctgggagcacagctcatcaccatggactggaccgtggccggttcctctttggtggtggcagcagctacgaggtcgtcccagtcccgaggtcgcagtcgtggtgcaggtcgtggggctggagtagaagagccgtcgggtcctagggtagaacggttcctccgtacggaccgtaacggtcctttacggtcgggtaccggtcctacccgttttccgttaccgaacggtcctttaactttcggttttacgtttttttaaggggtttcggggttaccggacccggtaaccggtacccggtacccccgttaaggggaaacccggtaaggggttccggttttagggaccggtttggggacgtagggggtaaacggtctacccgttaacttccccggtttatttccggttaggtcgtacgtaacgttacggtaaacttaccggaccttaaccggtaagttaaacggttaccaaagggaacctaacggtaccgtaccgtaaacccttaacggtaccccgggaaacggaccttaaacccggtaccgaacccggggttaacaaacccgtactaaccccgtttaagaacggttaggggtactccgggtagaaccggtaccggaaacgggttccttaaacgggggtaaaccttacggtaaaccggttaacgggaaaaccctcccgggggtaaaacccgtcccgtttttaaaaccttcccgggtttttaaaccgttttcgggtaccccgggttaacggtaacccgggggtaaaacccgtttcccccgggttaccctttaacccccccgttttaaaacggttttaaaaccctttccggtttaaaaccccccgtaacccgttttccccccg

SEQ ID NO: 291617 - DNA, 834 bp, Homo sapiens
  misc_feature: GYAE6OF01DKI52.44.36.D03.1.454.CMB.1.raw
tcagacagtatatacacgaccggtgctcgatttagctgcgtcacgatctctcttggggatcacataacaaccacactcctcctctaaagaagcccctggagcacagctcatcaccatggactggacctggcggttctctttgtggtggcagcagctacgaggtgtccagtcccaggtgcacgtcgtggtacgccaggttccgtggggctggaggtacgaagaacgtccgtcgggtcctcgggtagtacggtctcctggacaggcttcgtggacggcctacttcttcagtctagtgttactttttagttcgggttacggacgaccggtacgggtaccccgtaggggtaaccgtaaacggggttccgtttacgggtagggttcgggtaccgggttaagggggaacgggtaacgtttccgaacgtttccccgttaacgtttcgtttggggtactacggtaacgttaacggttaaacgtttaccgaaccgtaacgttaacggttaaacgttttacggaacgggtaacgtacgggttaacgttacccacccgtttaacggtaaccgggaccggtaaacgtaaccgaacccgttaaggtaaccgtaacccgacgtacccgttaaacggaggttaacggtacgtaccgtaaggaccggtacggtacgggtaccttaagggtaacgtaacgttacggaacggtaccgtaaccggacccggtaaccgtagtttacctttaaccggtttcgttaggttaccggtacccgttaaacgtccccggttacccccgttacgttaaacccctttagttttaacccgtccgtttaaccccgtttaccccg

SEQ ID NO: 291618 - DNA, 774 bp, Homo sapiens
  misc_feature: GYAE6OF01BTS3L.44.36.D03.1.454.CMB.1.raw
  modified_base (176)..(176): a, c, t, g, unknown or other
  misc_feature (176)..(176): n is a, c, g, or t
  modified_base (187)..(187): a, c, t, g, unknown or other
  misc_feature (187)..(187): n is a, c, g, or t
  modified_base (248)..(248): a, c, t, g, unknown or other
  misc_feature (248)..(248): n is a, c, g, or t
  modified_base (269)..(269): a, c, t, g, unknown or other
  misc_feature (269)..(269): n is a, c, g, or t
  modified_base (308)..(308): a, c, t, g, unknown or other
  misc_feature (308)..(308): n is a, c, g, or t
  modified_base (342)..(342): a, c, t, g, unknown or other
  misc_feature (342)..(342): n is a, c, g, or t
tcagacagtatatacacgaccggtgctcgatttagctgcgtcacgatctctcttgggggactcctgtgccccaccatggacactctttgctacacactcctgctgctcgacccaccccttccgtgggtcttgtcccaggtcaccttgaggagtctgtcctgtgctggtacaacccnagacgaccctnacgctgacctgaccaccattctcgttggttctctctacgtaactagttattagagtgggtntagacgtctggactccgtacnccgacccggaggacgccgtggagtgtctcgcacgtactnttccgtctagaactacgaaacgtaaactcctaanacgtactacttcgtatacgtaacgtacgtacttaaccgttaaccactacccgtacaaaccggtacctaacccgtaaacggaaaccgtcggttaacgggtttacgtttaaccgtttaagtaacgtaccggaacccttaacgaacgggttccgtaacccggtacgacccgggtaataccggacggtacctaacttaacgtcgttttaccggaggtacgttaacgggtaccgggtaaaggtaccgggaaacgggtaaacctacgtacggtttcggtttacggtttaccttaaggttaccgttaaaagtttacccgtactttaaccggacgtttacgggtagggttacccggtaaagggggttacccggtaaaaccgggaacccgggacccggttaaccgttccccggtaaccgtttcccggaacccttccccggg

SEQ ID NO: 291619 - DNA, 769 bp, Homo sapiens
  misc_feature: GYAE6OF01BYAI5.44.36.D03.1.454.CMB.1.raw
tcagacagtatatacacgaccggtgctcgatttagctgcgtcacgatctctcgttgggggggagacgagcccagcactggaagtcgccggtgtttccattcggtgatcatcactgaacacagaggactcaccatggactttgggctgagtagttcgggtttttcctcggttgtcttacgtttttaaggagggttcggcctaaggttcgtcgagggtgcagtcgttaggtggtaggtcggtgggggagcggccggcccagccgtagggaacctccgtgacgtacttccgtccgtggtcgccgtacgtccgttacgtgtacttctacttccgttacgacggtaccttagcgaccctagtccgccgtaccgggtccgggtacccgaccgacggtcccgaccgggtagggaccgggtaacgggggtccggtaggggtacgggttcggggtcggtaaactaaagtttacgacttacggaaaggtaaaggacggttaaggttaaagtacgaaaacggtaccaacgggttaacgacgtaccggtacggaagggaccggtaacctcgttacccgaccgtccgtacgaagtaacacgtaaacctacggtaaacgaaccgaactcgtacgatacgtctaacgaccgtaaataccgaacctaccgtacaacgtaggtacggaacgtaccgtacggtacttagttacgtaagtttccgtagggtaccgtaccggtaccgaccccgggtcccctaacgggtaccccggtcccgggttacccg

SEQ ID NO: 291620 - DNA, 736 bp, Homo sapiens
  misc_feature: GYAE6OF01CY2IP.44.36.D03.1.454.CMB.1.raw
tcagacagtatatacacgaccggtgctcgatttagctgcgtcacgatctctcttgggggactcctgtgccccaccatggacactctttgctacacactcctgctgctcgacccaccccttcctgggtcttgtcccaggtcaccttgaaggatctggtcctgtgctggtacgaaacccacagacgaccctcacgctcgacctgcacatctcgtggttctctctacaacgtatagtagaagtgggtagtcgagcgtggactccgtcgaccggccccggaaggggaacgtcccgtagggtacggtcggtcttacgacacgactacttccttacgtacgaatacggaaactaaaactcgtaactagtactatctacgtagaagacgtacgtaacgttaaccactaccgtaccgaaacggtaccaaccgtaaccgaaaggtcgtaggggttacgtttactttaacggtactacggtaacccaagtacgtaccggtaccctaggacccgaacaaccgtacgactaactattaacgtaccgtaggtaccgaacggttaacggggtaacggtaacgggaaacgggaaacgaaccgtaggtttacgttaggtttaacgttagtttaaacgtttaacgttaaacgtaccgttaacgtacgtcggttacgggtacgttacggggacgggtaaaccggtaaccggtaccccgtaagggtcccctaaccgggttcctaaccggtacccg

SEQ ID NO: 291621 - DNA, 789 bp, Homo sapiens
  misc_feature: GYAE6OF01DYWEA.44.36.D03.1.454.CMB.1.raw
tcagacagtatatacacgaccggtgctcgatttagctgcgtcacgatctctcgttggggggagacgagcccagcactggaagtcgccggtgtttccattcggtgatcatcactgaacacagaggactcaccatggactttgggctgagtagttgggtttttcctcgttgcttacgttttaaggaggtggcctagtcgtcagggtgcagctaggtggagtcgtgggggagacgccggcccagccgtagggaacctcccgtagacgtactccgtcctggtcgcacgtccttcgtggtacttccattcttacgaacgtacctatcgacctagtcgacgtacggttccggggtcccgaccgtacgggtcccgtaccggaaacggggtacccggaaagggggtcccggttaggggagggttacgggggtacggtaacttaaacgtttagtaacgtcgaaagtaaacggtaagttacggtaaagtaggaaaaccgtaaccgaacggtaaccggaacggtaccgttaccggaacgggaacgggaccgtaacgtacccgtacccgttacgtaccgaagtaaccgaaccgtaacgttacccgaaacggtaacctaaccgtacgtacgaccgtaactaccgtacggtaacctaaagtaccgtaaacctaactaacgtacgtaacgtaacggaacggaccgtaaccgtcgtacggtttaacttaggttacgttacggaccggtaccgtaccggtacccctacccccggtacggtacccgggttccccggtaacccccggg

SEQ ID NO: 291622 - DNA, 651 bp, Homo sapiens
  misc_feature: GYAE6OF01B8YJT.44.36.D03.1.454.CMB.1.raw
  modified_base (189)..(189): a, c, t, g, unknown or other
  misc_feature (189)..(189): n is a, c, g, or t
  modified_base (248)..(248): a, c, t, g, unknown or other
  misc_feature (248)..(248): n is a, c, g, or t
  modified_base (308)..(308): a, c, t, g, unknown or other
  misc_feature (308)..(308): n is a, c, g, or t
  modified_base (510)..(510): a, c, t, g, unknown or other
  misc_feature (510)..(510): n is a, c, g, or t
  modified_base (547)..(547): a, c, t, g, unknown or other
  misc_feature (547)..(547): n is a, c, g, or t
tcagacagtatatacacgaccggtgctcgatttagctgcgtcacgatctctctgggatcacataacaaccacactcctcctactaaagaacgcccctgggagcacagctcatcaccatggactggacctggcgttcctcttgtggtgcagcagctacgaggtcgtaccagtcccgaggtgcagtctggngcgagtcgtggggctggaggtagaaagtacgccgtgggtcctggtagtaacggtctccngagaaggtcttcgaggtacggcctaccgttctcgagtctatgttcttttaggttgggacncgaacgtcgcccgtaggaacctaaggtcttaggacggtggcgtagggaggatccgacttaccctagttcgtttggcacgttaacgtacggtaaactacggaaccctaagtaaggtaaccgtttagaacgaacgtagacgttacaactaccggttaccgaaggaactaacgaccgaagaagtaccaagttccaatacgacggncgaggacgaggttcgacgaggaacgtataccggtaanaacggacctaacggtcttaaacggtctttaacgttccgttaggacccgttacggacgtacccggttccaggttaaccctttaaggtctaaccggtaccttcccc

SEQ ID NO: 291623 - DNA, 898 bp, Homo sapiens
  misc_feature: GYAE6OF01CO26X.44.36.D03.1.454.CMB.1.raw
tcagacagtatatacacgaccggtgctcgatttagctgcgtcacgatctctcgttgggggggagacgagcccagcactggaagtcgccggtgtttccattcggtgatcatcactgaacacagaggactcaccagtggtactttgggcttgagtagtttcggggtttttccctcggttgtcctttacgttttttaaggagggttcggaccctaggttggtcgaagggttcggccgtaaggtcgttagggtcggggtacggttggtagggggggaaggacggccgggcccctaggcccgtacggggtaaaccctccccggtaggtaccgtaccttccgttccgtaggtcgaccgacgtcccgttacgtagggtactttaccgtaacgttcctttaccgaacggtaccttacgtacggccctaacgtcgaccgtaccggttccggggtacccgcccgtagggtcccgtccgggaaggacggggacgggtcggtaggggtaacggtgggacgtacttaaattaacgtagtacgaaaggtaacgtaggtaaggtaacgttaggaaacgtaacgacgtaacgggactacggtacggacggacggtccgtacgtacccgtaccgtccgtaaccggtagaacgtaaccgtaacgtaccgaacggtaaccacgtacgctaaccgtacgttacgtaaccgtaaccgttaacgtaacccgttaaaccctaaaccggttaaccgtaaccgtaacgggtaacggggttaaccggaaacccggttaccggtttacggttaccgttttaacccgtttaaggttttacggttaccggtaacggtaaaccccggtccggttaacccccggccccgggtttaacccgggtaccgggttccccccgggttaacccgg

SEQ ID NO: 291624 - DNA, 751 bp, Homo sapiens
  misc_feature: GYAE6OF01E12PV.44.36.D03.1.454.CMB.1.raw
  modified_base (227)..(227): a, c, t, g, unknown or other
  misc_feature (227)..(227): n is a, c, g, or t
tcagacagtatatacacgaccggtgctcgatttagctgcgtcacgatctctcttggggcagagctctggggagaactgctcagttaggacccagacggaaccatggaacgccccagcgcagcttctcttcctcctgctactctggcctcccagactaccgactggaagaatagtgatcgacgcgtctccgagcccaccgtgtctgtcgtccgtacgaaggggaaacnccgtcccgtacccttctccgtcggacgtacgggcctagtccgaaggtcgttacgtacgcgacgtacctaactttaccgcccgtacgtaaccaagacaacggtaaactccgtacgggccgtacggtccctacccgaggtaccctaccttccaagttccgttagtccggtacgtcctaaccgcccgtaaccggacggtccctaacggttccgtacccgtaccgtacggtccggtaacggttcgacgggtaccggttcgacgggtttcgggtcggtacgggtaacctacggttaccttaccgtactaccgtacgtaaccgtacctacgttacgacggacggtaccggtacggtaccgccgtagggtacggtcttacgtcggtaacgttagtttaaccgttacgttacggtacaaggtccgttaagttggttacggtccgtacttacccggcgttagggacccggttccgggaacgtaaccgggtaacgtaaacggtaacgtaaaccgaacgtaaaaccgtgtaacgg

SEQ ID NO: 291625 - DNA, 902 bp, Homo sapiens
  misc_feature: GYAE6OF01BKP7R.44.36.D03.1.454.CMB.1.raw
  modified_base (169)..(169): a, c, t, g, unknown or other
  misc_feature (169)..(169): n is a, c, g, or t
  modified_base (454)..(454): a, c, t, g, unknown or other
  misc_feature (454)..(454): n is a, c, g, or t
tcagacagtatatacacgaccggtgctcgatttagctgcgtcacgatctctcgttgggagctctgagagcggacgccccagccccagaacttcccgaggttgttttcagtttggtagactcagcactagaaacacgaggacgtactacaccgagtcggtacggttcggngtggagtcgtttcgggttttccttgtttagtttaactttacgaggttcgtaccgaggtagtagtaaggtcgacgttaggttgggacgggaacgggtaccggggggaattaccgttcgggtacccgtaacgggtccggtacggggtaccgggttacccctaggtaaccgtaccgttccgttaccggtcgttccgtcccggtcccttaggtaccggtaacttacccgaccgtacgttacgacggtaccgtaccctactagttaccggcggtacgttccggaccgacncgggtaccgtacggggaggggtacggtcggtacgggtacggtcgggtaccgtacgggaacccggtaaagtaaaaacgggtaaaaccttagggttaacccgacgtttaaacggttcctttaaggaacccgtaaggtaaacgtccgggtaaccggtcccggtacggttacggtacggaaacggtaacgtacccgtacggttaactccccgtaacccgttacgtaaaccgaggtacgttaacgtacggtaactacgtaacgtacctaaggtctaaggttccgtatacggaaccttaaagaacccttaaccggtaaaccccgaaggaaacccgtaagggtagacccggttaagttaacgttaccgttttaagttcggtttaaggttacggtttttaacgttaacgttaccggtactaaaaccggtcccggttagttaccccgggttacccgg

SEQ ID NO: 291626 - DNA, 870 bp, Homo sapiens
  misc_feature: GYAE6OF01CJKGQ.44.36.D03.1.454.CMB.1.raw
  modified_base (482)..(482): a, c, t, g, unknown or other
  misc_feature (482)..(482): n is a, c, g, or t
tcagacagtatatacacgaccggtgctcgatttagctgcgtcacgatctctcttggggagctctgagagcggagccccagccccagaattcccaggttgttttcatttggtgatcagcactgaacacagaggactcaccatggagttcgggctgagtcttgggttttccttgttgtttatttacaaggtgtccagtagtgaagtgcgtaggttgggtgggacggtccggggggatacgttcgggtaccaggtccgtagggaccgggttccctaggacgaccttctccgttgtcgttccgtccttcgtggtaacttccgaacctactcgtacgtacgacctacgttataacgtcggacggttcgggtacccgtccgaggtccgtaccggaggggtacgggtcgtagggtaggtcgggtacgttcgggaccgtaacgtaaaacggtaaaaaacgtaacggttccgaacgtacgttacctttaanaccgtaacgtaacggtaacggttacccggccgtaccgttacgtacggttaacggaaaccgtccgttaacggtaccctttaccccgacccttcgtaaacgaacggtactaacggttaacgtaacccttaacggaaaccgtaaccgttacgtaagttttaccgtaactttaccggtacggtaaccgttaaacggttaaccgttaaaccccgttaaaaccggtaacccggtaaaaaccccggggtaccggtaaaccgggtacccgggtaactttaaaccggtttacggttttaaagttttacgggttttcggtttacggtttttaaaggtttccgtttttaaaagtcgtttaaagggtaacccggttaaccggttcccgttaaccccgggg

SEQ ID NO: 291627 - DNA, 719 bp, Homo sapiens
  misc_feature: GYAE6OF01ES4HZ.44.36.D03.1.454.CMB.1.raw
  modified_base (196)..(196): a, c, t, g, unknown or other
  misc_feature (196)..(196): n is a, c, g, or t
  modified_base (352)..(352): a, c, t, g, unknown or other
  misc_feature (352)..(352): n is a, c, g, or t
tcagacagtatatacacgaccggtgctcgatttagctgcgtcacgatctctcttgggggggagacgagcccagcactggaagtcgccggtgtttccattcggtgatcatcactgaacacagaggactcaccatggacttttgggctgagatgggttttcctcgttgctcttttaagaggtggccaggtgtcaggtncagctagtggagtcgtgggggagagccggcccagcctgggaacctccctgacgactctcctggtcgcagcctgtggattcatcttcgaggacctatcgccatgcacgtcgggcctcgagcctcgaggcgagggtctggaggtgggtgactaattanatacgaagaagtagtaggaattaggaaaacgtaacgtacgtaacgggaacgtaccgtaccggaacggaacggggaccgtacgttaccgtacccggtaccgtaccgaaggaacgtaaccgtaaacgttacccgaaacggaacctaacgtaacgtacggacctaacgttaccgtaacgtaaccgtaaacgttacgtaaaccctaaccgtaaccgaacgtaaacggtacgggtaaccgggaaccggtaaccgggttaccgttaacggtttacgttaacgtttacggtttacggtaccggaccgggtaaccggtaccccgggtacccccccggtaacgggtaacccgggtacccccggggttaacccccgg

SEQ ID NO: 291628 - DNA, 719 bp, Homo sapiens
  misc_feature: GYAE6OF01DQC5K.44.36.D03.1.454.CMB.1.raw
  modified_base (115)..(115): a, c, t, g, unknown or other
  misc_feature (115)..(115): n is a, c, g, or t
tcagacagtatatacacgaccggtgctcgatttagctgcgtcacgatctctcgttggggagctctgagagcggacgccccagccccagaacttcccaggttgttttcatttggtnatcagcactagaacacgagaggacctcaccagtggagttcggctgagtcgttggttttccttgttgtttatttacgaggtcgtcgagtagtagagtgcgtaggttgggtcggacggtccggggatacgttggccagtccgtagggacggtcctgacgtactctacgtgtcgtccgtacctcgtcgtactccgacctatacgacgtacgacctataacgtacggtcggtaccggttccgggccgaccggacggtaccgtaccgggaggggacgggtcgtagggtacggtggtcgttacggaccgtaagtaaacgtaaaacgtacggtcgacgtagttactttacacgaacgtagacgtcccgcgtcggttacgtacggacgtaacgccgttaacgtaccctaccctacccgtacgtaacgaacgtacgtaacgttacgttaacgtaacgtaactacctattagtacgttataccgtgaactaacgttaacaaaccgttaaccggtaagaaaccggccgaaccggtaccgtaattaacgtttgtttaatttacggttgtttaggttatttacgttatacgtaccggttagtacgttcggtaaccgg

SEQ ID NO: 291629 - DNA, 804 bp, Homo sapiens
  misc_feature: GYAE6OF01E4KS6.44.36.D03.1.454.CMB.1.raw
  modified_base (296)..(296): a, c, t, g, unknown or other
  misc_feature (296)..(296): n is a, c, g, or t
  modified_base (420)..(420): a, c, t, g, unknown or other
  misc_feature (420)..(420): n is a, c, g, or t
tcagacagtatatacacgaccggtgctcgatttagctgcgtcacgatctctcttggggatcacataacaaccacactcctcctctaaaagaagccccgtgggagcacagctcatcaccatggactggacctggtccggttccttcgtttggtggtggcagcagctacgaggtcgtaccacgtcccgaggtcgcagtcgtgggtcgcgtacggtcggtgggtctaggaggtagaacgacgtccgtcgggtccgtcgggtagtaacgttcctccgtagaccgtaaggtcctttacggngggtacgtacccttacctttcgttacgacgttacgttagttcgtttaccgtttttaggttcgggtacgacccggtaacggtacccggtccccggtaaggaaccgggtacgggttcgttacgggnggtcgggtcgggtaaggggtacggtactaccgtaccttccgttagtttcggttgactacgtacgtaacgtacgtacgacgtaacgtagttaacgtcgaacggtactaacggtactaccgaaccgtaccggttaaccggacggtaaaccgtacgtacccgaagggtaacctaccgaacggtacccttaaggtaaccggtacggtaccgtacggtacgggtaaccggtacggtaacggtcccgtaaggtaaccgttacggtaaccgtaacgggaacgtcccgtaacggtacctttaacttaccggtttagtccgggtacggacggtacggaccgtacccgtttacccgtacgttaaccttacgttccgtaacgttcccgttaaccc

SEQ ID NO: 291630 - DNA, 994 bp, Homo sapiens
  misc_feature: GYAE6OF01DY2KJ.44.36.D03.1.454.CMB.1.raw
tcagacagtatatacacgaccggtgctcgatttagctgcgtcacgatctctcttggggagctctgagagcggacgccccagccccagaattcccaggttgttttccagttttggtgatcagcactgaacacgagaggactcaccagtggagttcggctgagtcgttgggtttttcttagtttgttttatttacgtaaggtcgtccgagtagtgaagtgtcgtaggttgggtaggggacggttccggggggagtacgtttcggtccacgtccggttagggtaccggggttcccctggacggtaccgttcttcccgttaggtcgttccggtcctcgtacggtactttacccaacctaactaccgtacgtacggtaacccctaacttaacgtaaacgttcgggtaccggttccgggggtccccggaccggaacggtccgtaccgggaaggggtaacgggggccgttaggggaggttcgggtaccggttcgggaaccgtaacgtaaaacgggttaaaaaaactaaggggttacccgacgtaacggtaaccgtttttaacgacccaaacgtaacgggtaaacggtacccggtacccggttacggttacgtaacggttaaggaaaaccgtcccgtaaacgggttaccgtttaacccctaccccctacgttaaacccgtaaagggtagggttaaccttaacgtaacccgttttaaaccgaaaagggtttaaacccctagttaacggttagtttaacgtttacggtacgttaaaccgggtaaacgttaaaccgttaaaccccgttaaaacccgttaaaccgggaaaaaacccgggacggtaaacccgggtaaacccggggttaacttaacggttaagggttttaactttttaaggttttccgggttttaaagggtttttggtttttaaaccgtttttaaaagtttaacccggtaaaccggtttaacgggtaaacccgtttcccggttaaaacccccgggggg

SEQ ID NO: 291631 - DNA, 745 bp, Homo sapiens
  misc_feature: GYAE6OF01CESU0.44.36.D03.1.454.CMB.1.raw
  modified_base (103)..(103): a, c, t, g, unknown or other
  misc_feature (103)..(103): n is a, c, g, or t
  modified_base (188)..(188): a, c, t, g, unknown or other
  misc_feature (188)..(188): n is a, c, g, or t
  modified_base (215)..(215): a, c, t, g, unknown or other
  misc_feature (215)..(215): n is a, c, g, or t
  modified_base (270)..(270): a, c, t, g, unknown or other
  misc_feature (270)..(270): n is a, c, g, or t
  modified_base (379)..(379): a, c, t, g, unknown or other
  misc_feature (379)..(379): n is a, c, g, or t
tcagacagtatatacacgaccggtgctcgatttagctgcgtcacgatctctcgttgggatcacataacaaccacactcctcctctaaaagacgcccctgggancacagctcatcaccatggactggacctggtccggttcctcgtttggtggtcggacagtcagctacgaggtctccacgtccaggtncaggcgtaggtgcgtgttcggacgggntggacggtaacgaagaccgtccggtacggtcgtcggacggtaacgttctcgacgngtaacgtcgttcgtaggacgtcctaccttcgtacgacgttacttacgttgtttacggtttttgtcgggttacgaccgtcggaccggtcccgtaggaacggtaccgggtntttacgggagggttcggacgggtaggggtacggtactaccgtaccgttaccttaggttcgttcggtacacgtaacgttaactaacgttcgagtaacgtaaggttcgtacggaaggtacacggtaccctacgaacctaacgggtaccgacggtaaaccgttacaaccggtaacggtaacttacgaaccgtacctaagtcgtgacgtagtacggacgacgacgtaggacgtagtacttcggtaacgactcggaccgttaacgtacgttttaccgagttttaccggaggttccggttaacccggtacgttaaccccgttcgttaaccggttaaccctttaaccctaggtccccgttaaccgttacccgg

SEQ ID NO: 291632 - DNA, 767 bp, Homo sapiens
  misc_feature: GYAE6OF01BIUQT.44.36.D03.1.454.CMB.1.raw
  modified_base (223)..(223): a, c, t, g, unknown or other
  misc_feature (223)..(223): n is a, c, g, or t
tcagacagtatatacacgaccggtgctcgatttagctgcgtcacgatctctcttggggcagagctcgtggggaggaactgctcagttaggacccagacggaaccatgggaagccccagcgcagcttctcttcctctgctactctggctcccagataccacgtggagaaatagtgatgacgcggtctccagccacctgtctgtcgtctaccggaaggggaaacncgccctacccgtctaccgtgcgacgggccaagtcgaggtagttgtacgacagacctaacttacgccttccgtaacagactaagtaacgtcgtcgggaccctagggtacctccccgagggttccctaccaccgtaacgttcgtagttcggtcgaccttacgtccccgaaccggacggtccctaacggtagggtaccctccgacggtacccgtagggttccagggtacgggacgttacgggttggggtccgtaggggtaacctacggttaacggttcctaacggtttcctaacccgtaccgtaatacccgggacgtaccgtaccggtaccgtcgtacctaacgggttccgtaacggtttaagttacggtttccgtaacgtttaacggtttactttacgttacgcgttaacgaccgttaagtacgttacgtaccgtaccgttaccgtaccccttcccggttacccggtaaccgggtaaaccgggttaccgtaaccgggtaaggtttaccggaaaggtttaaacccgtaaaggttccccgttaacggg

SEQ ID NO: 291633 - DNA, 770 bp, Homo sapiens
  misc_feature: GYAE6OF01BHDSK.44.36.D03.1.454.CMB.1.raw
  modified_base (370)..(370): a, c, t, g, unknown or other
  misc_feature (370)..(370): n is a, c, g, or t
tcagacagtatatacacgaccggtgctcgatttagctgcgtcacgatctctcgttgggggggagacgagcccagcactggaagtcgccggtgtttccattcggtgatcatcactgaacacagaggactcaccatggactttgggctgagattgggttttcctcgttgcttcttttaaggaggtggccagtgtcaggtgcagctagtggagtcgtgggggaggacgccggcccagccgtaggggaacctcccgtaggacgtacctcctccgtggtcgcctacggcccttcgttaggtaactttccgaacttccgtttacgaacgggtacccttagtccgacccagttcgcccgtacggttcggggtccccncgacgggtcctaccggagggcgtaacgggggtctaggggcggttacggggtagtacgtaaattagtacgtacgaaggaaggtagttaggaaatttacgggaaaacgaaccgtaaccggtaaacgggaaccgtacggtaacccgggaagggtaaccggggtacccgtaacgttacccgtaccccggttacctaccgaaaggaaccgtaactaaaccgttacccgaaacgaacccaaccgtacgtacgacctacgtacgtaacgaacctaagtacctaaaccgtaacctacgtaacgaaggtacggaacgtaccgaccgggtacttacggttacttaggttattaccggagtaccggaaccggtacccgtaccccggtacggaccggttaccccggtccccg

SEQ ID NO: 291634 - DNA, 809 bp, Homo sapiens
  misc_feature: GYAE6OF01DH9LS.44.36.D03.1.454.CMB.1.raw
  modified_base (106)..(106): a, c, t, g, unknown or other
  misc_feature (106)..(106): n is a, c, g, or t
  modified_base (192)..(192): a, c, t, g, unknown or other
  misc_feature (192)..(192): n is a, c, g, or t
  modified_base (231)..(231): a, c, t, g, unknown or other
  misc_feature (231)..(231): n is a, c, g, or t
  modified_base (350)..(350): a, c, t, g, unknown or other
  misc_feature (350)..(350): n is a, c, g, or t
  modified_base (602)..(602): a, c, t, g, unknown or other
  misc_feature (602)..(602): n is a, c, g, or t
tcagacagtatatacacgaccggtgctcgatttagctgcgtcacgatctctcgttgggggggagacgagcccagcacgtggaagtcgccggtgtttccattcggtnatcatcactgaacacagaggactcaccagtggtactttgggctaggagtagttcgggttttcctcgttgtctttacgttttaaggnggtcggcctaggttgtcgtagggtcgctaggtcgtaggngggtaggttccggggaggggggaggacggcccggaccacggtccggtacgggacctccgaggtacgtcctcgtctggcgccacgcttcggtagtctactattcctcgaccgtactgtcncctagtcgcctacggtccggccgaccgcggtcctacggagggaccggaggggtcgaggggtacggttggggactaactagttaactagtacgaaaggaagtagggtaagtaaagttaacggaaaagtaccgtaaacggacgggtaccgaacgggaccggtaagggaacggtaccgtaaccttacccggtaacgtaccctaacgggaacgaacgttaaaccctacggtaaacccggaacgtaaaccggaaccnccggttaacaccgttaacgtacgtaaacctaaccggttaaacctacccggtaaacccaaaccgttaccgaacggtaaccgggttaacacggtaaacccccgggtagtaccgttaacggttttattaaccggtttagtacgtaccccggggaacttaccccgggaccccgtacccgggttaaccgcccgggttaccccggttaacccg

SEQ ID NO: 291635 - DNA, 852 bp, Homo sapiens
  misc_feature: GYAE6OF01CLOMT.44.36.D03.1.454.CMB.1.raw
  modified_base (503)..(503): a, c, t, g, unknown or other
  misc_feature (503)..(503): n is a, c, g, or t
tcagacagtatatacacgaccggtgctcgatttagctgcgtcacgatctctcttggggatcacataacaaccacactcctcctactaaaagaacgcccctgggagccacagctcatccaccatggactggacctgggtcggttccttctttggtggtggcagcagcctacgtaggtcgtccacggtcccgagggtacgcaggtcgtgggtgacgcggttcggtaggggctagggaggtaggaaacggtaggtcccggttgggttcccgtcgggtaggacggttcctaccgtcgacgaacggttcttcggacggacggtccttacctttcctcgacgttcttagttcgttttacggtttttaggttcgggaccgtccgggaaccggacccgggtccccggtaaagggtaaccggtacgggttcggttaacggtcggggtcgggtaccgggtagggggtaacggtaccttaccgttaccgtttcctttacgtttcggttcgggtnacgttacgtaacgtacgttacgaacgtagtaacgttacgttacgaaggtcacgtacgtaccgtaaccgtacggttaccggaccgaacggtaacgtaaccccaaggtaaaccgttaccaaccgttaccgaaaggtcgtaccggttacgcggtaacgggaacgttccgggaacgggttacgtaaccgggtgttaacccgtacgaaacgggaacccgacgggttacccgtaacgtttaccttacggttttacggttacccgtagggacgggtaccccgttacgggtaccccggttcccttttaccgggaaacctttacgttttacccgaacccggtttttacccctccccgg

SEQ ID NO: 291636 - DNA, 697 bp, Homo sapiens
  misc_feature: GYAE6OF01EFM7O.44.36.D03.1.454.CMB.1.raw
  modified_base (147)..(147): a, c, t, g, unknown or other
  misc_feature (147)..(147): n is a, c, g, or t
  modified_base (159)..(159): a, c, t, g, unknown or other
  misc_feature (159)..(159): n is a, c, g, or t
  modified_base (587)..(587): a, c, t, g, unknown or other
  misc_feature (587)..(587): n is a, c, g, or t
tcagacagtatatacacgaccggtgctcgatttagctgcgtcacgatctctcgttggggagctctgagagcggagccccagccccagaattcccgaggttgttttcagtttggtgatcagcactagaaacagagtaggactcaaccngtggagttcggntgagtcgtttggttttcttgtttgttaagtttacgaaggtcgtacagtagtagtagtgacgtaggttgggtaggtacgggtacggggtatacggttcggtccgaggtccgtgggaccggtcctaggacgtctcctcgtgtcgtccgtcctgtcgtactcactatcgtagtactacctagttaagtcgtcgggtaccggttcgggccctacggcggtaccgtacggggaggggtaacgggtcgtagggtacggtcgccggttacggaaccgtaacgtaaaaaggttaaaacgtacgttccacgttacgttacttagaccaagtaggtaccgtacgtcgtacgtcgtaagtaacggaaccgtccgtaagttcctacccctacgttacgaacgaacgtatacgttacgtactaacgaactagtaactgttnactcgtagatactacgtaaactacggtaacgaaacgtcggaacgtcgtatacgtagttttatacggtgttagttgtttaactcgtacgtagtacgtacgttggtaaccgg

SEQ ID NO: 291637 - DNA, 828 bp, Homo sapiens
  misc_feature: GYAE6OF01DLT2F.44.36.D03.1.454.CMB.1.raw
  modified_base (178)..(178): a, c, t, g, unknown or other
  misc_feature (178)..(178): n is a, c, g, or t
tcagacagtatatacacgaccggtgctcgatttagctgcgtcacgatctctcgttgggggactcctgtcgccccaccatggacacttctttgctacacactcctgctgctcgaccctacccttcgtggttcttgtcccaggtcactgagtgtctggtctgtgcgtggtacgaacccanagacgaccctcacgctacgacctgaccacctagttccgtcgttcggtttcctctccgtacgaacgtattaagttagaaggtgggtgtagacgctacggtaccgtcccgtccgaacccggacccccggaaggggaaccggtcccgtagggtacggttcggtcgttacgacaccgtacttacttccttacgtacgtaacgtaacggtaaaaccgtaaaaccttcctaacgtaacgtaactacttacctacggtaaggaaagtaccgacgttttaaaacccggttaacctaaccgtaccgtaaaccgaaaccggtaaccctaaacccgaacggtaaacgggtaccgtaggtttacggtttatttaacgtaacgtacgaaaccctaagtaccggtaccgtacccggtcgtaaccggacaccgtacgacgtacgtaaacgttactagggtctacgggtacgaaacgggttggaaccgggaaacggtaaaaccgtaggaccgtttacggttacgttttaagttacgtttaagttaactttaaacgtccctttagtaccgtttcgggtaaccgggttccgtacgggggaaccgtaaaccgggttaaaccgggtcccggttaaccggtaccctacccggttccgtaccgttaacccgg

SEQ ID NO: 291638 - DNA, 723 bp, Homo sapiens
  misc_feature: GYAE6OF01BFWI1.44.36.D03.1.454.CMB.1.raw
  modified_base (209)..(209): a, c, t, g, unknown or other
  misc_feature (209)..(209): n is a, c, g, or t
  modified_base (292)..(292): a, c, t, g, unknown or other
  misc_feature (292)..(292): n is a, c, g, or t
  modified_base (365)..(365): a, c, t, g, unknown or other
  misc_feature (365)..(365): n is a, c, g, or t
  modified_base (372)..(372): a, c, t, g, unknown or other
  misc_feature (372)..(372): n is a, c, g, or t
tcagacagtatatacacgaccggtgctcgatttagctgcgtcacgatctctcgttgggggggagacgagcccagcactggaagtcgccggttgtttccattcggtgatcatcactgaacacagaggacctcaccatggactttgggctaggagtagttcgggtttttcctcgttgtcttacttttaaggaggtggccagtgtcgaggtncgaggtctaggtggagttcgggtagggggacggagccggccagccgtagggaacctcccgagacgtaccttcgtccgtggtcncgcgtcctacgtggtatttcacttcttcgaaggtacctatcgacctagtcgacgtccgttccgggcccgaccncggtccncggaacgggtacgggaagggcggttaagggtacgggtcggggtacgacttaaagtttgtaacacgtaaagtaagggagttaagggtaaaagtttacggaaaaccgtaaaacgtccgtaaacggggtacgaaaccggtaccggtaacgggaaaccgggaccggttaacctaccggtacgtactacggaacgtacgtaacacgttaacacgaactacgactcactaatcgtagtaaccgtaactacgtaaccaaccttaacgaccaaacggtacggacgtaccgacggtacgttcgtattacgttgtacgtagcggaaacttcccggaccgttacgccgtcccgggtaccccg

SEQ ID NO: 291639 - DNA, 797 bp, Homo sapiens
  misc_feature: GYAE6OF01CMI2C.44.36.D03.1.454.CMB.1.raw
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtcgttgggtttttccttgtttgtttatttacgaaggtcgtcagtagtagaagtgcgtaggttgggtgggacggtccgggggagtacgttcggtaccgaggtcccgtagggaccggggttccctaggacgtacctccgttccgtgttcgtccgtccttcgtggtacttccaacctatccaggtacgacctactattagtcggtacggtcggtaccgccgacggccgtaccggaggggaacgggtcgtagggaggtggtccgttcgggaccgtacgtaaaaggtaaaaacgtacggttcaccgtagttactttatacacgtaacggacggtaccgtccgtcgtacgttacgtaagaaaccgtccgtaacgtaccttacccgtaccctacgtaacgaagtaacgtaacgtacgttaaccgttaacgaaacgttaaccgttactaacgtttagtacgtttaccgtaggtaacgtaacgttaacgtaaacccgttaaaccgaacggaaaacccgggaacggtaaccggaaccggggtacttaacggttaacggtttaagttttaggtttaggttttaggttttagggtttaacgttttacgttaacgttacggtttaaaccggttaacgttccgggttaaccccggg

SEQ ID NO: 291640 - DNA, 1076 bp, Homo sapiens
  misc_feature: GYAE6OF01E4INQ.44.36.D03.1.454.CMB.1.raw
  modified_base (261)..(261): a, c, t, g, unknown or other
  misc_feature (261)..(261): n is a, c, g, or t
tcagacagtatatacacgaccggtgctcgatttagctgcgtcacgatctctcttggggcagagctctggggaggaactgctcagttaggacccagacggaaccatggaacgccccagcgcagcttctcttcctctgctactctggcctccagtactaccactagggaagaaattacggtgatggaccggtccggttacctccgacgtaccctacccgttgtccgttaggtcgtaccgtaccggaaaggggggtaaacgccncccctaccccttcgttcccgtcggaccgaccggggtacctaacggtaccgaagggttacggttacggttaacggcctaaccggtacctaaaccggtttaaccgccccgttaccgtaaccccgaaggtaccgaaacggtaaacttccggtaccgggaccgtaccgggtcccgttaccccggacgggtccccttaccgtacgtaaccgtttacgtttaccggtgggtaccctaccgaacccgtacccggtaaccgggaccggtacccgtaacggttaccgggtaacccctacccggtaaccggtaccggttaccggttaacgtacggggttaccgggtaacggttaccgggggttccgggtaccgggttaacgggggtaaccgtaccgggtttaccggttaacccgtaccgtttaaccccggtacccctaaaccgggtaaccctaccgggtaaccggtacccccggttacggttacccggttcgtaaacccgggttaccttaccgggtttaaaacggttaccgggttttaaggttttaccgttaaaccgggtttttaccggtttttaaacggttaaccgttaccgggttaacccgtaccggttaaacggttaaccgttttaaccggtaaccggttaccccggttaaccccgggtttcccccgggtaaccccccggttttaaaccccggggttaccccgggtaaaccccgggggttaaaacgggggtccccccgttaaaacgggtttaacccggggttaaaccggaaaacccccggttttaaagggtttaaacccccgggtaggtttaacccccgggg

SEQ ID NO: 291641 - DNA, 916 bp, Homo sapiens
  misc_feature: GYAE6OF01EV0JK.44.36.D03.1.454.CMB.1.raw
tcagacagtatatacacgaccggtgctcgatttagctgcgtcacgatctctcgttgggggggagacgagcccagcactggaagtcgccggtgtttccattcggtgatcatcactgaacacagaggactcaccatgggtacgttttgggctaggagtagtttcggggttttttccctcggtttgtcttttacgtttttaaaggtaggggtcggcctaggtggttcgagggttgacgtaggtcgtaggttagggagggttccggtagggggggaagggaggcccgggccccacggcccggttaggggaacccttcccgtggacgtaccttccgtccgtggtacgcgtaccgtcctttcgtacggaactttaccttattccgttacccggtaacgggaccctttaacggtccgtacccgtaagtaccggtaccggttaccgggttccgggggtaccccggccggtcgggtacccctaccgggaacgggtaccggggtaaaggggtccgggttaggggtacggggttacggggttggtaaaccttaaagttttaaccgaagttaaccggtaagggtaaaaggtaacggttaaagggttaaggttaaaccgggtaaaagaaaccgtaacccgggtaaagggtaaccgtaccggttaaccggaaacgggtaccggggtacgtaccggttaccgacccgttaccgtaccgtaagaacgaacgttaacctaccggaacgtaacgaacacgtaccactaagtacgtaacgtaactaaacggttacgaacctaaccgtactaacggtaacggtacgggaacgtaccgtaccggttaccgttacggtttacttacgttaacgttaggttacggaccgtaccggtacccggtacccccggtaacgtacccgggttcccccggtaccgg

SEQ ID NO: 291642 - DNA, 825 bp, Homo sapiens
  misc_feature: GYAE6OF01DBZRT.44.36.D03.1.454.CMB.1.raw
  modified_base (814)..(814): a, c, t, g, unknown or other
  misc_feature (814)..(814): n is a, c, g, or t
tcagacagtatatacacgaccggtgctcgatttagctgcgtcacgatctctcttggggagctctgagagcggagccccagccccagaattcccaggttgttttcatttggtgatcagcactgaacacagaggactcaccagtggagttcgggctgagtcttgggtttttccttgtttgtttattttacaaggttgtccagtagtgaagttgcgtaggttgggtgggtacgggtcccgggggagtaccgtttcgggtcccgaggtcccgtgggacggggttcccctaggacgaccttccgttccgtggtcgtccgtcccttcgtggtacttccaccagtcagtacgacctactatacgtggtacgtcggggtcccgccgacgggtccgtaccgggaagggggaacgggggtcgtaggggacggttcggggtccggtttcgggacccggtaacgtaaaaacggtttaaaaaaaccgtaagggtttaccgacccgtaaggtttcccttttaagtacccaaccgtaaacggttaaccggtaacccggtccccggtacggtttacgtacgggttaaacgggaaaacccgtccgttaaacgtacccgtttaccccgtaacccccgttacgtaaaccctaaagggtaagtactttaaaccgggtaaccctttacgaaaacgttaacccgttattagtttacggtaactttccggtacgacgtaacgttacgtaaacctaacggtaacgaaaccggacgacgacggtctagttgttaatttaggttggttagtttagttagttttaactactagtaacggtnttcggtacccg

SEQ ID NO: 291643 - DNA, 910 bp, Homo sapiens
  misc_feature: GYAE6OF01B1W1I.44.36.D03.1.454.CMB.1.raw
  modified_base (270)..(270): a, c, t, g, unknown or other
  misc_feature (270)..(270): n is a, c, g, or t
tcagacagtatatacacgaccggtgctcgatttagctgcgtcacgatctctcgttggggcagagctcgtgggggaggaactgctcagttacggacccagacggaaccagtggaacgccccagccgcagcttctcttcctcctgctactcgtcgacctcccgagactaccacgtaggaagtaaatgtgagtacggaccggccggttctacccgacgtccccaccgttggttccttggttaccggttccaacggggaaacgggggtaaaccnccgtaccccctaccccgttccgtcccggtacgggacccgtacggggacccgtaaggtaccgtaaggggttacggtttacggttaacgaccgtaaccgaacccgttaaaccggttaccgtacccgttaccggtaccgaacggaactaacggtaaacgtcccggttaccgggacccggtaccgggtaccccgtacccggaccggtcccttacccgtacgtacttaccgttatacgtagtcgacctaacctaaccgacggtaaccggtaccaccggtacccgaccccgtaacccggtaacgtaccggttacggttaccggtacggtaacgggttcccggtacggggttccgggtacgggttaccggtaccgttaaacgtccgtttaccgtacccgttcccgtaaaccggtaccgtacgtaacgtacgttaacgttaccgtacgtaccggtaccgttaagtttacggtttcgtttacggttactttacggttacttttacggtaacgttcgaccgtttacgtccgttccgtcccggtacgtcccgttccggaccggttccgggttaccgggttacccgggggaccgggtaacgggtacgggtacggtacgtacggtaccggaacggttccggtacggttccggg

SEQ ID NO: 291644 - DNA, 769 bp, Homo sapiens
  misc_feature: GYAE6OF01AQUVP.44.36.D03.1.454.CMB.1.raw
  modified_base (64)..(64): a, c, t, g, unknown or other
  misc_feature (64)..(64): n is a, c, g, or t
tcagacagtatatacacgaccggtgctcgatttagctgcgtcacgatctctcgttggggggganacgagcccagcacgtggaagtcggccggttgtttccagttcggtgatcatcactagaacacgagacggactcacagtggtacgtttgggactgagtagttcgggtttttcctcgttgtacttacgttttaaggagggtgccaggttgtacgaggttgcgagtcgtacggtgggagttccgggaggggggacggacgccggtacccgaggcccggttacgggtaacccttcccgtaggtaccgtaccgttcgttccgttggcgaccgtacgtccttacggtgtacttcaacgttacttaccgaacgtacctagtcgcctagtacgacctacggtccggtccgaccgaggtcctacggacgggacggtagggggttctaggggtaggtacggtacgttaactaagtttacgagtacgaagaggtaacgtaggtaactaagaacgaaacgtacggtaaacggcgtaacggacggaagggtacggtaccgtacgtacccgtaccgtacgtacgtaacggaactaccgtaacgtaccgaaaccgtaacaccgtacgtacgtaacgtactacgaacgtacaaacgttacgtaaaccctaacgtaaccgaacgtaacggaccggtagaaccgtacggcgttagtacttagttacggtcgtaacggaccgtaccgacccggacccgttacgggtcccggtacccggttacccg

SEQ ID NO: 291645 - DNA, 806 bp, Homo sapiens
  misc_feature: GYAE6OF01EOLYB.44.36.D03.1.454.CMB.1.raw
  modified_base (188)..(188): a, c, t, g, unknown or other
  misc_feature (188)..(188): n is a, c, g, or t
tcagacagtatatacacgaccggtgctcgatttagctgcgtcacgatctctcgttgggggggagacgagcccagcactggaagtcgccggtgtttccattcggtgatcatcactgaacacagaggactcaccatggactttgggctgagtagttgggtttttcctcgttgctttacgtttttaaaggngggtcggccagttgtcgaggtgcaggtcgtaggtgggaggtcggtggggggaggacggcggccccgagccgtacgggaacctcccgtgacgctccgtcctgtcgcacgtccctcgttacggtattctacgttcgttaccgaacggtacctagtcgaccctagtcgcccgtacgggtccggggtcccggaccgtaccggccctaccggaacgggtacgggtaaggggggtcgtagggggtacgggtgggggtacggaaccttaatttacggtaaacgtacggaaggaaaggtacgttaagggtaaacttaagggaaaaccgtaacgacgtaaaccgggtagacccgtaccgggaacggtaaccgggaccgttacgttacccgacccgtcgtaccgaaggaaccgacgtaactacggaaccgtaaacaccgaactcgacgtactacgtaggtaactaacgtacgttaaacctaaccgtaactaaccgaacgggttacgaaccgggtaaccaacgggtaccgttccgttaagttacgttaacggtttcggacggttaccggtaacccggtaccccggttaccccggtcccggggtaaacccgtccccgggttacccccggg

SEQ ID NO: 291646 - DNA, 756 bp, Homo sapiens
  misc_feature: GYAE6OF01DYPTT.44.36.D03.1.454.CMB.1.raw
  modified_base (264)..(264): a, c, t, g, unknown or other
  misc_feature (264)..(264): n is a, c, g, or t
  modified_base (629)..(629): a, c, t, g, unknown or other
  misc_feature (629)..(629): n is a, c, g, or t
  modified_base (643)..(643): a, c, t, g, unknown or other
  misc_feature (643)..(643): n is a, c, g, or t
  modified_base (686)..(686): a, c, t, g, unknown or other
  misc_feature (686)..(686): n is a, c, g, or t
  modified_base (692)..(692): a, c, t, g, unknown or other
  misc_feature (692)..(692): n is a, c, g, or t
tcagacagtatatacacgaccggtgctcgatttagctgcgtcacgatctctcgttggggggagacgagcccagcactggaagtcgccggtgtttccagttcggtgatcatcactgaacacagaggactcaccatggtagtttgggctgagtcgttcgggttttcctcggttgtcttacgtttttaaggaggttcgtcctagtgtcgaggacgtctagttggtggagtcggtgggggacgtcgtggtccgaggccgggtagtccngactaccgtctccgtggtagtacgtcccttggttcggtttaccttacgtacgtttacgtaagtttacgtttaggttttggttccaccggttcggttccgggggttccccacggtaccgggttcctaccgggaacggggtacgggaacggggggtccggtagggtcggggttacgcgtaacggttccaacggtccgttaccggaacgttagtaacgggtaagtagtaaacgtaggtttaacttacgacggtaacgtaccggttaccggtagggtaaacccgtccgttaacttaccgtaacctacgtacctaccggtaaagaccgtaaactaacttacgaaaatcttaagtcgttctagttacgtanaacgaatagaacgnggtacgaggtaacgtcgttaaccgactagtcgttatgtttacngggtgnggtacccgggaaggttctaacggaaacgggttaccgtaacggattacaaacttactgtattagg

SEQ ID NO: 291647 - DNA, 734 bp, Homo sapiens
  misc_feature: GYAE6OF01C5MBK.44.36.D03.1.454.CMB.1.raw
  modified_base (209)..(209): a, c, t, g, unknown or other
  misc_feature (209)..(209): n is a, c, g, or t
  modified_base (660)..(660): a, c, t, g, unknown or other
  misc_feature (660)..(660): n is a, c, g, or t
  modified_base (705)..(705): a, c, t, g, unknown or other
  misc_feature (705)..(705): n is a, c, g, or t
tcagacagtatatacacgaccggtgctcgatttagctgcgtcacgatctctcttggggatcacataacaaccacacctcctcctactaaagaacgccccgtgggagcacagctcatcaccatggactggaccgtggtccggttccttgtttggtgggtggcagcagctacgaggtcgccacgtcccgaggtgcgagtcgtggtcgacgnggtcggtggggctaggaggaggaacggtacggccggtcgggtcccgttgggtacggtaacggttccgtaccgtaggaacgtacggtccgttcggtacgggaccgtcccgtaccgtttctacgacggttccttaggttcgtttacggttttaggttgggttacggaccgaccggtacccggttccccggaaggtaacgagggttccgttagggtacggtcgggtacgggtaggggacgtaaccgtccgtaaccttcccgtttagttcggttacggagtacttacgtacgtacgttaccgaacgtaccgtaagtagttaccggagacgtacgtactacccgtaacgtaccggttaaccggacggtaaacctaaccgtaaccggtaacgtaacgtaaccgacgtaccctaacggagtacggactaggaccggtcgaacgggctaggaacgtacnggtaacgtggaacgacgtaccggtctagcttcgtgagtgccgtancccgtactcgtatactgtaacctcgttac

SEQ ID NO: 291648 - DNA, 915 bp, Homo sapiens
  misc_feature: GYAE6OF01CS1Y2.44.36.D03.1.454.CMB.1.raw
  modified_base (289)..(289): a, c, t, g, unknown or other
  misc_feature (289)..(289): n is a, c, g, or t
  modified_base (304)..(304): a, c, t, g, unknown or other
  misc_feature (304)..(304): n is a, c, g, or t
tcagacagtatatacacgaccggtgctcgatttagctgcgtcacgatctctcttggggagctctgagagcggagccccagccccagaattcccaggttgttttcatttggtgatcagcactgaacacagaggactcaccagtggagttcgggctgagtcgttgggtttttcctttgtttagtttatttacgaaggtgtccgagagtgaagtgcgtaggttggtggacggtccggggagtacgttggtccgagccgtgggacggtcctaggacgcttctcgtgtcgtccnctcgtgtactcaccntcagtcacactatacgtaggacgtcgggtaccgcgacggcgtacgggagggaacgggtcgtgggtaggtcggtaccggttacggaccgaacgtaaaacggttaaaaacgtaacggttccgacgtacgttacgttatacaacgtacggacgtaccggtaccgtcgtcgtacggtaacggaacctacccgtaagttacccgttaacccctacccgtttaccgaaaccgtaaagggtaacgtaccgtttaaacggtacccctttaaaaccgggtaaacccgttaacccgttaaaccggttagtttttaaacggttaaccccgtttttaaccgaaccggggttttaaaacccgtaacgttttaaaacccggggttaaaaccccgttttaaaaccccgggaaaacgggaaaaaaaccccccgggggtttacgggaaacccccgggtttaaaaccggggtacttttaaaaacgggttttcgggtttttaaaccgtttttaaggggttttcggtttttaaaggtttttaaccgggtttttaagtttttaaaccgggtaaacccgtttaaggggttaaaaccccggttcccggtttaacccgggttaaccccccggggg

SEQ ID NO: 291649 - DNA, 842 bp, Homo sapiens
  misc_feature: GYAE6OF01DSUJL.44.36.D03.1.454.CMB.1.raw
  modified_base (147)..(147): a, c, t, g, unknown or other
  misc_feature (147)..(147): n is a, c, g, or t
  modified_base (662)..(662): a, c, t, g, unknown or other
  misc_feature (662)..(662): n is a, c, g, or t
tcagacagtatatacacgaccggtgctcgatttagctgcgtcacgagtctctcttgggggactcctgtgccccacagtggacactctttgctacacactcctgctgctgaccacccttcctgggtcttgtcccaggtcacctgaagngtctggtcctgtgctggtacgaaacccacgaggacgaccctcaacgctcgacctcgcacccatcgtcgttgggttctcctactacaaacgtattattaaggaacgttgggtgtagagtcgtggacttccggtacaccggacccccgaaggggaacggtcccgttagggacggtcggtccgttggaccaactacgtacgttcctttacgtaaccggtaagtacgggtaaaacctaaaaactccgttaaacgaacgttaactaacgttctaacgtaaggaaacgtaacgccgttaaacggtttaacccattacccgtaaccgaaacggtaaccctaacccgttaaaccggaaaaaggttcggtaaacgggttttcgggtttaaccttttaacggttaacgtaaccgggtaaaaccctaaaccggttaaggtaccccgggttaacccgttacggaaccgtaaaccgaacggtacggactaacgtaattaccgttacgtgtacgacggtaaggtaacgngggtaaacgaaacgtaagtacgtacgtttaccggttaagtacgtttaaacgttaactttaacgttacccgttaacgtaacgttaccggtagggttacccggttagggtaaccggggtaaacgtaaaaccgggtacccggttaaccggaccccgttacccttccgttacccgtaaccccgg

SEQ ID NO: 291650 - DNA, 719 bp, Homo sapiens
  misc_feature: GYAE6OF01AQP91.44.36.D03.1.454.CMB.1.raw
  modified_base (165)..(165): a, c, t, g, unknown or other
  misc_feature (165)..(165): n is a, c, g, or t
  modified_base (214)..(214): a, c, t, g, unknown or other
  misc_feature (214)..(214): n is a, c, g, or t
  modified_base (223)..(223): a, c, t, g, unknown or other
  misc_feature (223)..(223): n is a, c, g, or t
tcagacagtatatacacgaccggtgctcgatttagctgcgtcacgatctctcgttggggagctctgagagcggacgccccacgccccagaacttcccgaggttgtttttctagtttggtgatcacgcactcgaacacgagacgactcacagtggtagtttgctgngtcgttggttctcgttgttagttaacgtttaagtcgtcgtaggtgtggnggtgcggtntggtgtggtgtcgtagggaggacgtcgttacgcggcggtccgggtcgggcagacgtctcctcgtcgcgcgtactcgtcgcgtcacctacgcgacgcacgacgtaactggtacgtacggttcgggtccggtccgcggtacggtaccggtacgggaacggggacggtggtacgggtacggttcggtacctagtacgtttacgttacgtttacgtacggtttaggttcttaacccgttataaccgtactaccgtacgtacgttaaccggttacgtacggaacggtaccggtaccttaccaccgtactacgtccgtaaacgtacgaacgttaccgtacgtaacgttacttacgttacttaacgtaacaacggtttaacaacccgtagtaaccgacggtcgtaaccgacgtaatcccggttactaacgtcgttaggtcgaacgaggacgtaaccggttcggcgttaccgtgggttaaggtttctttaggtttcgtttaacg

SEQ ID NO: 291651 - DNA, 922 bp, Homo sapiens
  misc_feature: GYAE6OF01C5LDR.44.36.D03.1.454.CMB.1.raw
tcagacagtatatacacgaccggtgctcgatttagctgcgtcacgatctctcttggggatcacataacaaccacactcctcctctaaagaagcccctgggagcacagctcatcacatggactggacctggcggttcctctttgtggtggcagcagctacaggtcgtaccacgtcccgaggtgacaggtctgggtcgacgtaggtcggtcgggggtcgtggaagggtaggaaaggaacggtccggttcggggttccgtacgggtaggtaacggtcctaccgcggacgtaacggtcctttacggtacgggacggtacctaccgtttccgttacgtacgtcttacgttcgtttacgtttttaggtttcggggtcgtacccggtacggtaccggtccccggtagggaacggtaacgggtccgtttagggtacgggtcgggtaccgggtaggggacgggtaccgtacctacccgttaccgtttacgtttcggtttagggtcgtaccgtaagtacggtaacgttacgtaacgacggtaacggttaaacggtttaccggaacggtaacgtacgggtaaccgtaacccgtaacccgttaacgggttaaccccgggaccggtaaaacccggttaacccgtacccggtaaaccggtaccgtaaccgtaccgtacccgttaaaacgtgggttaacccgggagttccgggaaacgggttacccgggaaggtaccggggttaaacggtacgggtaacgttacggttaaccgtaacggggaacccgtacccgggtaacccggttaccaaccggttttcctttaagttttccgggtaggggtaccgtaacccgggtaccgggttacccttaccccccgttaacgggttttaccctaacccgttttaaccggaacgtttttccccccggtttaacccg

SEQ ID NO: 291652 - DNA, 791 bp, Homo sapiens
  misc_feature: GYAE6OF01CSSAC.44.36.D03.1.454.CMB.1.raw
  modified_base (124)..(124): a, c, t, g, unknown or other
  misc_feature (124)..(124): n is a, c, g, or t
  modified_base (209)..(209): a, c, t, g, unknown or other
  misc_feature (209)..(209): n is a, c, g, or t
tcagacagtatatacacgaccggtgctcgatttagctgcgtcacgatctctcttggggagctctgagagcggagccccagccccagaacttcccagtgtttcattggtgatcagcactgaacanagagactcactatggagttcggctgagcgttgggttttcttgtttgttatttacgaggtgtccagtagtgaagtgcaggttcggnggacggtccggggatccgttggccagccgttagggcggtccctggacgactcgtccgtggttccgtacgtccttcggtacggtaccttaccgacctacggtacctaacggttcggaaccccttaacgttaagttacgggtcggtaaccggttcggggtccccggacccgtaacggggtcccgttaacccgggaagggggtaaccggggtccttaggggacggttcgggtccggttacggggccccgaacgtttaaaaaggtaaaaacccgtaaagggttcggacccttaacggttacctttaagaccgaacgtaggtaaacccggtccgtaccgtccggtagtggtacgaacgtccgtaagtaccttccctaacccttacgtaactaacggagttaaccgtacgtaaccgtaaacaacggtaacctacccgtaagtttacgtaccgttgtaccgtaacggtataacgttaaaccgtaaccggacgaaaaccgggtcgaaccggtaacgtcgtagtaaccgttatttaggttacgtttggttcgttagtttacttcgggtactagggtacctcggttacccgg

SEQ ID NO: 291653 - DNA, 512 bp, Homo sapiens
  misc_feature: GYAE6OF02G9WWJ.44.36.D03.1.454.CMB.1.raw
  modified_base (302)..(302): a, c, t, g, unknown or other
  misc_feature (302)..(302): n is a, c, g, or t
  modified_base (376)..(376): a, c, t, g, unknown or other
  misc_feature (376)..(376): n is a, c, g, or t
tcagacagtatatacacgaccggtgctcgatttagctgcgtcacgatctctcttggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggcccagcctgggaactccctgagactctcctgtgcagcctctggattcatcttcaggacctatgccatgcacgtgggtcccnccaggctccgaggcaaggggctgggagtgggtgcaattatatcagaagatggaattgaaagaacacgtacgganactcgagaagggccgattcaccgtctcagagacaattccgagaacacactgcatctagacaaatcgtaaccaacctcacaagtgaaggacacggctgtctattattgtgcgacgacgccccgtgacggcgtccccg

SEQ ID NO: 291654 - DNA, 521 bp, Homo sapiens
  misc_feature: GYAE6OF02HBDBK.44.36.D03.1.454.CMB.1.raw
  modified_base (216)..(216): a, c, t, g, unknown or other
  misc_feature (216)..(216): n is a, c, g, or t
tcagacagtatatacacgaccggtgctcgatttagctgcgtcacgatctctcttggggcagagctctggggaggaactgctcagttaggacccagacggaaccatggaagccccagcgcagcttctcttcctcctgctactctggctcccagataccactggagaaatagtgatgacgcggtctccagccaccctgtctgtgtctccaggggaaangccaccctctcctgcagggccagtcagagtgttagcagcaacttagcctcgtaccagcagaaatctggccaggctcccaggctcctcatctatggtgcatccaccagggccacgtggtactcccagcccaggttcagtggcaggtgggtctgggacagagttcactctcaccatcagcagcctgcagtctagaagtatttgctagttttattacgttgtcagctagtatagtgactcggtccttccgttctaccgtttccggcccgttcgggaccctacgtacgtccgtatttaccgtaaaccgg

SEQ ID NO: 291655 - DNA, 527 bp, Homo sapiens
  misc_feature: GYAE6OF02GG5FR.44.36.D03.1.454.CMB.1.raw
  modified_base (216)..(216): a, c, t, g, unknown or other
  misc_feature (216)..(216): n is a, c, g, or t
  modified_base (372)..(372): a, c, t, g, unknown or other
  misc_feature (372)..(372): n is a, c, g, or t
tcagacagtatatacacgaccggtgctcgatttagctgcgtcacgatctctcttggggcagagctctggggaggaactgctcagttaggacccagacggaaccatggaagccccagcgcagcttctcttcctcctgctactctggctcccagataccactggagaaatagtgatgacgcggtctccagccaccctgtctgtgtctccaggggaaangccaccctctcctgcagggccagtcagagtgttaccagcaacttagcctggtaccaccagaaacctgggcaggctcccaggctcctcatctatggaacatcccaccagggccactggtactcccaccaggttcagtggcaggtcggggtccggganaggagttcactctcaccatcagcggcctgcagtctgaggtattttgcttagtttattacttgtctagctagtataataactgcctctctacgtttcgggcgggggaccgagggtggagtacgtacgaacgacgtggtcggcgtggcaccgattcg

SEQ ID NO: 291656 - DNA, 542 bp, Homo sapiens
  misc_feature: GYAE6OF02I14DR.44.36.D03.1.454.CMB.1.raw
  modified_base (217)..(217): a, c, t, g, unknown or other
  misc_feature (217)..(217): n is a, c, g, or t
  modified_base (418)..(418): a, c, t, g, unknown or other
  misc_feature (418)..(418): n is a, c, g, or t
tcagacagtatatacacgaccggtgctcgatttagctgcgtcacgatctctcttggggcagagctctggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaanagcccaccctctcctgcagggccagtcagagtgttagcagcaacttagcctcgtacccagcaagaaatctggccaggctcccgaggcctcctcatctatggtgcatccaccagggcccacgtggtactcccagactaggttcaggtgcaggtgggtctgggacagtactcactctcaccatcacgcgctgctgtctgagtntttgcttagtttattactgtacagtactagttagtagttgtacgttcggtcccgttccgttacctaccggtttccggcccgttcgggaccctacggtacgttccgtaactttccgaaacgtacg

SEQ ID NO: 291657 - DNA, 530 bp, Homo sapiens
  misc_feature: GYAE6OF02GKKQG.44.36.D03.1.454.CMB.1.raw
  modified_base (347)..(347): a, c, t, g, unknown or other
  misc_feature (347)..(347): n is a, c, g, or t
  modified_base (373)..(373): a, c, t, g, unknown or other
  misc_feature (373)..(373): n is a, c, g, or t
  modified_base (388)..(388): a, c, t, g, unknown or other
  misc_feature (388)..(388): n is a, c, g, or t
  modified_base (480)..(480): a, c, t, g, unknown or other
  misc_feature (480)..(480): n is a, c, g, or t
  modified_base (489)..(489): a, c, t, g, unknown or other
  misc_feature (489)..(489): n is a, c, g, or t
  modified_base (514)..(514): a, c, t, g, unknown or other
  misc_feature (514)..(514): n is a, c, g, or t
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgtgggttttccttgttgttatttacaaggtgtccagagtgaagtgcagttggtggagtccgggggagacttggtccagcctggagggtccctgagactctcctgtgtcgcctctggattcaccatcagtgaccactatatggactgggtccgccaggctccgaggggaggggctgggagtggcttggccgnaagtaaaaacaagttgccagctttancacagagtacgccgngtctgtagaaagccagattccaccctctacaagagatgacttcaaagtaactcaatttgattctgacgtaatgaactaacctagaaaaccgngacacgggnagtgtaattattgtgttgtgtttanagtcaggtactgtacc

SEQ ID NO: 291658 - DNA, 530 bp, Homo sapiens
  misc_feature: GYAE6OF02F37L8.44.36.D03.1.454.CMB.1.raw
  modified_base (426)..(426): a, c, t, g, unknown or other
  misc_feature (426)..(426): n is a, c, g, or t
tcagacagtatatacacgaccggtgctcgatttagctgcgtcacgatctctcttggggatcacataacaaccacactcctcctctaaagaagcccctgggagcacagctcatcaccatggactggacctggcggttcctctttgtggtggcagcagctacaggtgtccagtcccaggtgcagctggtgcagtctggggctgaggtgaagagcctgggtcctcggtgaaggtctcctgcaaggcttcgtggaggcaccttcttcagctatgtctttttagtttgggtgcgacgacggcccctggacaagggcttgagtggcgtgggaggatcatccctattcgtttggtgctatcgtaattacgcacagtaagtttcgagacagagtcacagtaccgcgacgatccagagtacagcctacagtggancgtagacgcgaggcgtagagtatcgtagaacgacgacgacctattcttagtttcgtgtcggacgtagtacgcccgttcgtacctactttcacgttccgttaccc

SEQ ID NO: 291659 - DNA, 499 bp, Homo sapiens
  misc_feature: GYAE6OF02GS1DC.44.36.D03.1.454.CMB.1.raw
  modified_base (339)..(339): a, c, t, g, unknown or other
  misc_feature (339)..(339): n is a, c, g, or t
  modified_base (427)..(427): a, c, t, g, unknown or other
  misc_feature (427)..(427): n is a, c, g, or t
tcagacagtatatacacgaccggtgctcgatttagctgcgtcacgatctctcttggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtctgggggagagcggcccagcctgggaactccctgagactctcctgtgcagcctctggattcatcttcaggacctatgccatgcactgggtccgccaggctccaggcaaggggctgggagtgggtggcaattanatcagaagatggaattgaagaacactacggagactcgagaagggccgatcaccgtctccagagacaattccaggaacacactgcatcngcaaatgtacaacctcacaagtgagacacggctgtctattattgtgcgagacgcccctcgacgcggtccccg

SEQ ID NO: 291660 - DNA, 547 bp, Homo sapiens
  misc_feature: GYAE6OF02IK874.44.36.D03.1.454.CMB.1.raw
  modified_base (426)..(426): a, c, t, g, unknown or other
  misc_feature (426)..(426): n is a, c, g, or t
  modified_base (432)..(432): a, c, t, g, unknown or other
  misc_feature (432)..(432): n is a, c, g, or t
  modified_base (437)..(437): a, c, t, g, unknown or other
  misc_feature (437)..(437): n is a, c, g, or t
  modified_base (452)..(452): a, c, t, g, unknown or other
  misc_feature (452)..(452): n is a, c, g, or t
tcagacagtatatacacgaccggtgctcgatttagctgcgtcacgatctctcttggggatcacataacaaccacactcctcctctaaagaagcccctgggagcacagctcatcaccatggactggacctggcggttcctctttgtggtggcagcagctacaggtgtccagtcccaggtgcagctggtgcagtctggggctgaggtgaagaagcctgggtcctcggtgaaggtctcctgcaaggcttctggaggcaccttcttcagctatgctttttattgggtgcgacaggcccctggacaagggcttgagtggctgggagggatcgatccctatcttggtgcatcgaattacgcacagtaagtttcaaggtacagacgttcaacctagttacccgacggtacgaatcccaacgagtacagcctanatgganctgancaggctagagacttntaggaaagccgacgggcccattccttacgttttctaggtggaccgtaaggaccgtcccctacggttacctaaccttttcacgttaccgttccccg

SEQ ID NO: 291661 - DNA, 576 bp, Homo sapiens
  misc_feature: GYAE6OF02ITAWI.44.36.D03.1.454.CMB.1.raw
  modified_base (219)..(219): a, c, t, g, unknown or other
  misc_feature (219)..(219): n is a, c, g, or t
  modified_base (304)..(304): a, c, t, g, unknown or other
  misc_feature (304)..(304): n is a, c, g, or t
  modified_base (371)..(371): a, c, t, g, unknown or other
  misc_feature (371)..(371): n is a, c, g, or t
  modified_base (386)..(386): a, c, t, g, unknown or other
  misc_feature (386)..(386): n is a, c, g, or t
  modified_base (414)..(414): a, c, t, g, unknown or other
  misc_feature (414)..(414): n is a, c, g, or t
  modified_base (440)..(440): a, c, t, g, unknown or other
  misc_feature (440)..(440): n is a, c, g, or t
  modified_base (473)..(473): a, c, t, g, unknown or other
  misc_feature (473)..(473): n is a, c, g, or t
tcagacagtatatacacgaccggtgctcgatttagctgcgtcacgatctctcttggggagctctgagagcggagccccagccccagaattcccaggtgtttcatttggtgatcagcactgaacacagaggactcaccatggagttcgggctgagctgggttttcctgttgttatttacaaggtgtccagagtgaagtgcagttggtggagtccgggganacttggtccagcctggagggtccctgagactctcctgtgtcgcctctggattcaccatcagtgaccactatatggactgggtccnccaggcctccgaggggaagggctgggagtggcttggccgacaagtaaaaacagttgaccagctttancacagagtacgccgngtctagtagaaagccagattcaaccctntacaagagatgacttacaagtaactnattgatttcgagcaaattgaacctttaaaccgngaaaaaacccgtggaaccctacgggactaacgttggttaatttagttacggtggttttagtaaggttttaactaagttccgaaagggttacttggtaaccccg

SEQ ID NO: 291662 - DNA, 531 bp, Homo sapiens
  misc_feature: GYAE6OF02IXEDA.44.36.D03.1.454.CMB.1.raw
  modified_base (345)..(345): a, c, t, g, unknown or other
  misc_feature (345)..(345): n is a, c, g, or t
  modified_base (371)..(371): a, c, t, g, unknown or other
  misc_feature (371)..(371): n is a, c, g, or t
  modified_base (392)..(392): a, c, t, g, unknown or other
  misc_feature (392)..(392): n is a, c, g, or t
  modified_base (474)..(474): a, c, t, g, unknown or other
  misc_feature (474)..(474): n is a, c, g, or t
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccgaggctccagggaagggctggagtggcttggccgnaagtaaaacaaagttgccagctttancacagagtacgccgcgtctgngaaagccagattccacctctacaagagatgacttcaagtaactcattgatttctgacgaatgactaaccgtagaaaaaccgnggaacacgggacacgtgttaattagttgtgtttgtgtttatatcgagtactgtaccg

SEQ ID NO: 291663 - DNA, 621 bp, Homo sapiens
  misc_feature: GYAE6OF02JYW9N.44.36.D03.1.454.CMB.1.raw
  modified_base (310)..(310): a, c, t, g, unknown or other
  misc_feature (310)..(310): n is a, c, g, or t
  modified_base (378)..(378): a, c, t, g, unknown or other
  misc_feature (378)..(378): n is a, c, g, or t
  modified_base (437)..(437): a, c, t, g, unknown or other
  misc_feature (437)..(437): n is a, c, g, or t
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttatttacaaggtgtccagagtgaagtgcagttggtggaggtccgggggagacttgggtccagcctgggagggtccctgagactctcctgtgtcgcctctggattcaccatcagtgaccactatatggactgggtccncaggctccgaggggacgggctgggagtggcttggcccgagaagtaaaaacgagttcgccagtctttancgaacaggacgtacgccgtcgttacgtgtagaaacgccaaggtactttccgaacccttnacgaaaggacgtactcgtacttacaaacggtaactctaagttggtaacttcgtagaccgtaatacgtaaccttaaaccggtagaaaaacccggagggtaccaccggggactaagtacggttaagtttagttacggttgtttagttggttttaacacgttaccgtaaggttaccttcgtacccgg

SEQ ID NO: 291664 - DNA, 543 bp, Homo sapiens
  misc_feature: GYAE6OF02GPEWO.44.36.D03.1.454.CMB.1.raw
  modified_base (351)..(351): a, c, t, g, unknown or other
  misc_feature (351)..(351): n is a, c, g, or t
  modified_base (377)..(377): a, c, t, g, unknown or other
  misc_feature (377)..(377): n is a, c, g, or t
  modified_base (423)..(423): a, c, t, g, unknown or other
  misc_feature (423)..(423): n is a, c, g, or t
  modified_base (446)..(446): a, c, t, g, unknown or other
  misc_feature (446)..(446): n is a, c, g, or t
  modified_base (455)..(455): a, c, t, g, unknown or other
  misc_feature (455)..(455): n is a, c, g, or t
  modified_base (482)..(482): a, c, t, g, unknown or other
  misc_feature (482)..(482): n is a, c, g, or t
  modified_base (492)..(492): a, c, t, g, unknown or other
  misc_feature (492)..(492): n is a, c, g, or t
  modified_base (503)..(503): a, c, t, g, unknown or other
  misc_feature (503)..(503): n is a, c, g, or t
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattccaccatcagtgaccactatatggactgggtccgccaggcctccgaggggaacgggctgggagtggcttggccganaagtaaaaacaagttgccagctttancacagagtaccgccgcgtctgtagaaacgccaagacttccaccctntacaagagatgacttcaagactnattgattcngcgaatcgaactaacctagaaaaccgnggacacgggnagtgttaattnttggttgtttgttagtttatatacgtaggtactgtacccg

SEQ ID NO: 291665 - DNA, 566 bp, Homo sapiens
  misc_feature: GYAE6OF02IHTCM.44.36.D03.1.454.CMB.1.raw
  modified_base (311)..(311): a, c, t, g, unknown or other
  misc_feature (311)..(311): n is a, c, g, or t
  modified_base (375)..(375): a, c, t, g, unknown or other
  misc_feature (375)..(375): n is a, c, g, or t
  modified_base (379)..(379): a, c, t, g, unknown or other
  misc_feature (379)..(379): n is a, c, g, or t
  modified_base (496)..(496): a, c, t, g, unknown or other
  misc_feature (496)..(496): n is a, c, g, or t
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaggtgtccagagtgaagtgcagttggtggagtccgggggagacgttggtccagcctgggacgggtccctgagactctcctgtgtcgcctctggattcaccatcagtgaccactatatggactggggtccnccaggctccgaggggagggctgggagtggcttgggccgcaagtaaaacaagttgccagctttancaanagagtacgccgtcgtctgtgaaacgccaagtacttccaccctctacaaggagacttgtaccttacaaagtaactcattagattctagacaatcgaaccttaaccgtagaaaacccgngaaccgacgggcaagtgttaacttagttggttgtttaggttattttaagtattacgaggtactgtacccg

SEQ ID NO: 291666 - DNA, 991 bp, Homo sapiens
  misc_feature: GYAE6OF02H82E7.44.36.D03.1.454.CMB.1.raw
tcagacagtatatacacgaccggtgctcgatttagctgcgtcacgagtctctcttggggagctctgcttcagctgtgagcgcagaaggcaggactcgggacgaatcttcatcatgacctgctccctctcctcctcacccttctcattcactgcacaggtcctgggcccagtctcgtgttgacgcagccgcccgtcagtgtctgcggccccaggacagagggtcaccatcctacctgactcgtaggaaacgtaaacccttcctaaagttaggtttagggtaaaaacttaaagttttaactaggttaaacgttcccgttaggggttaaccccaacggtaccctaaaaccgttcccccgaaaggggacgcccgtaaccggaacccccccctaaaaactttccccgttacgttaaactttttaacgtaccgggtaaaacctaaaacgttaaaacgttaaaccggacccggtaacccctttaccggaaacggggggtaacctttacccggtaacgggtaaccccgggtttaaacttttacccgttccggttaccgggtaacccttttaaccccgtaaaacggggttttccctacgggggtaaaccccttaaaccgggtttcccaaacccggggtcccccgtaaaacccccgggtttggggaaaccccccttaaggttaaccccggaaaccccggggttaacctttacccggaaacgggtaacccggtttacgggggggaaacccggtaacgggacccgttaaacgttttaaacgttacccggtacgggtaacccggggtaaacgtttacgggggaaaccttacgggaacccggttaacgggccccgttaagggaaccgggttagggacccgggtttaacgggggactttaacccggggtttacgggtttaccccgggtttacggggggacccgggggtaaaccgggggttaaacccgtaaacgggggtttcccggtaaacccggtttaaccccggg

SEQ ID NO: 291667 - DNA, 554 bp, Homo sapiens
  misc_feature: GYAE6OF02G638M.44.36.D03.1.454.CMB.1.raw
  modified_base (310)..(310): a, c, t, g, unknown or other
  misc_feature (310)..(310): n is a, c, g, or t
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggaggcttggtccagcctgggagggtccctgagactctcctgtgtcgcctctggattcaccatcagtgaccactatatggactgggtcccnccgaggcctccgaggggaagggctgggaggtgggtctcgagtctatttatacgtggtgtatttcactatactacgcagtactcggtagaacgggccattccacctatcctccgagggactaacgtccgaaggtaactacggtttatcttacaatcgaacactgagacgcgacgacacggcctactatactgtgacgagacaggtccggcgtcgtcggtagttggttatttacgttcgttgtacg

SEQ ID NO: 291668 - DNA, 515 bp, Homo sapiens
  misc_feature: GYAE6OF02GTPBA.44.36.D03.1.454.CMB.1.raw
  modified_base (331)..(331): a, c, t, g, unknown or other
  misc_feature (331)..(331): n is a, c, g, or t
tcagacagtatatacacgaccggtgctcgatttagctgcgtcacgatctctcttgggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtctgggggaggagcggcccagcctgggaactccctgagactctcctgtgcagcctctggattcatcttcaggacctatgccatgcactgggtccgccaggctccaggcaaggggctggagtgggngcaattatatcagaagatggaattgaaagaacactacgggagactcgagaagggccgatcgaccgtctcagacgacaattccaggaacacactgacatctgacaaatcgtaacaacctcacaagtgaggacacggctgtacttattattcgtgcgagaccgccccgtacgacgaccggtccccg

SEQ ID NO: 291669 - DNA, 513 bp, Homo sapiens
  misc_feature: GYAE6OF02J1WOZ.44.36.D03.1.454.CMB.1.raw
  modified_base (345)..(345): a, c, t, g, unknown or other
  misc_feature (345)..(345): n is a, c, g, or t
tcagacagtatatacacgaccggtgctcgatttagctgcgtcacgatctctcttggggatcacataacaaccacactcctcctctaaagaagcccctgggagcacagctcatcaccatggactggacctggcggttcctctttgtggtggcagcagctacaggtgtccagtcccaggtgcagctggtgcagtctggggctgaggtgaagagcctgggtcctcggtgaaggtctcctgcaaggcttctggaggcaccttcttcagctatgtcttttagttgggtgcgacaggcccctggacaagggcttgagtggcgtgggagggtatcatcccgtatcgtttggngcatcgaattacgcaacagtaagtttcagggacagagtcactattaccgcggacaactccaagtagtacacgcctacatggagtctcgagcgaggctgagtatcgtagaagacgacgacatacttagttctgtgcgagacgtccgtcgactactttcacttacgtccc

SEQ ID NO: 291670 - DNA, 266 bp, Homo sapiens
  misc_feature: GYAE6OF02FOWSE.44.36.D03.1.454.CMB.1.raw
  modified_base (263)..(266): a, c, t, g, unknown or other
  misc_feature (263)..(266): n is a, c, g, or t
tcagacagtatatacacgaccggtgctcgatttagctgcgtcacgatctctcttgggggactcctgtgccccaccatggacactctttgctacacactcccgctgctgaccaccccttcctgggtcttgtcccaggtcaccttgaaggagtctggtcctgtgctggtgaaacccacagagaccctcacgctgacctgcaccatctctgggttctctctcaacgatattagaatgggtgtgagcgggctggcaaggcgcatagnnnn

SEQ ID NO: 291671 - DNA, 641 bp, Homo sapiens
  misc_feature: GYAE6OF02FZURT.44.36.D03.1.454.CMB.1.raw
tcagacagtatatacacgaccggtgctcgatttagctgcgtcacgatctctcttgggggactcctgtgccccaccatggacactctttgctacaaactcctgctgctgaccaccccttcctgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctcgaatgacgaaaatcctacagtacatctctagaagagcagtttaaccatacctaccgaacggaccacctaacgaaaacggcgaggttacggttactttagtactacgaacctaacacgtacgacccgtggaccgacacgaggccaacgtattacttacgtggtacgaccgtaacgggtaagtacgggaacggggaaaacgaacgtacgtacgttacggttttacgtagtttaattaagttaacgttacctttacctagttacgttacgggtaccggttacggtacggggaacgtaaacggggacccgtacgggtacccgtaccggttccgtaccgtacgtacccgg

SEQ ID NO: 291672 - DNA, 782 bp, Homo sapiens
  misc_feature: GYAE6OF02IWNNU.44.36.D03.1.454.CMB.1.raw
tcagacagtatatacacgaccggtgctcgatttagctgcgtcacgagtctctcttggggagctctgcttcagctgtgagcgccagaaggcaggactcgggacgaatcttcatcatgacgtgctccctctcctcctcgacccttctcattcactgcacagggtccctgggcccagtctgtgttcgacgcaggccgccctcagtgtctcgccggccccaggaccaggacgggtcaccactcctacctgctcgtaggaaacgtaaccctcctaagttaggtttacggaaaacttaagttaatagttaactcccgttagggtaacccaggtaccaacctacccgaaggacgtccaacgaccccctaaacttcccgtacgttaatttacgtacgaaccgtaaacgttaaactaacggaccgtaacccgttacgaagggtacttccgtaggtaacccgtactttccgttacgtccggtacctttaccgtaaacgtttccgtacgggtacctaaaccggttccgaacggaccccgtaaccggtacgggaccctaacgttaacccggaacccggttaaccttaccggaacggtaaccggttacgggggaaccgtaaccgggtaccgttaacgtttaacttacccggtacgggtaccggtaaacggtacgggtaactacggacgtacggtccgtacgggacgtcgggtaacggtacgggtaacgtttccgtacgggttaccgttcggggaccgggaggtaacccggaagggttaccggtacccgttaccgg

SEQ ID NO: 291673 - DNA, 532 bp, Homo sapiens
  misc_feature: GYAE6OF02GEVDQ.44.36.D03.1.454.CMB.1.raw
  modified_base (407)..(407): a, c, t, g, unknown or other
  misc_feature (407)..(407): n is a, c, g, or t
tcagacagtatatacacgaccggtgctcgatttagctgcgtcacgatctctcttgggggactcctgtgccccaccatggacactctttgctacacactcctgctgctgaccaccccttcctgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctcgaatgacgaaaatcctacagtacatctctgagagcagttaacatctccaaggacacctccaaaagcaggtgtctttagtatgaccaacatggaccctgacgacacaggcanatattactgtgcgacgggtaatggacgggaaagaaacgagcgttaggtttctagttattataagttcttacagtcgtggacgtcgtaggggacaacgggccgtaccggtcaccggtctcctaccg

SEQ ID NO: 291674 - DNA, 643 bp, Homo sapiens
  misc_feature: GYAE6OF02GZZSN.44.36.D03.1.454.CMB.1.raw
  modified_base (372)..(372): a, c, t, g, unknown or other
  misc_feature (372)..(372): n is a, c, g, or t
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgtggtttctgttgttatttacaagtgtcagagtgaagtgcagttggtggagtccgggggagacttggtccagcctgggagggtccctgagactctccgtgtgtcgcctctggattcaccatcagtgacctactatatggactgggtcccgcaggcctccgagggagggctgggagtggcttgggccgacaagtaaaaacagttgaccagtctttancacagacgtacgccgcgttctgtagaaacgccgtaagtacttccaccctctaccaaaggagtagtacgtaaccttaccgaaagtaaacctcctaagtttagtactttaccgtaggtaccgtaaattacggaaccctttaaacccgtaaacggaaaaaccggtacgggtaaccgaccggggtacctaagtttacggttaacttttaaggttcggtttaggttttacgtttagttttagtaacgttacgtaagggttaccttaggttaccccg

SEQ ID NO: 291675 - DNA, 758 bp, Homo sapiens
  misc_feature: GYAE6OF02JS7EQ.44.36.D03.1.454.CMB.1.raw
  modified_base (160)..(160): a, c, t, g, unknown or other
  misc_feature (160)..(160): n is a, c, g, or t
  modified_base (177)..(177): a, c, t, g, unknown or other
  misc_feature (177)..(177): n is a, c, g, or t
tcagacagtatatacacgaccggtgctcgatttagctgcgtcacgatctctcttggggggagacgagcccagcactggaagtcgccggtgtttccattcggtgatcatcactgaacacagacggactcaccatggactttgggctgagatgggttttccncgttgcttcttttaagnggtggccagtgtcaggtgcagctagtggagtcgtgggggagagcggcccagccgtgggaacctccgtgacgactctcctgtcgcagcctcgtggattcattccttacgacggtacctatcgccagtcgctacgtcgggtcccgcgaggtcctaccgagggaccgaagggggtcctaggggtacggttcggggtaggaaccttaaagtttacgtaagtacgaaaggtaaagtagttacgggtaaatttaggaaaacgtaaaccgaaccggttaacgggacgtaccgtaccgggaaaggtaacggggtaccgtaacgttaccgacccggttacgtacccgaaggtaaccgaactaacgttacccgaaagggaaaccaaccgtacgttacggacctacgttaccgtacgaaccgtaaacgttaccggtaaaccctaaacccgttaccaaacggtaaacggtacggaacggaacccgtaccgggttaaccgttacggttaacctttaagttaacgttacggttacggaccggtaacggtaccccgtacccccggtacggtaaccgggtaccccgggttaccccgg

SEQ ID NO: 291676 - DNA, 696 bp, Homo sapiens
  misc_feature: GYAE6OF02JJSC4.44.36.D03.1.454.CMB.1.raw
tcagacagtatatacacgaccggtgctcgatttagctgcgtcacgatctctcttggggggagacgagcccagcactggaagtcgccggtgtttttccattcggtgatcatcactgaacacagaggactcaccatggactttgggctgagatgggttttcctcgttgcttcttttaagaggttggccagtgtcaggtgcagctagtggagtcgtgggggagagcggcccagccgtgggaacctccctgacgactctcctgtcgcagcctcgtggattccattccttcgaggtaacccttagtcgacccgtattcggcctacgttcgggtccccgaccaggggtcccttcccgaagggccgaaacgggggtcctacggggaggttcgggggtggacctaaggtccaagttcccgtggggttctaggtacgtagggtaaagtaaaagaattaccggttagtacgggtaaacctcggtaacgaagggaccgtagttccgttcccgtatcccgtaaggacgaacgtaacgttacgaaacgaaccgtaccgtagtactactaacgaaactacgaactaagtttagaacgtacgaacgacgtaacgtccggacgttcctacgtaacgtttacgttagtaaccgtacgtacccgttaacgttccgttaccgttaccggtagggacccgtagggtaccgtcccgg

SEQ ID NO: 291677 - DNA, 588 bp, Homo sapiens
  misc_feature: GYAE6OF02G04WO.44.36.D03.1.454.CMB.1.raw
  modified_base (306)..(306): a, c, t, g, unknown or other
  misc_feature (306)..(306): n is a, c, g, or t
  modified_base (345)..(345): a, c, t, g, unknown or other
  misc_feature (345)..(345): n is a, c, g, or t
tcagacagtatatacacgaccggtgctcgatttagctgcgtcacgatctctcttgggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggcccagcctgggaactcccgtgagactctcctgtgcagcctcgtggattcatcttcaggacctatgccatgcacgtcgggtcccnccgaggcctccgaggcgaaggggtctaggggaggtgggnggactaattatactcgaagaagagtagggaattaggaaagaacacgtaacggagaccgtaccggaaggaacgggccgaacttccgaccgtctaccgagaacgactaacgttaccaaggtaaccaccgactcgacacgtctagactaaacgtacgtaaccaacctacaaacgaagtagacgacgacggctgtacttagttattgtgacgacgaccgccccgtacggaccggtacccggtccccg

SEQ ID NO: 291678 - DNA, 568 bp, Homo sapiens
  misc_feature: GYAE6OF02JO9FJ.44.36.D03.1.454.CMB.1.raw
  modified_base (307)..(307): a, c, t, g, unknown or other
  misc_feature (307)..(307): n is a, c, g, or t
  modified_base (342)..(342): a, c, t, g, unknown or other
  misc_feature (342)..(342): n is a, c, g, or t
  modified_base (366)..(366): a, c, t, g, unknown or other
  misc_feature (366)..(366): n is a, c, g, or t
  modified_base (406)..(406): a, c, t, g, unknown or other
  misc_feature (406)..(406): n is a, c, g, or t
  modified_base (413)..(413): a, c, t, g, unknown or other
  misc_feature (413)..(413): n is a, c, g, or t
  modified_base (469)..(469): a, c, t, g, unknown or other
  misc_feature (469)..(469): n is a, c, g, or t
tcagacagtatatacacgaccggtgctcgatttagctgcgtcacgatctctcttggggagctctgagagcggagccccagccccagaattcccaggtgtttcatttggtgatcagcactgaacacagaggactcaccatggagttcgggctgagctgggttttccttgttgttatttacaaggtgtccagagtgaagtgcagttggtggagtccgggggagacttggtccagcctgggagggtccctgagactctcctgtgtcgcctctggattcaccatcagtgaccactatatggactgggtccncaggctccgagggaagggctggagtggcttggccncagtaaaaacagtgccagctttancacagagtacgcgacgtctgtagaaagccagattcacctntacaagngatgacttcaagaactcaattgaattctgacgaatgacttaaacctgaaaaaccgnggaaccacgggactaagttacggttaatttacgttaggttacgttttagttacggtttttaactaacgttaccaaaggggttaaccttggtaaccccgg

SEQ ID NO: 291679 - DNA, 532 bp, Homo sapiens
  misc_feature: GYAE6OF02GJCC9.44.36.D03.1.454.CMB.1.raw
tcagacagtatatacacgaccggtgctcgatttagctgcgtcacgatctctcttggggatcacataacaaccacactcctcctctaaagaagcccctgggagcacagctcatcaccatggactggacctggcggttcctctttgtggtggcagcagctacaggtgtccagtcccaggtgcagctggtgcagtctgggactagaatgccgcaaccttggtcctcggtgacccctttcctgcacggcctctggaagtactaccagttccactacttataccatcaactggtgcgccaggcccctggacaagggcttgagtggatgggtgaatcatcctcttttggctcactcacctacgcacgagacgttccggggcacgtaattacgattaccgcggacaagtccacagacacagtctccatcgacaatgagtttcttagaatccgacgacacggccgttctactactgtgcgagacggtcccgtacccgagcctcgcgagtcggcgtccgttagacgtacgtcgtacggggg

SEQ ID NO: 291680 - DNA, 747 bp, Homo sapiens
  misc_feature: GYAE6OF02I5P82.44.36.D03.1.454.CMB.1.raw
  modified_base (391)..(391): a, c, t, g, unknown or other
  misc_feature (391)..(391): n is a, c, g, or t
tcagacagtatatacacgaccggtgctcgatttagctgcgtcacgatctcccttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacgttggtccagcctgggacgggtccctgagctctcctgtgtcgcctctggattcaccatcagtgaccatatatggactgggtccgccagggcctccgaggggaacggggctagggagtcggcgttgggccgacaagtaaaaacaaagtttcgaccagtctttatcanagacgtacggccgagtctggtagaaacgccaagtacttaccaccccttctacaaaggacgacttacggtaactttacgaaaacgttaaccttacgtaaacttttggtaaactttccgtaagggaccgtaaaacgtttcgggaaaccccttttaaaaccgtaaacgggtaaaaaacccccggtaggggaaccccgtaaccgggggtacctaaggtttacggtttaaacgtttttaaacggtttcggggttttaacgggtttttagggtttttaagggttttttaaacttaaccggttttacccggaaaacggggttttaaaccccttttcggggttaccccgtttaaacccgggggg

SEQ ID NO: 291681 - DNA, 569 bp, Homo sapiens
  misc_feature: GYAE6OF02IPVYO.44.36.D03.1.454.CMB.1.raw
  modified_base (216)..(216): a, c, t, g, unknown or other
  misc_feature (216)..(216): n is a, c, g, or t
  modified_base (375)..(375): a, c, t, g, unknown or other
  misc_feature (375)..(375): n is a, c, g, or t
  modified_base (417)..(417): a, c, t, g, unknown or other
  misc_feature (417)..(417): n is a, c, g, or t
  modified_base (442)..(442): a, c, t, g, unknown or other
  misc_feature (442)..(442): n is a, c, g, or t
  modified_base (490)..(490): a, c, t, g, unknown or other
  misc_feature (490)..(490): n is a, c, g, or t
tcagacagtatatacacgaccggtgctcgatttagctgcgtcacgatctctcttgggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtctggggganacttggtccagcctggaggggtccctgagactctcctgtgtcgcctctggattcaccatcagtcgaccactatatggactgggtccgccaggctccgagggaaggggctagggagtggcttgggccgcgaagtaaaaacaaggttcgaccagtctttancacagagtacgccgcgtctgtagaaagccagacttcaccctntcaagagatgacttacaagtaactnattgattcgtagacgtaatacgaaccttaaccgtaacgaaaaaccggnggaaccgacgggactaagtgttaattagttgttaggtttagttagtttatacgtactaaggtacttgtacccgtacggg

SEQ ID NO: 291682 - DNA, 638 bp, Homo sapiens
  misc_feature: GYAE6OF02GBR21.44.36.D03.1.454.CMB.1.raw
  modified_base (381)..(381): a, c, t, g, unknown or other
  misc_feature (381)..(381): n is a, c, g, or t
tcagacagtatatacacgaccggtgctcgatttagctgcgtcacgatctctcttggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggcccagcctgggaactcctgacgactctcctgtcgcagcctctggattcatcttcaggacctatgccatgcacgtgggtcccgcaggctccgaggcgaagggctggagtgggtgacaattatatcgaagaagatggtaaatgaaagaacacgtacgggaanaccgtaccggaaggtaacggggacctacgttaccgtaacccgtctacccgaagaacggaactaaacgttaccgaacggtaaaccacctaaccgtacgaccgtactcgtacggactaaacgttacggtaaccctaaaccttaccgaaactaaacggtagaacggtaccgaacggtcgttacgtacttaacgtttacgttacggttcgacggtacggacccgtacccccggtacggacccggtacccgggtacccccgg

SEQ ID NO: 291683 - DNA, 652 bp, Homo sapiens
  misc_feature: GYAE6OF02HJNHD.44.36.D03.1.454.CMB.1.raw
  modified_base (318)..(318): a, c, t, g, unknown or other
  misc_feature (318)..(318): n is a, c, g, or t
tcagacagtatatacacgaccggtgctcgatttagctgcgtcacgatctctcgttgggggggagacgagcccagcactggaagtcgccggtgtttccattcggtgatcatcactgaacacagaggactcaccatggactttgggctgagattgggttttcctcgttgcttcttttaaggaggtgtccagtgtcaggtgcagctgggtggagtcgtgggggaggcgtggtccagccgtgggacggtccctgagactctccgtgtgcagcgtctggattcaccttcagtacctagtggcagtcgcacgttcggggtcccnccgaggcctccgaggcgaaggggctgggacggtggggtgctacgtttagtatgggtatggaatgggtaaaagttaataaattactagtcgacaggtacctccggtaggaaacgggtccctaattcccgaacctagttccctacgaagaacgtacctaaacttacccgaaagaaccacgtcctaggttaactcgtacgtaacaaatcggaaactcgacccgtaggaaccgaacggtacccgggaaggtaacccgtacgggtccttaggttacgtttaacgttaccggtgggtacgaccgggtaaggtaacctaagtttaggttacggttaacccg

SEQ ID NO: 291684 - DNA, 528 bp, Homo sapiens
  misc_feature: GYAE6OF02F6JVP.44.36.D03.1.454.CMB.1.raw
  modified_base (302)..(302): a, c, t, g, unknown or other
  misc_feature (302)..(302): n is a, c, g, or t
  modified_base (342)..(342): a, c, t, g, unknown or other
  misc_feature (342)..(342): n is a, c, g, or t
tcagacagtatatacacgaccggtgctcgatttagctgcgtcacgatctctcttggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggaggagcggcccagcctgggaactccctgagactctcctgtgcagcctctggattcatcttcaggacctatgccatgcacgtgggtccnccaggctccgaggcaaggggctggagtgggtggcaattanatcagaagatggaattgaaagaacgactaacgggagactacgagaacggcgatcacgtctccagacgacaattccagaacacactgacatctagactaaatcgtaacaacctcacaagtacgagacacggcttgtacctaattagttgtgtagacgacgtccccctacggtacgacccggtccccg

SEQ ID NO: 291685 - DNA, 685 bp, Homo sapiens
  misc_feature: GYAE6OF02IL6J5.44.36.D03.1.454.CMB.1.raw
  modified_base (509)..(509): a, c, t, g, unknown or other
  misc_feature (509)..(509): n is a, c, g, or t
  modified_base (524)..(524): a, c, t, g, unknown or other
  misc_feature (524)..(524): n is a, c, g, or t
  modified_base (589)..(589): a, c, t, g, unknown or other
  misc_feature (589)..(589): n is a, c, g, or t
  modified_base (615)..(615): a, c, t, g, unknown or other
  misc_feature (615)..(615): n is a, c, g, or t
  modified_base (657)..(657): a, c, t, g, unknown or other
  misc_feature (657)..(657): n is a, c, g, or t
tcagacagtatatacacgaccggtgctcgatttagctgcgtcacgatctctcttgggagctctgagagcggagccccagccccagaattcccaggtgtttcatttggtgatcagcactgaacacagaggactcaccatggagttcggctgagcgttgggttttccttgttgttattttacaaggtgtccaggagtgaagtgcagttggtggaggtcggggagtacgttggtccaggccgtgggagggtccctgagacctctccgtgtcgtccggcctgtgggtacttcacctatcagtgaaccacttagtactggaccgtggggtccccaccgacggtcctcccgaagggggaacggggtctggggaggtcggcgttacgggcccgagtaaaaggtaaaaaaacgtaacggttgaacccgagttacctttaacgccgtaaagaacggtacggttaccggaccgtcggtaccttaggtaagaaaacgccgaaagtacttccaacccgttntacgaaaagcgttanagttaacctacaaacgtaactctattagtaagttcctaggacaagtacgtaacttaaacccgaanaaaaccccgggtagaaccgtacgggnaagttagttagttaagttgtaggttttggagttttttaaagnttaaccgaagggttacctagttcccggg

SEQ ID NO: 291686 - DNA, 704 bp, Homo sapiens
  misc_feature: GYAE6OF02IH5GD.44.36.D03.1.454.CMB.1.raw
tcagacagtatatacacgaccggtgctcgatttagctgcgtcacgatctctcttgggggactcctgtgccccaccatggacactctttgctacacactcctgctgctgaccaccccttcctgggtcttgtcccaggtcaccttgaaggagtctggtcctgtgctggtgaaacccacagagaccctcacgctgacctgcacatctcgttggttctctctcaacgattattaagagtgggtgtgagtcgtggactccgtcacgccccgagggacgccgtggagtgctgcacgactattcttctacgaatacgaaacgtaaaactcctaactaacgtacaacttctacgtagaaagagtaccgttaacgttaaacctatacctaaccgaaacggtacctaacccgtaaccgaaaaaggtcgtaacgggttcggtttaccgtttaagttacacgaaccctaaacgtacgttacccgggtacccgtaggaaccggaacgtaacggaggaccaacttaattacttacgtcggacgtacggtaacggttaaagtcgggaaacgggtaaaacgaacgtaggttaccgttaggttttcgtacgttaatttaaacgtacgttaccttaacgttacgtacgttacgggtaacgttcggtaacgggaacggtaaacgggtacccgtaacggttaccgaccgttaccgtcctaacgg

SEQ ID NO: 291687 - DNA, 518 bp, Homo sapiens
  misc_feature: GYAE6OF02FQOXV.44.36.D03.1.454.CMB.1.raw
  modified_base (303)..(303): a, c, t, g, unknown or other
  misc_feature (303)..(303): n is a, c, g, or t
  modified_base (343)..(343): a, c, t, g, unknown or other
  misc_feature (343)..(343): n is a, c, g, or t
  modified_base (402)..(402): a, c, t, g, unknown or other
  misc_feature (402)..(402): n is a, c, g, or t
tcagacagtatatacacgaccggtgctcgatttagctgcgtcacgatctctcttgggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtggggggaggagcggcccagcctgggaactccctgagactctcctgtgcagcctctggattcatcttcaggacctatgccatgcactgggtccnccaggctccgaggcaaggggctgggagtggggtgcaattntatcagaagataggaattgaaagaacacgtacggagactcgaagaggcgattcacgtcncagagacaattccagaacacactagcatctagactaaatcgtaaccaacctcaacaagtagacggacacggctgtactagttattgtgcgacgacgccccgtcgacgcggtccccg

SEQ ID NO: 291688 - DNA, 536 bp, Homo sapiens
  misc_feature: GYAE6OF02JJHZK.44.36.D03.1.454.CMB.1.raw
  modified_base (261)..(261): a, c, t, g, unknown or other
  misc_feature (261)..(261): n is a, c, g, or t
  modified_base (404)..(404): a, c, t, g, unknown or other
  misc_feature (404)..(404): n is a, c, g, or t
tcagacagtatatacacgaccggtgctcgatttagctgcgtcacgatctctcttggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtctgggggagagcggcccagcctggggaactccctgagactctcctgtgcagcctntggattcatcttcaggacctatgccatcgcactcgggtccgccaggcctccgaggcaaggggctgggagtgggtgctaattatatcaagaagatggaattgaaagaacacgtacggagactacgagaagggccgatcacgtcncagacgacaattcaggaacacactgcatctagacaaatgtaaccaacctcaactaagtgaacggtacacggactcggttactaattattagtgacgaggaccgtcccccgtaggacggtacccggtccccgg

SEQ ID NO: 291689 - DNA, 646 bp, Homo sapiens
  misc_feature: GYAE6OF02HWJJC.44.36.D03.1.454.CMB.1.raw
  modified_base (308)..(308): a, c, t, g, unknown or other
  misc_feature (308)..(308): n is a, c, g, or t
tcagacagtatatacacgaccggtgctcgatttagctgcgtcacgatctctcttgggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggaggagcggccccagcctgggaactccctgagactctcctgtgcacgcctctggattcatcttcaggacctatcgccatgctacgtgggtcccnccgaggcctaccgaggaccgaagggggctggggaggtgggtggactaattagtatacgaagaaggagtacggaatttagaaaaggaaccacgtaacgggacgtaaccgtaccggaagggaacggggacccgtaagttacctaaccggtacctacccgaaggaacggtaacctaaacgttacccgaaggaaaccaccgaactcgactacttctacgaactaaagtacgtaacctaacctaccgaacgaaacgtaggacgaccgacggtcgtagttacttagttacgttagtacgacggacggaccgtacccccgtaggtaccggtacccggtaccccgg

SEQ ID NO: 291690 - DNA, 567 bp, Homo sapiens
  misc_feature: GYAE6OF02I1222.44.36.D03.1.454.CMB.1.raw
  modified_base (498)..(498): a, c, t, g, unknown or other
  misc_feature (498)..(498): n is a, c, g, or t
  modified_base (520)..(520): a, c, t, g, unknown or other
  misc_feature (520)..(520): n is a, c, g, or t
tcagacagtatatacacgaccggtgctcgatttagctgcgtcacgatctctcttagggatcacataacaaccacactcctcctctaaagaagcccctgggagcacagctcatcaccatggactggacctggaggttcctctttgtggtggcagcagcaacaggtgtccagtccctggtgcaactggtgcagtctgggactagatgccgcaaccttggtcctcggtcgaccctttctgcacggcctcgtggaagtactaccagttccactacttataccatcaactgggtgccgccacggccctggacaagggcttggagtggagtgggtgaatcactccttcgttttggctcactcactacgcacgacgtacgttcccggggactaggtaactttacgacgttacccgcggtaacaacgtccaacgacgacacgacgtcctaccatacgacaagtgacgtttcttagaactccgacgacgacgtccgtctactactgngcgagtacggtcccgtacccgngcctcgacacgtcggactccgttagacgtacgtcggtcggggtaccg

SEQ ID NO: 291691 - DNA, 707 bp, Homo sapiens
  misc_feature: GYAE6OF02JXYH0.44.36.D03.1.454.CMB.1.raw
tcagacagtatatacacgaccggtgctcgatttagctgcgtcacgatctctcttggggatcacataacaaccacactcctcctctaaagaagcccctgggagcacagctcatcaccatggactggacctggcggttcctctttgtggtggcagcagctacaggtgtccagtcccaggtgcagctggtgcagtcgtgggctgaggtgaagagctggtcctcggtgaaggtctctgcaaggctctggaggcacttcttcagctatgtcttttagttggtgcgacgacggtcccctggacgaagggtcttggagttcgggcgtaggggacgggtatcgacgttccctagttcgtttgggtcgacgtaatccggtaaatttaccggactaacgtacggttaaacggtttcgaagggtaaccaagggtacgttaccgaacccgtaacgtttaaccccgggacggtaaaccggtaaactacccgtaaacgggtaacgtaaacccgtaacggtacccttaacggtagtacgggaaacgtccgttaagggaacggccgaacgggtccgtaggtaacggtacgttacgtaacggaaacggaccgtacgggtaccctattcgttttaacgttccgttaggtacggaccggtaacggaccgttcccccgttacgttacccttaaaccgttttcgtaaccgttacccggtttaaccccc

SEQ ID NO: 291692 - DNA, 637 bp, Homo sapiens
  misc_feature: GYAE6OF02IH0H4.44.36.D03.1.454.CMB.1.raw
  modified_base (358)..(358): a, c, t, g, unknown or other
  misc_feature (358)..(358): n is a, c, g, or t
tcagacagtatatacacgaccggtgctcgatttagctgcgtcacgatctctcttgggggggagacgagcccagcactggaagtcgccggtgtttccattcggtgatcatcactgaacacagaggactcaccatggactttgggctgagattgggttttcctcgttgctctttttaagaggtggccagtgtcaggtgcagctagtggagtcgtgggggagagcggcccagcctgggaactccctgacgactctcctgtgcagcctcgtggattcatcttcaggacctatcgccatcgccacgttcggggtcccgccgaggtcctaccgaggaccgaagggggtctggggaggttggggngactaattagattcgaagaagtagtaggaattagaaagaacacgtacggagacgtacggaaggaacgggccgtatacgaccgttactaccgagacgactaacttaccgaacggaaccaccactgactactacgtacgactaaagttacgtaaccaacctacaacgtaaagtacggtaacggaccgaaccgggtcttacgtacttaacgtttaagttcggtacggacggaacggtaccggtcccccccggtaacggacccggtaccccggttccccccgg

SEQ ID NO: 291693 - DNA, 951 bp, Homo sapiens
  misc_feature: GYAE6OF02J0EM9.44.36.D03.1.454.CMB.1.raw
tcagacagtatatacacgaccggtgctcgatttagctgcgtcacgatctctcttggggagctctgagagcggagccccagccccagaattcccaggtgtttcatttggtgatcagcactgaacacagaggactcaccatggagttcgggctgagctgggttttccttgttgttatttacaaggtgtccagagtgaagtgcagttggtggagtccgggggagacgttggtccaggcctggggacgggtccctggacgactctcctgtcgtcgcctctggattcacctatcagtcgaccactatagtcggactcggggtcccgccgagggtcctacccggaagggggaacgggggtccgtaggggacggttcggggtccgttaggggaccccggtacgaaacgggttaaaaaaaccgtaaagggtttcgggacccctaaaggttaccctttttaaagtaccgaaacccgtaaggtaaccgggttaaccggcccggttaccggttacgttacgggttaacggaaaaacggttccccggtaaaaggtaccccgttttacccaaaccccccgtttcgaaaccggtaaaacggtaacggtaaacgtttacccgggtaaaacccgttttaaccggaaaaaccggttaaccctttaaccgtaaacgttttaacggggttaacctttttacccggtaacgggtaaaccggttaaaaccttaaccgggttaaaaccccgtttaaaaaccccgggttaaacggaaaaaaaaccccgggggttccggggaaaaacccggttacccggggggtaactttaaaacccgggtttaagggttttaaaccgtttttaaaggttttaccgggttttaacggggttttaaggttttaagggtttttttaaactaaggtttaaccccgggttaaagggggtttaaccccttaacgggggtttaacccccgg

SEQ ID NO: 291694 - DNA, 573 bp, Homo sapiens
  misc_feature: GYAE6OF02G0TSG.44.36.D03.1.454.CMB.1.raw
  modified_base (367)..(367): a, c, t, g, unknown or other
  misc_feature (367)..(367): n is a, c, g, or t
  modified_base (377)..(377): a, c, t, g, unknown or other
  misc_feature (377)..(377): n is a, c, g, or t
  modified_base (380)..(380): a, c, t, g, unknown or other
  misc_feature (380)..(380): n is a, c, g, or t
  modified_base (464)..(464): a, c, t, g, unknown or other
  misc_feature (464)..(464): n is a, c, g, or t
  modified_base (499)..(499): a, c, t, g, unknown or other
  misc_feature (499)..(499): n is a, c, g, or t
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacttggtccagcctggagggtccctgagactctcctgtgtcgcctctggattcaccatcagtgaccactatatggactgggtcccgccgaggctccgaggggaagggctgggagtggcttggccgcaagtaaaaacaagttcnccagtcttancanagagtacgccgcgtctgtagaaacgcaagacttcccaacctctacaagagtatacgtacttacaagtaactcagttgactttcngtacgaatcgaaccttaaaccgtacgaaaaaccgngggaaccacgggacagttaggtatttagttgttggtttagttagttttagtattcgaacgggtactggtacccg

SEQ ID NO: 291695 - DNA, 692 bp, Homo sapiens
  misc_feature: GYAE6OF02JW9B3.44.36.D03.1.454.CMB.1.raw
  modified_base (314)..(314): a, c, t, g, unknown or other
  misc_feature (314)..(314): n is a, c, g, or t
tcagacagtatatacacgaccggtgctcgatttagctgcgtcacgatctctcttgggagctctgagagcggagccccagccccagaattcccaggtgttttcatttggtgatcagcactgaacacagaggactcaccatggagttcgggctgagctgggttttccttgttgttatttacaaggtgtccagagtgaagtgcagttggtggaggtccggggagacgttggtccagccgtggagggtccctgagactctccgtgtgtcgcctcgtggattcaccatcgagtcgacctactatatggactcgggtccnccgtaggctcggaacggggaggggctgggagtcggcttcggccggacgaagtaaaaaaccaaagttcggacctaggtacttttagaccgaacgaggtaacgtacgccgtcgtacgttgggtagtaaaaccgtccgtaaggtacctttcccgtaaaccccttcgtaacgaaaccggagtaacgttacgttaaaccgttacgaaaaacgtaacttcaagtttcgaatttccgaggtaacctaaagtcgtaaaccgttaaacccagggaaaaacccggagaaccgacgggtacttaagttacggttaactttaggtttcgttacgggtttatttaggttttaacttaagtcccggtaaggttaacccgttcgttaacccgg

SEQ ID NO: 291696 - DNA, 555 bp, Homo sapiens
  misc_feature: GYAE6OF02FRO86.44.36.D03.1.454.CMB.1.raw
  modified_base (388)..(388): a, c, t, g, unknown or other
  misc_feature (388)..(388): n is a, c, g, or t
tcagacagtatatacacgaccggtgctcgatttagctgcgtcacgatctctcttgggggactcctgtgccccaccatggacactctttgctacacactcctgctgctgaccaccccttcctgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctcgaatgacgaaaaatcctacagtacatctctgaagagcaagtttaaccatctccaaggacacctcaaaagcaggtgtctttagtatgaccaanatacggaccctgcggacacgaggcacatattaccgtgtgcacgggtaatggacgggaaagaacaggcgttggttacctagtattagtaagttccttaacagttctaggtaccgttcgtaggggacctaaacggggccctacgggttccacccgttccgtacctaccg

SEQ ID NO: 291697 - DNA, 515 bp, Homo sapiens
  misc_feature: GYAE6OF02FP7LY.44.36.D03.1.454.CMB.1.raw
  modified_base (347)..(347): a, c, t, g, unknown or other
  misc_feature (347)..(347): n is a, c, g, or t
  modified_base (372)..(372): a, c, t, g, unknown or other
  misc_feature (372)..(372): n is a, c, g, or t
  modified_base (445)..(445): a, c, t, g, unknown or other
  misc_feature (445)..(445): n is a, c, g, or t
  modified_base (473)..(473): a, c, t, g, unknown or other
  misc_feature (473)..(473): n is a, c, g, or t
  modified_base (502)..(502): a, c, t, g, unknown or other
  misc_feature (502)..(502): n is a, c, g, or t
  modified_base (504)..(504): a, c, t, g, unknown or other
  misc_feature (504)..(504): n is a, c, g, or t
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctcgggattcaccatcagtgaccactatatggactgggtccgccaggctccgagggaaggggctgggagtggcttggccgnaagtaaaacaagttgccagctttancacagagtacgccgcgtctgtgaaagccagattcaccctctacaagagatgacttcaaagactcattgattcngacgtaatgaactaaccgagaaaaccgngaccaggcagtgtatatgtgttgtgttantnagactgcacgg

SEQ ID NO: 291698 - DNA, 597 bp, Homo sapiens
  misc_feature: GYAE6OF02HZIXL.44.36.D03.1.454.CMB.1.raw
tcagacagtatatacacgaccggtgctcgatttagctgcgtcacgatctctcttgggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggcccagcctgggaactccctgagactctcctgtgcacgcctctggattcattcttcaggtacctagtcgccatcgctacgtcgggtccgccgaggcctccgaggacgaaggggctagggaggtgggtggactaagttatactacgaagaaagtagtaggtaattagaaacgaacacgtaacggagtacgtacgaaggacgggccgtatccgaccgtctacgagacgactaacgttaccaggaaccacacgtgacactcacgacaagtacgtacaacctcaacgaaagtacgagacgacggtacgttcgtactttattagttacgtgtacgtacggacccgtacccccggtacggacccggtacccggttaccccgg

SEQ ID NO: 291699 - DNA, 659 bp, Homo sapiens
  misc_feature: GYAE6OF02JLB1S.44.36.D03.1.454.CMB.1.raw
  modified_base (213)..(213): a, c, t, g, unknown or other
  misc_feature (213)..(213): n is a, c, g, or t
  modified_base (223)..(223): a, c, t, g, unknown or other
  misc_feature (223)..(223): n is a, c, g, or t
  modified_base (304)..(304): a, c, t, g, unknown or other
  misc_feature (304)..(304): n is a, c, g, or t
  modified_base (329)..(329): a, c, t, g, unknown or other
  misc_feature (329)..(329): n is a, c, g, or t
  modified_base (340)..(340): a, c, t, g, unknown or other
  misc_feature (340)..(340): n is a, c, g, or t
tcagacagtatatacacgaccggtgctcgatttagctgcgtcacgatctctcttgggcagagctctggggaggaactgctcagttaggaccagacggaaccatggaagcccagcgcagctctcttcctctgctactctggctcccagactaccactggagaaatagtgatgacgcggtctccagccaccctgtctgtgtcctcgaggggaaangcccacctcncctgcagggccagtcagagtgttacgcagcaacttagcctgtacccagtccaagaaattccgagggcccaggcctccccgnggtcctcctacacttctagtggtcnctaatccgacncgtacgggccttcgaggcctagttccccgggaaatcgggttacccaggggtccggacgtaggggtttcgggttccggtacgggtaccgtacgggtacggtttaccgtaccgttcctccgtaacctactaccgtaacgtccgtaacgtcccgtacggtaccgtaacgttcgtacgtaacgttagtttacgttacgtacgttttaacgttacgtttcgttacgtacgtctaagttacgttagttgtacggtcggtaccgttccgttacgttccgtttaccggtccgtcgggtaccaacggttcggtacgttacgttaaccg

SEQ ID NO: 291700 - DNA, 591 bp, Homo sapiens
  misc_feature: GYAE6OF02G7LZ2.44.36.D03.1.454.CMB.1.raw
  modified_base (347)..(347): a, c, t, g, unknown or other
  misc_feature (347)..(347): n is a, c, g, or t
  modified_base (373)..(373): a, c, t, g, unknown or other
  misc_feature (373)..(373): n is a, c, g, or t
  modified_base (416)..(416): a, c, t, g, unknown or other
  misc_feature (416)..(416): n is a, c, g, or t
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttgggtggagtccgggggagacttggtccagcctgggagggtccctgagactctcctgtgtcgcctctggattcaccatcagtgaccactatatggactgggtccgccaggctccgagggagggctgggagtggcttggccgnaagtaaaacaagttgccagtctttancacagagtacgccgcgtctgtagaaagccagtattccaccctntacaagagatgacttacgaaagacctctaagttgaatttcgtagacgtaaattcgtaacctaaaccctaggaaaaacccggaggtaccacggggacctaagttcgttaattttaagttcggttaggttttagtttagttttaagttacttcgtaagggtaccttaggttaccccg

SEQ ID NO: 291701 - DNA, 545 bp, Homo sapiens
  misc_feature: GYAE6OF02G6163.44.36.D03.1.454.CMB.1.raw
  modified_base (343)..(343): a, c, t, g, unknown or other
  misc_feature (343)..(343): n is a, c, g, or t
  modified_base (430)..(430): a, c, t, g, unknown or other
  misc_feature (430)..(430): n is a, c, g, or t
tcagacagtatatacacgaccggtgctcgatttagctgcgtcacgatctctcttggggatcacataacaaccacactcctcctctaaagaagcccctgggagcacagctcatcaccatggactggacctggcggttcctctttgtggtggcagcagctacaggtgtccagtcccaggtgcagctggtgcagtctggggctgaggtgaagaagcctgggtcctcggtgaaggtctcctgcaaggcttctggaggcaccttcttcagctatgtcttttattgggtgcgacaggcccctggaccaagggcttggagtggcgtgggagggatcatccctatcttggncatcgaattacgcacagaagtttcaggacagagtcaaccattacccgcggaacgaatcccaacgacgtacagacctaacagtgggancgtagacgcgaggctagagatcagaagaccgacggccagttcctaagtttcgtaggtcgacggtagtaaccgtccccgttacggtacctaacgttttccaagttaccgttccccg

SEQ ID NO: 291702 - DNA, 827 bp, Homo sapiens
  misc_feature: GYAE6OF02F2SQ2.44.36.D03.1.454.CMB.1.raw
  modified_base (206)..(206): a, c, t, g, unknown or other
  misc_feature (206)..(206): n is a, c, g, or t
  modified_base (271)..(271): a, c, t, g, unknown or other
  misc_feature (271)..(271): n is a, c, g, or t
  modified_base (709)..(709): a, c, t, g, unknown or other
  misc_feature (709)..(709): n is a, c, g, or t
tcagacagtatatacacgaccggtgctcgatttagctgcgtcacgatctctcttggggagctctgagagcggagccccagccccagaattcccaggtgtttcatttggtgatcagcactgaacacagaggactcaccatggagttcggctgagctgggttttccttgttgttatttacaaggtgtccagagtgaagtgcagttggnggagtccggggagacttggtccagccgtgggacgggtccctggagactctccgtgtcgtcgcctntggattcaccatcagtcgacctacgtatagtacgggactcggggtcccaccgacgggcctacccggaagggggaacgggggccttagggggagttcggggtccttcggggaccccgacgaaaacggttaaaaaaaccgtaaagggtttccgaccccgtaaaggtccgttttttaaacaccgaaacgtaacgggtaaccggttaacccgggccccgtaccggttacgttacgggttaaacggaaaaaccggtccccgtaaagggtaaccttttaccccgaaacccccgtttacgtaacccgaaaaagggtacgtaaacttacgggtaaaccctttaacccgaaaaggtaaaccctttcgtaaacgttttcggtaaactttccgttaggaaccgttaaagtcggtaaacccttaaaaacccgtacggtaaaaaaacccgnggggaaaccctaccggggtaacaacggtttaggttaaacttttaaaggtttcggtttaggttttacggtttagttttaacgttaacgttcggaaacggttaaccgtcggttaacccgg

SEQ ID NO: 291703 - DNA, 639 bp, Homo sapiens
  misc_feature: GYAE6OF02HPMHQ.44.36.D03.1.454.CMB.1.raw
  modified_base (441)..(441): a, c, t, g, unknown or other
  misc_feature (441)..(441): n is a, c, g, or t
tcagacagtatatacacgaccggtgctcgatttagctgcgtcacgatctctcttggggatcacataacaaccacactcctcctctaaagaagcccctgggagcacagctcatcaccatggactggacctggcggttcctctttgtggtggcagcagctacaggtgtccagtcccaggtgcagctggtgcgagtcgtggggctggaggtgaagagccgtggtcctggtgaaggtctccgtgacgaaggtcgttcgtggacggctaccttcttacaggtctagtgttctttttagtttgggtgcgtacgacggtccccgtaggaacgtaagggtcttggaggtggcgtggggaggatcgactccgtagttcgttggtcgactagtacgtaacttacgactaagtagtaagttcgaggactagacgtcaaccgtacgttaccgnggtaactaacgtacgaacgtagtacagtacctaacgagtcggaatcgtaggagtcgaggtcgtagtaagacgtctaacgggaacgtaaccgaccggtacctagttactttacgtttcgtaggttaccggaacgtaacggtacccgttacccgtacggttaccgttaacccgttttacgaccgtttcccgttaaccccg

SEQ ID NO: 291704 - DNA, 629 bp, Homo sapiens
  misc_feature: GYAE6OF02IMC88.44.36.D03.1.454.CMB.1.raw
  modified_base (323)..(323): a, c, t, g, unknown or other
  misc_feature (323)..(323): n is a, c, g, or t
  modified_base (419)..(419): a, c, t, g, unknown or other
  misc_feature (419)..(419): n is a, c, g, or t
tcagacagtatatacacgaccggtgctcgatttagctgcgtcacgatctctcttggggagctctgagagcggagccccagccccagaattcccaggtgtttcatttggtgatcagcactgaacacagaggactcaccatggagttcgggctgagctgggttttccttgttgttattttacaaggtgtccagagtgaagtgcagttggtggagtccgggggagacgttggtccaggcctgggacgggtccctggacgactcctcctgtcgtcgcctcgtggattcaccatcgagtgacccacttaatatggactcggggtcccnccgaggcctccgaagggggaacggggtctgggaacgtgggacttacgggccgacgtaaaggtaaaaaacaacgggtttgacccaggtacttttaanccgtaacgaggacgtaccgcgtcgtactagtagaaaacgtcctaaggactttccaacccctgtaccgaaagcgtaatcgtaacttccaaagactcgattgacttctagaccgtaatcgaaacctaaccgtagaaaaccgtagaccagggacaggtaacgttaacttgttacgttaggttacttgttaagtactcgaaggttactgtaccg

SEQ ID NO: 291705 - DNA, 661 bp, Homo sapiens
  misc_feature: GYAE6OF02HCAFA.44.36.D03.1.454.CMB.1.raw
tcagacagtatatacacgaccggtgctcgatttagctgcgtcacgatctctcttggggagctctgagagcggagccccagccccagaattcccaggtgtttcatttggtgatcagcactgaacacagaggactcaccatggagttcgggctgagctgggttttccttgttgttattttacaaggtgtccagagtgaagtgcagttggtggaggtccgggggagacgttggtccagcctgggacgggtccctgagactctcctgtgtcgcctcgtggattcaccatcagtgaccactatatggactcgggtccgccaggctccggaggggaagggctgggagtggcgttggccgacgaagtaaaaacaaggttcgaccagtctttatcacagagtaccgccgcgtctggtagaaacgccaagtacttccaccctctacgaaaggagtatacgtaaccttacgaaacgtaaccttcgaatttacgaatttccgtagtaaccgtaaattcgtaaacccttaaacccgtaaaggaaaaacccggagggaacccgtacgggggacctaaggttacggtttaacgttttaagtttcgggtttacggttttaggtttagttttttaactagtttaccggtaaacgggttaacctttcggtaaccccgg

SEQ ID NO: 291706 - DNA, 638 bp, Homo sapiens
  misc_feature: GYAE6OF02G3TEW.44.36.D03.1.454.CMB.1.raw
  modified_base (398)..(398): a, c, t, g, unknown or other
  misc_feature (398)..(398): n is a, c, g, or t
  modified_base (550)..(550): a, c, t, g, unknown or other
  misc_feature (550)..(550): n is a, c, g, or t
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttatttacaaggtgtccagagtgaagtgcaggttggtggaggtccgggggagacttggtccagccgtgggacgggtccctgagacctctcctgtgtcgcctctggacttcaccatcagtcgaccactatagtggacgtgggtcccgccaggcctccgagggggaaggggcgtgggagtgggcgttcgggccgacaaagtaaaaacaagttcgactagtcttttaancaacgagtacgtaccgccgtcgtctggtacgaaacgccaaggtaccttcccaacccttctaccgaaagacgtattacgaactttacgaaagtaactctaatttgactttcgtagaccgtaaatcgaaccttaaaccgtacgaaaaacccggnggaccgaacgggactaagtaggttaattttagttggttagttttagttaggttttaactacgttacggaaggttacctggttaccccg

SEQ ID NO: 291707 - DNA, 746 bp, Homo sapiens
  misc_feature: GYAE6OF02GEJNR.44.36.D03.1.454.CMB.1.raw
tcagacagtatatacacgaccggtgctcgatttagctgcgtcacgatctctcttgggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggaggagcggcccagcctgggaacctccctgagacctctccgtgtgcagcctgtggattcatcttcacggtacctatgccagtcgacacgttcgggtcccgccaggtcctccgaggacgaagggggctaggggaggtgggtggactaaagtttatatacaaggaaagtaggttagggaaatttaggaaaacggtaaccgacgttaaaccgggaagtaacccgtaaccgggaaacgggtaaacggggtaccccgtaacgtttacccgacccggttccgtacccgaacggtaaccgaaaccgttaaacgtttaacccggaaacggtaaaccaaccgtaacgtacgtacctacgttacgtagtaacctaaacgttacgttaaccctaaacccgtaaccgaaacgtaaacggtacggtaacgggaccgaaccgggtcgttacggttaaccgtttaagtttaacgtttcggttacggtaccggtaaccggtacccggtaccccccgtacgggtacccgggtacccggttaccccccgg

SEQ ID NO: 291708 - DNA, 621 bp, Homo sapiens
  misc_feature: GYAE6OF02H7BWF.44.36.D03.1.454.CMB.1.raw
tcagacagtatatacacgaccggtgctcgatttagctgcgtcacgatctctcttggggatcacataacaaccacactcctcctctaaagaagcccctgggagcacagctcatcaccatggactggacctggcggttcctcttttgtggtggcagcagctacaggtgtccagtcccaggtgcagctggtgcagtctggggctgaggtgaagaagccgtgggtcctcggtgaaggtctccgtgcaaggtcttcgtgggaggtcctaccttcttcagtctattgtctttttagttgggtgcgacacgggcccctaggacgaagggtcttggaggtggcgtgggaggatcactcctatcgttggtgctagtacgtaagttaccgacacgtaagtaacgtttcgaaggtacacggtacgtacctaacccgtaacgtttacccgggacggaacgtaaactccgaacggtacgtaaccacgtaccctaacgagtcggagtcgtaggacgacggagggcctaggaacgtactacgtaggaaacgacgaccggactacgttcttagtttcgtcggtacggacggtagtaccgtcccttacgtaccttaacgtttactacttcgttacccc

SEQ ID NO: 291709 - DNA, 593 bp, Homo sapiens
  misc_feature: GYAE6OF02GEH4I.44.36.D03.1.454.CMB.1.raw
  modified_base (382)..(382): a, c, t, g, unknown or other
  misc_feature (382)..(382): n is a, c, g, or t
  modified_base (386)..(386): a, c, t, g, unknown or other
  misc_feature (386)..(386): n is a, c, g, or t
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctgggacgggtccctgagactctcctgtgtccgcctctggattcaccatcagtgaccactatatggactgggtccgcaggctccgaggggacgggctgggagtggcgttggccgacgaaagtaaaaacaagttcgaccagtctttancaanagacgtaccgccgcgtctagtagaaacgccaagtacttcccaccctcacaaagagattcgacttacaaagtaacctctaattgtaattcgaggtactaaatcgtaaacctaaaccgtaacggaaaacccgagaccgaccgggactagttacgtatttagttgttaggtttgtttagttataacgtagaacggttacctgtaacccgg

SEQ ID NO: 291710 - DNA, 503 bp, Homo sapiens
  misc_feature: GYAE6OF02FI1JV.44.36.D03.1.454.CMB.1.raw
  modified_base (216)..(216): a, c, t, g, unknown or other
  misc_feature (216)..(216): n is a, c, g, or t
tcagacagtatatacacgaccggtgctcgatttagctgcgtcacgatctctcttggggcagagctctggggaggaactgctcagttaggacccagacggaaccatggaagccccagcgcagcttctcttcctcctgctactctggctcccagataccactggagaaatagtgatgacgcggtctccagccaccctgtctgtgtctccaggggaaangccaccctctcctgcagggccagtcagagtgttagcagcaacttagcctcgtaccagcagaaatctggccaggctcccaggctcctcatctatgatgcatccaacagggtcactggcaccccagacaggttcagtggcagtgggtctgggacagacttcactctcaccgtcagcaatgtacagcctgaagtatttgctagtttattacttgtcagctagcgttcctccagccgctctacgtttcgggccggggtaccaaggctgggacgtagtacgaaggtactcgg

SEQ ID NO: 291711 - DNA, 640 bp, Homo sapiens
  misc_feature: GYAE6OF02G9RE9.44.36.D03.1.454.CMB.1.raw
  modified_base (160)..(160): a, c, t, g, unknown or other
  misc_feature (160)..(160): n is a, c, g, or t
tcagacagtatatacacgaccggtgctcgatttagctgcgtcacgatctctcttgggggggagacgagcccagcactggaagtcgccggtgtttccattcggtgatcatcactgaacacagaggactcaccatggactttgggctgagatgggttttccncgttgctctttaagaggtggccagtgtcaggtgcagctaggtggagtcgtgggggagagccggccagccgtagggaacctcccgtagagactctcctgtcgcagcctcgtggattcattctcgagactatgcctatcgctacgtgggtcccgcaggcctccgaggacgaaggggctgggaggtgggtcgactaagttatatcgaaggaagagtaggtaaatggaaaagaaccacgtacgggaagtacgtaccggaaggaacgggaccgtacgtaccgtaccgtcgtaccgaagaacgaactaacgttaccgaacggaacaacaccgtacgacgtactcgtacgactaaacgtacgtaacctaaaccgtacaacgaacgtacggaacggacgtacggtacgtacgttaacttagttacgttcggtaggtacggtaccggtacccggtcccccgtacggtacccggtacccggtaccccggg

SEQ ID NO: 291712 - DNA, 543 bp, Homo sapiens
  misc_feature: GYAE6OF02GZF3S.44.36.D03.1.454.CMB.1.raw
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctggattttccttgctgctattttaaaaggtgtccagtgtgaggtgcagttggtggagtctggggggaggtttggtaaagcctgggggatcccttagactctcctgtgcagcctctggattcactttcagtaacgcctggatgacctgggtccgcaggctccgagggagggctggagtgggttggccgtattagaaccaaagctaggacggtgggacagcagactacgctgccacccgtgaaaggcagattcaccatctacaagagatgaattacgaaaagtatacggtgtctctgacagatgaacacgacccgaacaccgagacacgacgccgtctattacgtcgtcgtgggattcggtttcagttccgggaccgagggtaaccccg

SEQ ID NO: 291713 - DNA, 546 bp, Homo sapiens
  misc_feature: GYAE6OF02GEX9U.44.36.D03.1.454.CMB.1.raw
  modified_base (346)..(346): a, c, t, g, unknown or other
  misc_feature (346)..(346): n is a, c, g, or t
  modified_base (420)..(420): a, c, t, g, unknown or other
  misc_feature (420)..(420): n is a, c, g, or t
  modified_base (427)..(427): a, c, t, g, unknown or other
  misc_feature (427)..(427): n is a, c, g, or t
  modified_base (482)..(482): a, c, t, g, unknown or other
  misc_feature (482)..(482): n is a, c, g, or t
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggtttccttgttgttattttacaaggtgtccagagtgaagtgcagttggtggagtccgggggagacttggtccagcctggagggtccctgagactctcctgtgtcgcctctggattcaccatcagtcgaccactatatggactgggtccgccaggctccgagggagggctgggagtggcttggccganaagtaaaacaagtcgacctagtctttagcacgagagtacgccgcgtctgtacgaaagccaagacttccaccctntacaagnatcgacttcaaagactcattgacttctagcgaatgaacctaacctagaaaaccgngaccacgggcagtcgtaattagtgttagtttgtagttttagacttcgaggttacctggtaaccg

SEQ ID NO: 291714 - DNA, 542 bp, Homo sapiens
  misc_feature: GYAE6OF02GX7DO.44.36.D03.1.454.CMB.1.raw
  modified_base (343)..(343): a, c, t, g, unknown or other
  misc_feature (343)..(343): n is a, c, g, or t
  modified_base (354)..(354): a, c, t, g, unknown or other
  misc_feature (354)..(354): n is a, c, g, or t
tcagacagtatatacacgaccggtgctcgatttagctgcgtcacgatctctcttggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtctgggggagagcggcccagcctgggaactccctgagactctcctgtgcagcctctggattcatcttcaggacctatgccatgcacgtgggtccgccaggcctccagggcaaggggctggaggtgggtggacaattanatcaggaaagntaggaattgaaagaacacgtacggagactaccggagagggccgatcaccgtctaccagacgacaacttaccaaggaaccacactcgcactcagacaaatcgtaaccaacctacaacaagtacgaggacacggtacgtgtacttattattgtgacgacgaccgcccccgtcggaccgtaccggtccccg

SEQ ID NO: 291715 - DNA, 571 bp, Homo sapiens
  misc_feature: GYAE6OF02FZ4PE.44.36.D03.1.454.CMB.1.raw
  modified_base (250)..(250): a, c, t, g, unknown or other
  misc_feature (250)..(250): n is a, c, g, or t
  modified_base (283)..(283): a, c, t, g, unknown or other
  misc_feature (283)..(283): n is a, c, g, or t
  modified_base (287)..(287): a, c, t, g, unknown or other
  misc_feature (287)..(287): n is a, c, g, or t
tcagacagtatatacacgaccggtgctcgatttagctgcgtcacgagtctctcttggggatcacataacaaccacactcctcctctaaagaagcccctgggagcacagctcatcaccatggactggacctggcggttcctctttgtggtggcagcagctacaggtgtccagtcccaggtgcagctggtgcagtctggggctggaggtgaagagccgtgggtcctcggtgaaggtctcctgcaaggcttcnggagcaccttctcagctatgcttttattggtgngacnggccctggacaaggcttgagtggctgggaggatcactccttagtcgtttaggtgctagtcgaagtttacgcacgtagtaagtttcgaggacagacgtcaacctagtaccggcggaacgagtaccaacgtagtaacagtaccctaactagtaggagtctaggacgtcgacggtcgtaggtagacgttcgacgtaacggacgaccgggtccagtaccgttagtttcgtaggttggacggagtaccggtccgttccggtactaaccgtttcaccgttacgttacccc

SEQ ID NO: 291716 - DNA, 801 bp, Homo sapiens
  misc_feature: GYAE6OF02GTSBM.44.36.D03.1.454.CMB.1.raw
tcagacagtatatacacgaccggtgctcgatttagctgcgtcacgatctctcttgggggggagacgagcccagcactggaagtcgccggtgtttccattcggtgatcatcactgaacacagaggactcaccatggactttgggctgagatgggttttcctcgttgctctttaagaggtggccagtgtcaggtgcagctaggtggagtcgtggggggaggagcggcccagcctgggaacctccctgagactctcctgtgcagcctctggattcatcttcaggacctatgccatcgcctacgtcggggtcccgccgagggcctccgagggtccgaagggggtcctaggggaggttgggggtggacctaaagtttactaagttccgaaggaaaaggtagttaggggtaaaactttagggaaaagtaaaaccgacccggttaaacggggaaacgtaacccggttacccgggaaacgggtaaaccggggtcccggtaaacgtttcccgaacccggttaccgttaacccggaacgggtaaaccgtaaacccggtaaacgtttaacccgaaacgggtaaacccaaaccgtaaccgttaacgggacctaacttaccgttaacggtaaactaaaacgttacgtaaacccttaaacccgttaaccaaaccgtaaaggtacgggaaccgggtaccgtaaccggggtaccgttaaggttaacctttaaacgtttaagttcgggttacggaccggtaccgggtacccggttaccccccgtacgggtaacccgggtaccccggttaccccccggg

SEQ ID NO: 291717 - DNA, 619 bp, Homo sapiens
  misc_feature: GYAE6OF02HH73M.44.36.D03.1.454.CMB.1.raw
  modified_base (489)..(489): a, c, t, g, unknown or other
  misc_feature (489)..(489): n is a, c, g, or t
  modified_base (537)..(537): a, c, t, g, unknown or other
  misc_feature (537)..(537): n is a, c, g, or t
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttatttacaaggtgtccagagtgaagtgcagttggtggaggtccgggggagacgttggtccagccgtgggacgggtccctgacgactctcctgtgtccgcctcgtggacttcaccatcagtgaccactatagtggacctgggtccgccgaggcctccggaaggggaacggggctagggaggtggcgttcgggccgacgtaaaggtaaaaaaccaaggttcgacctagtcttttaagacaacgtagacgtaccgccgtcgtctgtagaaacgccaagtacttccaccctctacaagacgatcgtacttacaagaactnaattgattcgagacgtaattcgaaaccttaacgtaacggaaaacccgnggaaccgacgggtactagttagttaatttagttggttgtttaggtttagttttatacgtacgtaagggtaccttggtacccg

SEQ ID NO: 291718 - DNA, 620 bp, Homo sapiens
  misc_feature: GYAE6OF02IP4YJ.44.36.D03.1.454.CMB.1.raw
  modified_base (588)..(588): a, c, t, g, unknown or other
  misc_feature (588)..(588): n is a, c, g, or t
  modified_base (594)..(594): a, c, t, g, unknown or other
  misc_feature (594)..(594): n is a, c, g, or t
  modified_base (597)..(597): a, c, t, g, unknown or other
  misc_feature (597)..(597): n is a, c, g, or t
  modified_base (599)..(599): a, c, t, g, unknown or other
  misc_feature (599)..(599): n is a, c, g, or t
  modified_base (601)..(601): a, c, t, g, unknown or other
  misc_feature (601)..(601): n is a, c, g, or t
  modified_base (603)..(606): a, c, t, g, unknown or other
  misc_feature (603)..(606): n is a, c, g, or t
  modified_base (608)..(608): a, c, t, g, unknown or other
  misc_feature (608)..(608): n is a, c, g, or t
  modified_base (610)..(610): a, c, t, g, unknown or other
  misc_feature (610)..(610): n is a, c, g, or t
  modified_base (612)..(616): a, c, t, g, unknown or other
  misc_feature (612)..(616): n is a, c, g, or t
  modified_base (618)..(620): a, c, t, g, unknown or other
  misc_feature (618)..(620): n is a, c, g, or t
tcagacagtatatacacgaccggtgctcgatttagctgcgtcacgatctctcttgggatcacataacaaccacactcctcctctaaagaagcccctgggagcacagctcatcaccatggactggacctggcggttcctctttgtggtggcagcagctacgaggtgtccacgtcccgaggtgcagcgtggtgcagtcgtgggctggaggtagaagagccgtggtcctcggtgaggtctcgtgacgagcttcgtggaggcctaccttcttcagcttagtgttctttttagttgggtcgcgacgacggccccgtaggacgaagggtcgttggacggtaggcggtaggggaggtactacgtacttcccgtaagttcgttggtgtcgtacgtttacgaacgtttaccggactaacgtaacgtaaacgtttacgaacggtacgtaagtacggtaccctaaaccgttacgtaacccggacggaacggtaaaccacccggtaaggtaacgtacgaacgttaccctaaacgtgtacgggtatccggtaagggccgggacgggtccgtacgggacgaaacggggtcccagttaacggngaacgntangngngnnnngngngnnnnngnnn

SEQ ID NO: 291719 - DNA, 611 bp, Homo sapiens
  misc_feature: GYAE6OF02JAB66.44.36.D03.1.454.CMB.1.raw
  modified_base (312)..(312): a, c, t, g, unknown or other
  misc_feature (312)..(312): n is a, c, g, or t
  modified_base (349)..(349): a, c, t, g, unknown or other
  misc_feature (349)..(349): n is a, c, g, or t
  modified_base (427)..(427): a, c, t, g, unknown or other
  misc_feature (427)..(427): n is a, c, g, or t
  modified_base (519)..(519): a, c, t, g, unknown or other
  misc_feature (519)..(519): n is a, c, g, or t
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctgggacgggtccctgagactctcctggtgtcgcctctggattcaccatcagtgaccactatatggactgggtcccncaggcctccgagggaagggctggagtggcttggccgnaagtaaaaacaaggttcgaccagtctttagcacgagacgtacgccgtgtctgtacgaaagccaagtacttccaccctntacaagagactgaaccttacgaaacgtaactcaattcggatttccgtaggacgtaaattcggtaaacctaaacccgtaggaaaaaacccggnggtaacccgacgggtactaagttcggttaatttagttggttcgtttaggtttacgtttataacgttcgtaagggtaaccttcggtaacccgg

SEQ ID NO: 291720 - DNA, 649 bp, Homo sapiens
  misc_feature: GYAE6OF02G4VYO.44.36.D03.1.454.CMB.1.raw
  modified_base (403)..(403): a, c, t, g, unknown or other
  misc_feature (403)..(403): n is a, c, g, or t
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgtggttttccttgttgttatttacaaggtgtccagagtgaagtgcagttggtggagtccgggggagacttggtccagcctggagggtccctgagactctcctgtgtcgcctctggattcaccatcagtcgaccactatagtggacgtgggtcccgccgaagggcctccgaagggggaagggctgggacgtggcgttgggcccgtcgaaaggtaaaaaaccaaggttcgaccctaaggtctttttaanacctaaccaggaacgttaccggcccggtacgttccgtggtacgaaacgcccaagtaccttccacccgttcacgaaagagtattcgtacttacaaagtacctctaagtttcgaattcgtgacgtaagtacgaaccttaaccgtaggaaaacccggtggaacccgtacgggactagttaggttaattttaggttagttaggttttgttagttttagtaacttacggtaacgggtaccttggtaccccg

SEQ ID NO: 291721 - DNA, 617 bp, Homo sapiens
  misc_feature: GYAE6OF02H5D93.44.36.D03.1.454.CMB.1.raw
  modified_base (326)..(326): a, c, t, g, unknown or other
  misc_feature (326)..(326): n is a, c, g, or t
  modified_base (336)..(336): a, c, t, g, unknown or other
  misc_feature (336)..(336): n is a, c, g, or t
  modified_base (343)..(343): a, c, t, g, unknown or other
  misc_feature (343)..(343): n is a, c, g, or t
  modified_base (503)..(503): a, c, t, g, unknown or other
  misc_feature (503)..(503): n is a, c, g, or t
tcagacagtatatacacgaccggtgctcgatttagctgcgtcacgatctcgtcttgggggactcctgtgccccaccatggacactctttgctacacactcctgctgctgaccaccccttcctgggtcttgtcccaggtcaccttgaaggagtctggtcctgtgctggtacgaaacccacagagacccctcacgctgacctgcaccatctctgggttctctctcaacgatattagaagtgggtgtgagtctggtactccgtcacgcccccgagggaacggccctggacgtggcttgcacacatcttctcgaatgaacaaaatcctanagtacatctntagaganctagttaaccatcctaccaaggaccaacctaccgaaaaggtcagggttacgttactttaacgtactacgaaccctaactacgtacggaccctaggacggtaccacgaggtacaacgtaattacttacgtagttgactaacgggtaagaggaacgggaaanaaacgtaggtcgtttagtttcgtagttaagttaagttaacgttaccttacagtcgtagggtacgtcggtagggaccgaacgggtccgtacggttaccaccgttcgtacctaccg

SEQ ID NO: 291722 - DNA, 752 bp, Homo sapiens
  misc_feature: GYAE6OF02G0QAC.44.36.D03.1.454.CMB.1.raw
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacgttggtccagcctgggacgggtccctgagactctcctgtgtcgcctctggattcaccatcagtcgaccactatatggactcgggtccgccgaggcctaccgaggggaagggcgtgggagtcgggtcgttcgggccgtacgaaacgtaaaaaacgtaaaggttacgaccgtaagtcgttttaataccgaacgtaaggtaacgtacccggcccggtccgtaccgttaggtacggtaaaacgccccgtaaagtactttaccctaacccctcgtaaccgaaaggactaagttacgtaacccttaacgaaacgaaccttcaatttacggtactttacgtacggtaacgtaaagttacgaaaccctttaaacccggtaaacggaaaaaccccgggtaagggaaacccgtaccgggggtaacttaacggtttaacggtttaaagtttttaacggtttgggttttcgttttaagggtttaggtttttaaattaccggtttaccggaaacgggttaacctttaccggtaccccgg

SEQ ID NO: 291723 - DNA, 525 bp, Homo sapiens
  misc_feature: GYAE6OF02IYGK9.44.36.D03.1.454.CMB.1.raw
  modified_base (215)..(215): a, c, t, g, unknown or other
  misc_feature (215)..(215): n is a, c, g, or t
  modified_base (314)..(314): a, c, t, g, unknown or other
  misc_feature (314)..(314): n is a, c, g, or t
tcagacagtatatacacgaccggtgctcgatttagctgcgtcacgatctctcttggggcagagctctggggaggaactgctcagttaggacccagacggaaccatggaagccccagcgcagcttctcttcctcctgctactctggctcccagataccactggagaaatagtgatgacgcggtctccagccacctgtctgtgtctccaggggaaangcccacctctcctgcagggccagtcagagtgttagcagcaacttagcctcgtaccagcagaaatctggccaggcctccaggcctcctcatctatgggtncactccaccgaggcccatggtactcccagccaggttcagtggcaggtcgggtctgggacagtactcactctcaccatcacgcacgcctagacgcctagtaagtagtttgactagtttatagtactgtacgagtcgagcgtacgcaacgtcggccgtactcctaccgttccgaccgaacgggaccacggtacgtaggaacgtagttaaaccg

SEQ ID NO: 291724 - DNA, 639 bp, Homo sapiens
  misc_feature: GYAE6OF02I3VGL.44.36.D03.1.454.CMB.1.raw
  modified_base (254)..(254): a, c, t, g, unknown or other
  misc_feature (254)..(254): n is a, c, g, or t
tcagacagtatatacacgaccggtgctcgatttagctgcgtcacgatctctcttggggatcacataacaaccacactcctcctctaaagaagcccctgggagcacagctcatcaccatggactggacctggcggttcctctttgtggtggcagcagctacaggtgtccagtcccaggtgcagctggtgcagtctggggctggaggtgaagaagccgtgggtcctcggtgaaggtcctcctgcgaaggtcttcgnggagctaccttcttcagctatgtcttttagttgggtcgcgacgtacggtcccctggacgtaagggtcttggaggtggcgtaggggaggtatcgacttcccgttattcgtttggtcgactacgtacgtaactttacggacacgtaaggtaacgtttacgaagggtacagtacgtactaaccgtacgttaccggacgggtaaccgtaactaccgacgtaacgtaaccgaccgtactaccgagtcggacgtaccgtaggaagccgtacggtacgtaaggacgtactaccgtaagaaaccgacgaccggtactacgttacgttagtttcgcggttggaccgttacggccggtcccttacggtaccttacgtttacacgttacccgtccc

SEQ ID NO: 291725 - DNA, 765 bp, Homo sapiens
  misc_feature: GYAE6OF02HV63V.44.36.D03.1.454.CMB.1.raw
  modified_base (185)..(185): a, c, t, g, unknown or other
  misc_feature (185)..(185): n is a, c, g, or t
  modified_base (353)..(353): a, c, t, g, unknown or other
  misc_feature (353)..(353): n is a, c, g, or t
  modified_base (610)..(610): a, c, t, g, unknown or other
  misc_feature (610)..(610): n is a, c, g, or t
  modified_base (680)..(680): a, c, t, g, unknown or other
  misc_feature (680)..(680): n is a, c, g, or t
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttatttacaggtntccagagtgaagtgctaggttggtggaggtccgggggaagtacgttgggtcccaaggtcccgtggggtacgggtccccttaggacggacttcgtccgtggttcgtccgccttacgtggtacttcgaccattcagtggaacccacttaatcgtggaccttcggggtccnccaggtcctaccgagggggtaagggctggggagtgggacgttcgggcccgtaacgaaaagtaaaaaaacgtaaggttcgaccgtagttacttttaacacgaaccgaagtaccggtaccggccgtacggttcctaggtaacggaaacggccctaaggtaaccgtttacccaccccgttactaccggaaaaggtacgtaacgttacggtaaccttaacgaaaacggtaacctacgtaacgtttcgtaaacgtttaccgngtaacccgaaagtttaccgaaacctttaaaacccggaaacggtaaaaaacccgcggaacgtacccggggntttaacggtaacttaagttttacgttagtttaggtttgtttaacgtttaagttacgtacggtaagggttaacctggttaacccgg

SEQ ID NO: 291726 - DNA, 666 bp, Homo sapiens
  misc_feature: GYAE6OF02JTP8B.44.36.D03.1.454.CMB.1.raw
tcagacagtatatacacgaccggtgctcgatttagctgcgtcacgatctctcttggggatcacataacaaccacactcctcctctaaagaagcccctgggagcacagctcatcaccatggactggacctggcggttcctctttgtggtggcagcagctacaggtgtccagtcccaggtgcagctggtgcagtctggggctgaggtgaagaagccgtcgggtcctggtgacggtctcctaggctaaggtcgttcgtggacggtctaccttcgttcagtcttatttgttcgttttagtttgggtcgcggaccgtacgggccccgtagggacgtaagggtcgttggacggtggggacggtggggtacggtatccgtacgttcccgttagttcgtttggtacgtacgtacgttacgtaacttacgtacgtaacgtaacggtaacggtttacgaagggtacgtaacggaacgtaccgtaacccgtaacgttaacccggacggtaaccgtaaacgtaccgaacgtaacgtaccgtaacgtacctaacgacgtacggacgtcgtagagtcgaggcgtagacgtagtacgagaacgacgacgtactacgttcgttacgttacgtacggtacgacgtacgtacgtccgttaccgttacctaactttcgtactccg

SEQ ID NO: 291727 - DNA, 517 bp, Homo sapiens
  misc_feature: GYAE6OF02F0CAL.44.36.D03.1.454.CMB.1.raw
  modified_base (432)..(432): a, c, t, g, unknown or other
  misc_feature (432)..(432): n is a, c, g, or t
tcagacagtatatacacgaccggtgctcgatttagctgcgtcacgatctctcttggggatcacataacaaccacactcctcctctaaagaagcccctgggagcacagctcatcaccatggactggacctggcggttcctctttgtggtggcagcagctacaggtgtccagtcccaggtgcagctggtgcagtctggggctgaggtgaagagcctgggtcctcggtgaaggtctcctgcaaggcttcgtggaggcaccttcttcagctatgtctttttatttgggtgcgtacgaggcccctggaccgaagggcttgagtggcgtgggaggatcatccgtatcgttggtgctagtacgaattacgcacagtaagtttcaggacagagtacacctattaccgcggacaactccacgagtacagcctacataggancgtagagcgaggctgagtatgagaacgacacggctatctagttctgtgcgtagacgcccttcgtaccttaacttcattccgtccc

SEQ ID NO: 291728 - DNA, 657 bp, Homo sapiens
  misc_feature: GYAE6OF02GZHIB.44.36.D03.1.454.CMB.1.raw
  modified_base (331)..(331): a, c, t, g, unknown or other
  misc_feature (331)..(331): n is a, c, g, or t
tcagacagtatatacacgaccggtgctcgatttagctgcgtcacgatctctcttgggggactcctgtgccccaccatggacactctttgctacacactcctgctgctgaccaccccttcctgggtcttgtcccaggtcaccttgaaggagtctggtcctgtgctggtgaaacccacagagaccctcacgctgacctgcaccatctcgtggttctctctcaacgatattagaagtgggtgtgagctggactccgtcaccgccccgagggaacggcccctgggacggtggtcttggacctacacatcttctcgaatagaacgaaaactcctanaagtacatctctagaagacgactacgttaacctactcctacgaacgaccaaccgtaaccgaaacggactagggttacgtactttagtacgtacgaaccacagtacgacccgtaggccgaacacgacggacactaatacttacgtgtacgtacgaggtaagtcggaaacgggaaaacgaaagtcgtacgtttacggtttacgttagttaacgtttaagttaacgttactttaacgtacgtttcggttacggtacggttacgggtacgggtaaaccggtaaccgggaccgttaaccgggtaccctaacccggttcctacccgtaccgg

SEQ ID NO: 291729 - DNA, 593 bp, Homo sapiens
  misc_feature: GYAE6OF02GU01I.44.36.D03.1.454.CMB.1.raw
tcagacagtatatacacgaccggtgctcgatttagctgcgtcacgatctctcttgggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtctgggggagagcggcccagcctgggactcctgagactctcctgtgcagcctctggattcatcttcaggacctatgccatgcacgtcgggtccgccgaggctccgaggcgaaggggctgggagtggggtggactaattatatcgaagaagatggaaattgaaagaacacgtacggaagacgtaccgaacggaagggccgagttccgaccgtctccgagacgactaacttaccaggaaccacactagcatctacgactaaacgtagtaaccaaccgtaccaacgtaaacgtacgaacggacgtaccggtacgtacgttacttaagttactttggttacgacggtacggaccgtaccccccgtcggtaccggacccggttaccccccgg

SEQ ID NO: 291730 - DNA, 765 bp, Homo sapiens
  misc_feature: GYAE6OF02G8LDT.44.36.D03.1.454.CMB.1.raw
  modified_base (305)..(305): a, c, t, g, unknown or other
  misc_feature (305)..(305): n is a, c, g, or t
tcagacagtatatacacgaccggtgctcgatttagctgcgtcacgatctctcttggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggcccagcctgggaacctccctgagactctcctgtgcagcctctggattcatcttcaggaccctatcgccatcggcactgggtccnccaggctccgagggccaaggggtctgggaggtggggtggactaaagttatagtcaagggtaaagattagggaaatttagggaaaacgtaaacgaacgttaccgggaaggaacccgttaccggaaacgggtaaacggggaccccggtaaatttacccggtaaccccggttaccgttacccggaaaggaaaccggtaaccctaaaacgttaccccgaaaacgggtaaaccaaccgaaccgttacggaccaacgttacctaacggtaacctaaaagtttaccggtaaaccctaaacccttaaccgaaaccgtaaacgggttacggaaaccgggtaccgtaacccgggtaccgttaacggttaccgtttaaacgtttaacgtttacggtaacggtaccgggtaacggtaacccggtacccccccggttaacgggacccgggtaaccccgggttaacccccccgg

SEQ ID NO: 291731 - DNA, 528 bp, Homo sapiens
  misc_feature: GYAE6OF02HZXXF.44.36.D03.1.454.CMB.1.raw
tcagacagtatatacacgaccggtgctcgatttagctgcgtcacgatctctcttggggatcacataacaaccacattcctcctctaaagaagcccctgggagcacagctcatcaccatggactggacctggaggttcctctttgtggtggcagcagcaacaggtgtccagtccctggtgcacctggtgcagtctgggactagaatgccgcaacccttggtcctcggtgaccccttttcctgcacggcctctggaagtactaccagttccactacttataccatcaactgggtgcgccaggcccctggacaagggcttgagtggatgggtggaatcatccctctttttggctcactcacctacgcacgagacttccggggcagaattacgattaccgcggacaagtccacagacacagtctccatgacaatgagttcttagaatccgacgacacggccgtctactactgtgcgagaggtcccgtaccccgagcctcgcatggagccgtttgagtgttcgtggggtaccg

SEQ ID NO: 291732 - DNA, 810 bp, Homo sapiens
  misc_feature: GYAE6OF02IGS28.44.36.D03.1.454.CMB.1.raw
  modified_base (292)..(292): a, c, t, g, unknown or other
  misc_feature (292)..(292): n is a, c, g, or t
tcagacagtatatacacgaccggtgctcgatttagctgcgtcacgatctctcttgggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggaggagccggcccaggccctggggaacctcccgtgagactcgtcctgtgcagcctctggattcatcttcaggacctangccatcgcctacgtcggggtcccgccgacggcctaccgagggaccgaaggggggcctaggggaacggttgggggtcggactaaagtttacgtaatacgaaggtaaagtagtagggtaaatttggaaaacggtaaaccgaaccgttaacgggaacgtaccgtaccgggaaacggggtaaacggggtacccggtaacgttacccgtaacccggttaccgtaccgaaacggtaacggaaccgttaaaccgtttaacccggaaacgggaaaacctaaccgtaacccgttacggaacctaacgttaccgttaacgaacctaaaagttaccggttaaaccgtaaaccccttaaccggaaacgtaaaaccgggtacgggaacgggtaacccgacccgggttaaccgttaacggtttaccgttaaacgttttaaggtttaccgttaagggtcccggtaacggtaccccggtaaccccccccggttacggggtaaccccggggtaccccgggttaaccccccccggg

SEQ ID NO: 291733 - DNA, 737 bp, Homo sapiens
  misc_feature: GYAE6OF02JXT1L.44.36.D03.1.454.CMB.1.raw
  modified_base (186)..(186): a, c, t, g, unknown or other
  misc_feature (186)..(186): n is a, c, g, or t
  modified_base (207)..(207): a, c, t, g, unknown or other
  misc_feature (207)..(207): n is a, c, g, or t
  modified_base (219)..(219): a, c, t, g, unknown or other
  misc_feature (219)..(219): n is a, c, g, or t
  modified_base (361)..(361): a, c, t, g, unknown or other
  misc_feature (361)..(361): n is a, c, g, or t
tcagacagtatatacacgaccggtgctcgatttagctgcgtcacgatctctcttgggcagagctctgggaggaactgctcagttaggacccagacggaaccagtggaagccccagcgcagcttctcttcctctgctactctggcctcccagactaccactggacgtaatagtgatgacgcggttcnccagccaccgtgtctgtgtcnccgaaggggaancgcccacccttcaccgtgccagggccaagtcagacgtcgtacagacacttagcctacggaccaccagtaaccgtgggacaggtcccgtcccaggcctcctacgattcacgtcgacactccaccgaggcctaacgtcgtaacncccgacctagggtcagtcggctaggtccggtaccgggactaggtaccgttcaaccgttccgtacgaaccacgttacgaccggtcccggccgttgaccgttacgtccgtaggtaccggtttaacgtttacggtaccttaacgggttttaactttacgttacggtcgtaacccggttaagtaaacgtttaaaccgttaaacttaacccggtttaacccgtacccctttacccgggttcccggtaacgtaacccggggtaccgaaccgtttaaacggtacggggttaaacgtttaaacccggttaaaacccggttacgttaacggggttcccgttaacggtaccggttacccaacccgtttacgtccccgtttaaacgg

SEQ ID NO: 291734 - DNA, 804 bp, Homo sapiens
  misc_feature: GYAE6OF02HS36H.44.36.D03.1.454.CMB.1.raw
  modified_base (206)..(206): a, c, t, g, unknown or other
  misc_feature (206)..(206): n is a, c, g, or t
  modified_base (221)..(221): a, c, t, g, unknown or other
  misc_feature (221)..(221): n is a, c, g, or t
tcagacagtatatacacgaccggtgctcgatttagctgcgtcacgatctctcttggggagctctgagagcggagccccagccccagaattcccaggtgtttcatttggtgatcagcactgaacacagaggactcaccatggagttcgggctgagctgggttttccttgttgttatttacaggtgtccagagtgaagtgcagttggnggaggtccggggganacgttcggtaccagtccgtgggacgggtccctggagacgttctcctggtcgttccgcctctcggtacttcaccatcagtcgacctactatatggacgtgggtccgaccacggcgtccgaagggggaacggggctcgggaggtcgggtcgttacgggccgtaacgaaacggttaaaaaaaccgtaaaggttacgacccgtaaacggttacttttaaaccggtacctaaacgtaacggtaaaccgggttaaacccggtcccgggaccggtttcgtaacggttaacggaaaaccggacccctaaaggtaacctttacccgaaaccccgtttccgtaaccaaacggtacgtaattcgggttaaaccttaacggtaaaacgtaaacttaccgtaagttttaggtaaacgttttccagggtaacgtaaacgtacgttaaaaccgttaaacccggaaacggtaaaaacccgggaggaacccggtaaccggggacctaaaggttaccgttaaagtttagtttggtttaggttttacgttagggtttttaacaaccgtttaacggttaacggttaaccttccggtaacccgg

SEQ ID NO: 291735 - DNA, 692 bp, Homo sapiens
  misc_feature: GYAE6OF02IHJ2V.44.36.D03.1.454.CMB.1.raw
  modified_base (328)..(328): a, c, t, g, unknown or other
  misc_feature (328)..(328): n is a, c, g, or t
tcagacagtatatacacgaccggtgctcgatttagctgcgtcacgatctctcttggggcagagctctggggaggaactgctcagttaggacccagacggaaccatggaagccccagcgcagcttctcttcctcctgctactctggctcccagataccactggagaaatagtgatgacgcggtctccagccaccctgtctgtgtctaccgaagggaagcgcccaccctctcctgcgagggccagtcaggtagttgttagcaagtctaacttcgccctcgtaccagaccaagaaacttcgacggccaggccctaccgaggtccctacctnaacttctaagtcgggtcacctacgtacccgaaccggacgggcctacgttcgggtaacctcccgaggaccgttagggttcaacggggttcggacgttaggggtcgggtacgtacggggactaggtacttcctaactcgtacctaaccactaccgtacgactaccgtctcggactacggttaccgtagtaacggtttctttacggtacgtttaacttttacgttaccgtcgttaccgtaagtacgttaacgttaattaaccggttcgtaccggttcccggtaccccgttacccggtaccgggaaccgtaaacggaccgtaccggttaaggtacccgggtaaagtaacgttaaccggaacgttcggg

SEQ ID NO: 291736 - DNA, 668 bp, Homo sapiens
  misc_feature: GYAE6OF02GKYP9.44.36.D03.1.454.CMB.1.raw
  modified_base (224)..(224): a, c, t, g, unknown or other
  misc_feature (224)..(224): n is a, c, g, or t
  modified_base (253)..(253): a, c, t, g, unknown or other
  misc_feature (253)..(253): n is a, c, g, or t
  modified_base (389)..(389): a, c, t, g, unknown or other
  misc_feature (389)..(389): n is a, c, g, or t
  modified_base (465)..(465): a, c, t, g, unknown or other
  misc_feature (465)..(465): n is a, c, g, or t
  modified_base (477)..(477): a, c, t, g, unknown or other
  misc_feature (477)..(477): n is a, c, g, or t
tcagacagtatatacacgaccggtgctcgatttagctgcgtcacgatctctcttggggactcctgtgccccaccatggacactctttgctacacactcctgctgctgaccacccttcctgggtcttgtcccaggtcaccttgagagtctggtcctgtgctggtagaaacccacagacgaccctcacgctcgcctgccaccatctcttggttctctactcaacgntattagattggtgtcgagctgatccgtcncgccccgagggaacgcccgttagggagtggctttggaccacgtacattccttacgtacggtaactaagaaaccgtaaaaacgtcctaaccgaagtacaacttcctcgtaaggaacgtacgacgtaactttaaaccnctaccgtaaccaacggaacctaaccaaccgaaaacgggtcaagggtcgtttacgtttaacgagttacgactaaacncgtacgtaccgngacgacgaataccggactaacaacgtttattaaccggtgtccggtacgtacgggtaaatccggaaagggaaacgacgtagtccgttagtttacgtgttaactaagttacccgttatacctacgttaacgtggtaaccgtgtaacggggactaaaacgggtccctacggtaacgtcccgttagcccgttacg

SEQ ID NO: 291737 - DNA, 507 bp, Homo sapiens
  misc_feature: GYAE6OF02IR09O.44.36.D03.1.454.CMB.1.raw
tcagacagtatatacacgaccggtgctcgatttagctgcgtcacgatctctcttggggatcacataacaaccacactcctcctctaaagaagcccctgggagcacagctcatcaccatggactggacctggcggttcctctttgtggtggcagcagctacaggtgtccagtcccaggtgcagctggtgcagtctggggctgaggtgaagaagcctgggtcctcggtgaaggtctcctgcaaggcttctggaggcaccttcttcagctatgcttttattgggtgcgacaggcccctggacaagggcttgagtggctgggaggatcatccctatcttggtgcatcgaattacgcacagtagtttcaggacagagtcaaccattaccgcggacgaatccacgagtacgagcctacatggagcctgagcgaggctgagatcgtgaacgacgacggccatcgtattctggtgcgtacgacgcccttcggtacctaactttcacttcgtaccc

SEQ ID NO: 291738 - DNA, 716 bp, Homo sapiens
  misc_feature: GYAE6OF02IEEDK.44.36.D03.1.454.CMB.1.raw
  modified_base (405)..(405): a, c, t, g, unknown or other
  misc_feature (405)..(405): n is a, c, g, or t
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttatttacaggtgtccagagtgaagtgcagttgggtggaggtccgggggagacgttggtccagtccgtgggacgggtccctgacgtactcctctgtgtccgcctcgtggtattccaccatcagtcgaccactatatggacgtcgggtccgccgacggcctccggaggggagggcgtggagtggtcgttcggccgactaaaggtaaaaacgagttcgacctaagtactttaacnccgaacgtaggtacgtaccgccgtccgttcgtaggtacgaaaacgtcccaagtacctttccaaccccgttctaccgaagtacgtaacgttacgtaaccttacgaaacgtaaccttctaagtttcgaattttaccgtacgggtaacctaacgttaccgtaaaccttaaacccggttaaacgggaaaaaccccggtaacgggaaccggaccggggtaaccttaaggttaacggttaattttcggttaggttttacgtttaggttttaagttttacttaaggttacggtaaacggttacctcggttaacccggg

SEQ ID NO: 291739 - DNA, 799 bp, Homo sapiens
  misc_feature: GYAE6OF02H5MAQ.44.36.D03.1.454.CMB.1.raw
  modified_base (780)..(780): a, c, t, g, unknown or other
  misc_feature (780)..(780): n is a, c, g, or t
tcagacagtatatacacgaccggtgctcgatttagctgcgtcacgatctctcttggggatcacataacaaccacactcctcctctaaagaagcccctgggagcacagctcatcaccatggactggacctggcggttcctctttgtggtggcagcagctacgaggtgtccagtcccgaggtgcagctggtgcagtcgtgggctgaggtgaagagccgtgggtcctcgggtagaaggtctccgtgacgaaggtctttcgtgggaggtcctaccctttcttcgagtcttagttgttacttttttaggtttgggttgaccggacgtacggtcccccgtaggacgaagggtccttaggacggttcggacggtgggggtacgggtatccgtaacgtttcccgttaacgtttccggttttcgggttggtaccttaacggtttacccggtaaaagtttacccggaccgtaaacgttaaacgggttaaaccggttttaccgaaacggggaaccgttaagggtaaccggtaaccctaacccggttaaccggttttaaccccggacccgggtaaaccgtaaaccttacccggaaaccggtaacggttaaccgaccgtacccttaaccgaaggttacgggacggtaccggtacggacggtacggaacgtcgtaaggacgtacgttacgtaacggaaacgtaaccggaccgtacctacgtttaccgttttagtttaccggtcggtacggtaccggtaacgcccgttcccgttacgttaccttaacccgttttntaacccgttcgttaccccc

SEQ ID NO: 291740 - DNA, 628 bp, Homo sapiens
  misc_feature: GYAE6OF02HQG7E.44.36.D03.1.454.CMB.1.raw
  modified_base (224)..(224): a, c, t, g, unknown or other
  misc_feature (224)..(224): n is a, c, g, or t
  modified_base (238)..(238): a, c, t, g, unknown or other
  misc_feature (238)..(238): n is a, c, g, or t
tcagacagtatatacacgaccggtgctcgatttagctgcgtcacgatctctcttgggggactcctgtgccccaccatggacactctttgctacacactcctgctgctgaccaccccttcctgggtcttgtcccaggtcaccttgaaggagtctggtcctgtgctggtgaaacccacagagaccctcacgctgacctgcaccatctctgggttctctctcaacgntattagaatgggtntgagctggactccgtcagcccccagggacggccctggagtggcttgcacacgatcttctcgaatgaacgaaaatcctacagtacatctctgaagagctaagttaaccatctcaagacacctacaaaggcaggtcggttctttaagtactagaccgaactagtcggacctagccggacacaggcaacattactactgtagacgtacggtaatcggaacggtaaagtaaacgaaggtaccgttacggtttacgttagttaactttaacgttaacgttaccgtttaaccgtacgttacgttaaccgggtaccggttggttaacccgggggaacgtaaaaccgggggtaccctaaccgggttacccgtacccggtttacctaccccgttaacgg

SEQ ID NO: 291741 - DNA, 811 bp, Homo sapiens
  misc_feature: GYAE6OF02ISMIH.44.36.D03.1.454.CMB.1.raw
tcagacagtatatacacgaccggtgctcgatttagctgcgtcacgatctctcttgggggggagacgagcccagcactggaagtcgccggtgtttccattcggtgatcatcactgaacacagaggactcaccatggactttgggctgagattgggttttcctcgttgcttcttttaagaggtggccagtgtcaggtgcagctaggtggagtcgtggggggagacgccggacccaggccgtggggaaccttcccgtaggaacgaccttccgtccgttaggtcgccaacggtcccttcgtaggtactttcacttcctttcgaacggtacccttagccggtaccctagtcgcctaacggttcggggtccccaccgacggtcctaaccggacggggaccgaaacgggggtcctgggggaggttcggggtacggaacctaatttaacgacttacggaaagtaaaggtagttagggtaaattacggaaaaacgtaacctaccggtaaacggggaacctaccgtaccgggaaaggtaaaccgggtacccgtattacccgaccggttcctaaccgaaggtaaccgaacttaaaccttaccggaaacggaacctaccgtaaacgttgaccgtaacgttcccgtaacggtaaaccgtaaagttacccgtaaacccgtaaacccgttacgtaaaccggtaaaacggttcggaaaccggaccgttaaccggtacgttacgtttaacgttaactttagggttacgtacggtacccgaacggttacccccgtcccgggtaccgaccggtaccccggtttaaccccg

SEQ ID NO: 291742 - DNA, 613 bp, Homo sapiens
  misc_feature: GYAE6OF02FQU4B.44.36.D03.1.454.CMB.1.raw
  modified_base (376)..(376): a, c, t, g, unknown or other
  misc_feature (376)..(376): n is a, c, g, or t
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctgggagggtccctgagactctcctgtgtcgcctctggattcaccatcagtgaccactatatggactgggtccgccaggctccgagggaagggctgggagtggcttggccgacgaagtaaaacaagttgaccagtctttancacagacgtacgccgtcgtctagtagaacgccagtacttccaaccctctacgaagagattcgacttcaaacgtaactcctaagtttcagtttacgtcgacgtaaagtcgtaaaccttaaaccgtaacggtaaaaacccggagggtaaccgacggggtactaaggtttgttaacttttaagttggttagttttggtttagttttattacgtacggtaacggtaacttcggtaaccccg

SEQ ID NO: 291743 - DNA, 641 bp, Homo sapiens
  misc_feature: GYAE6OF02FR237.44.36.D03.1.454.CMB.1.raw
  modified_base (275)..(275): a, c, t, g, unknown or other
  misc_feature (275)..(275): n is a, c, g, or t
  modified_base (292)..(292): a, c, t, g, unknown or other
  misc_feature (292)..(292): n is a, c, g, or t
  modified_base (387)..(387): a, c, t, g, unknown or other
  misc_feature (387)..(387): n is a, c, g, or t
  modified_base (408)..(408): a, c, t, g, unknown or other
  misc_feature (408)..(408): n is a, c, g, or t
  modified_base (477)..(477): a, c, t, g, unknown or other
  misc_feature (477)..(477): n is a, c, g, or t
  modified_base (534)..(534): a, c, t, g, unknown or other
  misc_feature (534)..(534): n is a, c, g, or t
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacgttggtccagcccgtgggagggtccctgagacctctcctgtgtcgcctntggattcaccatcagtnaccatatatggactcgggtccgccgaggcctccgaggggaagggctgggagtggcttgggccacgaagtaaaaacaagttcgaccagtactttancgacgagtgtaccgccgcgtngtagaacgccgaagtattaccacccttctacgaaacgtacgtattcgtaacctttacgaaagtaacctnttaagttagtacgttcctagaccgtaaatcgtaaaccttaacgaacggaaaaaccgngggaacctacgggactaacggttgttaacgtttaagtttcggttacggtttttagttacgggtttttaattaacgtacggttaacggttaaccgttcggttaacccg

SEQ ID NO: 291744 - DNA, 735 bp, Homo sapiens
  misc_feature: GYAE6OF02GSFKQ.44.36.D03.1.454.CMB.1.raw
  modified_base (271)..(271): a, c, t, g, unknown or other
  misc_feature (271)..(271): n is a, c, g, or t
  modified_base (315)..(315): a, c, t, g, unknown or other
  misc_feature (315)..(315): n is a, c, g, or t
  modified_base (644)..(644): a, c, t, g, unknown or other
  misc_feature (644)..(644): n is a, c, g, or t
  modified_base (707)..(707): a, c, t, g, unknown or other
  misc_feature (707)..(707): n is a, c, g, or t
tcagacagtatatacacgaccggtgctcgatttagctgcgtcacgatctctcttggggagctctgagagcggagccccagccccagaattccccaggtgtttcatttggtgatcagcactgaacacagaggactcaccatggagttcgggctgagctgggttttccttgttgttatttacaaggtgtccagagtgaagtgcaggttggtggagtccgggggagacttggtccagcctggagggtccctgagactctcctgtgtcgcctcgnggattcaccatcagtcgaccactatagtcggacctggggtcccnccgaggctaccgaggggaaggggctgggagtgggcttcgggacccgagtaaaggtaaaaaaccaagggtttcgacccgtaaggtcctttttaaacgccgaaacgtaaaggaaccggttaacccggcccgggtacccggttcgttagggtaaccggtaaaaacggcccccgaaacggtaaccttttccccgaaacccccgtttacgtacccgaaaaagggacgtaacttcgggaaacccttttacggaaaacaaaccgtttcaagttttcggaaccttcggtacgtacgtaaatccggttaaaccttaaacccgagaaaaaacccggggngaacccggacgggacacggtttaaggttaattacgttttaggtacgttttggacgtttttaanactaccggtaaggaccgttcggtaaccg

SEQ ID NO: 291745 - DNA, 600 bp, Homo sapiens
  misc_feature: GYAE6OF02I9XON.44.36.D03.1.454.CMB.1.raw
  modified_base (341)..(341): a, c, t, g, unknown or other
  misc_feature (341)..(341): n is a, c, g, or t
  modified_base (384)..(384): a, c, t, g, unknown or other
  misc_feature (384)..(384): n is a, c, g, or t
  modified_base (578)..(578): a, c, t, g, unknown or other
  misc_feature (578)..(578): n is a, c, g, or t
tcagacagtatatacacgaccggtgctcgatttagctgcgtcacgatctctcttgggtagctctgagagcggagccccagccccagaattcccaggtgttttcatttggtgatcagcactgaacacagaggactcaccatggagttcgggctgagctgggtttttccttgttgttattttacaaggtgtccagagtgaagtgcagttggtggaggtccgggggagacttggtccagccgtggagggtccctgagactctcctgtgtcgcctctggattccaccatcagtgaccacttatagtggacgtgggtccgcgaggcctccgaggggagggcgtggngtggcttggccgcgaagtaaaaacaagttacgccagtctttanacacagagtacgccgcgtctgtagaacgccagtacttccacctctacaagacgagttagacttacaaacgaaccttatatttacgtactttccgtaggaacgtaagttacgaaccttaaaccgtacggaaaaacccgtcgggaaccgacgggacctagttagttatttagttcgttgttttaggttattttatnttacggagtacttcgtaacccg

SEQ ID NO: 291746 - DNA, 620 bp, Homo sapiens
  misc_feature: GYAE6OF02F75ZR.44.36.D03.1.454.CMB.1.raw
  modified_base (410)..(410): a, c, t, g, unknown or other
  misc_feature (410)..(410): n is a, c, g, or t
tcagacagtatatacacgaccggtgctcgatttagctgcgtcacgatctctcttggggagctctgagagcggagccccagccccagaattcccaggtgtttcatttggtgatcagcactgaacacagaggactcaccatggagttcgggctgagctgggttttccttgttgttattttacaaggtgtccagagtgaagtgcagttggtggaggtccgggggagacttggtccagccgtggacgggtccctgagacctctcctgtgtcgcctcgtggattccaccatcagtgacccacttatagtggacgtcggggtcccgaccgaggcctaccggagggggaaggggctggggaggtgggcgttgggccgacgaaaggtaaaaacgtaaaggttcgaccagtactttacncaacagacgtccgccgtcgtgtgtagaaacgcaagtacttcccaccctcacaagatatcgtacttacaagaacttctagtttgatttgcgtacgtaagtcgtaaacctaacgtaacggaaaaccgaggaaccgacgggactagttagttatttacgttggtttagttgtttacgtttaagttacttacggtaacggttactggtaacccg

SEQ ID NO: 291747 - DNA, 698 bp, Homo sapiens
  misc_feature: GYAE6OF02HKYY3.44.36.D03.1.454.CMB.1.raw
  modified_base (160)..(160): a, c, t, g, unknown or other
  misc_feature (160)..(160): n is a, c, g, or t
tcagacagtatatacacgaccggtgctcgatttagctgcgtcacgatctctcttggggatcacataacaaccacactcctcctctaaagaagcccctgggagcacagctcatcaccatggactggacctggcggttcctctttgtggtggcagcagctanaggtgtccagtcccaggtgcagctggtgcagtcgtggggctgaggtagaagaagtccgtgggtcctgggtagaaggtctccgtgacgaaggtcttacgtggaggtcctaaccgtttctacgagtcctagttgtcgtttttagttgggtgtccgacgtacggtccccgtaggaacgaggtcttggacggttgcgtgggaggactacgactccgtattcgtttggcgactagtacgtaacttcgactaactaaggtaagtttaccgaaggacgtaagtagtacctaaccgtaacgttaacccgggacgtaaaccggtaacgtacccgaaacggtaacgtaaccgaaccgtaccgttaaacgacggttaggaaacgccgttagggacgaacgtaacgggtcgtaaacgacgtaacggttacaacgggaaacggacccgtaacgggaccttacggttaacctttagtttccgcggttacggacggtaaccggaccgttcccggtacttaccgttaaacctttacgtacgtaacccgttcccg

SEQ ID NO: 291748 - DNA, 671 bp, Homo sapiens
  misc_feature: GYAE6OF02JY0ZH.44.36.D03.1.454.CMB.1.raw
  modified_base (305)..(305): a, c, t, g, unknown or other
  misc_feature (305)..(305): n is a, c, g, or t
  modified_base (336)..(336): a, c, t, g, unknown or other
  misc_feature (336)..(336): n is a, c, g, or t
  modified_base (546)..(546): a, c, t, g, unknown or other
  misc_feature (546)..(546): n is a, c, g, or t
  modified_base (562)..(562): a, c, t, g, unknown or other
  misc_feature (562)..(562): n is a, c, g, or t
tcagacagtatatacacgaccggtgctcgatttagctgcgtcacgatctctcttggggggagacgagcccagcactggaagtcgccggtgtttccattcggtgatcatcactgaacacagaggactcaccatggactttgggctgagatgggttttcctcgttgctcttttaagaggtggccagtgtcaggtgcgagctagtggagtcgtgggggaggaggccggcccagcccgtggggaacctcccgtgagaccgtctccgtgtgccgacgtcctcgtggatttccattccgttcacggacctntacgccagtcgccgaccgtcggggtaccccncccgtaacgggtccctcccgaacgggaccggtaacggggggccttagggggacggttggggggttacgaccgtaaagttaccgtaagttcgaaagtaagtacgtggtaaacgttagaaacgaaactacggtaacgggagtaacctaccggaaggaacgggtacgtacgtacgaccgtaccgaccgtagaacgaactactacgacgaaacncgactcgacgagtccngacctaaagccgtaactacctacaacgtaagtacggagaccgtcgtacgtaatcgtagttatggtagaccgtacggtacccgaccccggtagacccgtacggttacccg

SEQ ID NO: 291749 - DNA, 680 bp, Homo sapiens
  misc_feature: GYAE6OF02GZ2NR.44.36.D03.1.454.CMB.1.raw
  modified_base (273)..(273): a, c, t, g, unknown or other
  misc_feature (273)..(273): n is a, c, g, or t
  modified_base (277)..(277): a, c, t, g, unknown or other
  misc_feature (277)..(277): n is a, c, g, or t
  modified_base (318)..(318): a, c, t, g, unknown or other
  misc_feature (318)..(318): n is a, c, g, or t
  modified_base (395)..(395): a, c, t, g, unknown or other
  misc_feature (395)..(395): n is a, c, g, or t
  modified_base (419)..(419): a, c, t, g, unknown or other
  misc_feature (419)..(419): n is a, c, g, or t
tcagacagtatatacacgaccggtgctcgatttagctgcgtcacgatctctcttggggagctctgagagcggagccccagccccagaattcccaggtgtttcatttggtgatcagcactgaacacagaggactcaccatggagttcgggctgagcttgggttttccttgttgttattttacaaggtgtccagagtgaagtgctagttggtggaggtccgggggatacgttggtccagtcctgggacgggtccctgagtactctccgtgtgtcncctntggattcacctatcagtgaccactatatggactgggtcccnccgaggtcctccgaggggaagggctgggagtggcgttgggccgacaaaggtaaaacaaggttcgacctagtctttancgaacgagacgtaccgccgcgttntaggtacgaaacgcccaagtaccttccacccttacgtaccaaaggtagaacttcgtaaccttacgaaaacgtaacgttctaagtttcgtaactttccgtaggtaaccgtaacttacgggtaaacccttaaaacccgttaaacgggaaaaaacccgttcgggaaaccgtacccggggtacttaaggttaacggttaatttacgttaggttagtttcgtttaaggtttaataccgtaggtaacggtaacgttcgttaacccgg

SEQ ID NO: 291750 - DNA, 602 bp, Homo sapiens
  misc_feature: GYAE6OF02G4736.44.36.D03.1.454.CMB.1.raw
  modified_base (225)..(225): a, c, t, g, unknown or other
  misc_feature (225)..(225): n is a, c, g, or t
  modified_base (532)..(532): a, c, t, g, unknown or other
  misc_feature (532)..(532): n is a, c, g, or t
tcagacagtatatacacgaccggtgctcgatttagctgcgtcacgatctctcttggggagctctgagagcggagccccagccccagaattcccaggtgttttcatttggtgatcagcactgaacacagaggactcaccatgggagttcgggctggagctgggttttccttgttgttatttacaggtgtccagagtgaagtgcaggttggtggaggtccggggganacttggtccagcctgggacggtccctgagactctcctgtgtcgcctcgtggacttccacctatccaggtcgacctactatatcggactcgggtcccgcgaggcctccgaggggacgggctggagtggccgtggccgacaaagtaaaacaggttcgacagtcttatcacaggactacgccgtcgtctagtagaaacgtcaagtacttccaccctctacgaagtagtatacgtaaccttagaaacgtaactacgtattagtacttacgtgtaacgtaattacgaaacctaaaccgtaacggaaaaccgnggtaaccgacgggatagtacgttaatttacgttagttgtttagttatttatatacgaggtacctgtaccg

SEQ ID NO: 291751 - DNA, 735 bp, Homo sapiens
  misc_feature: GYAE6OF02JT880.44.36.D03.1.454.CMB.1.raw
tcagacagtatatacacgaccggtgctcgatttagctgcgtcacgatctctcttggggatcacataacaaccacactcctcctctaaagaagcccctgggagcacagctcatcaccatggactggacctggcggttcctctttgtggtggcagcagctacaggtgtccagtcccaggtgcagctggtgcagtctggggctgaggtgaagaagcgtgggtcctcggtgaaggtctcctgcgaaggtcttcgtggaggctaccttcttcagctatgtcttttagttgggtgccggacacggtccccgtaggaaccgtaaggggtcttaggacggttcgggtacggtaggggagggtacttccgaacttacccgttacgttcgtttaggggtcgtaccgtacgttacggtaagttaccgacgtaaacgtaggttaacgtttacggaagggtactaacggtacgttacccgaaaccgtacgtttaaaccccggacgggtaacctaaacgtacccgaacgtaacggtaacccgaccgtacctaaacggtacgttacggggactaccgttacgggacaccggtacgggtaccgtaggaacggtaaccgtttcgtaaacgggaaaccggtaaccggtaaccgggtaccctaggttacccttttaggtttcccggtaggtacggtaaccgaaggtcccgtaccccgttagttaccctaacggtttcctagttaccccggttcc

SEQ ID NO: 291752 - DNA, 455 bp, Homo sapiens
  misc_feature: GYAE6OF02FF6PD.44.36.D03.1.454.CMB.1.raw
  modified_base (336)..(336): a, c, t, g, unknown or other
  misc_feature (336)..(336): n is a, c, g, or t
  modified_base (445)..(445): a, c, t, g, unknown or other
  misc_feature (445)..(445): n is a, c, g, or t
  modified_base (447)..(455): a, c, t, g, unknown or other
  misc_feature (447)..(455): n is a, c, g, or t
tcagacagtatatacacgaccggtgctcgatttagctgcgtcacgatctctcttggggatcacataacaaccacactcctcctctaaagaagcccctgggagcacagctcatcaccatggactggacctggcggttcctctttgtggtggcagcagctacaggtgtccagtcccaggtgcagctggtgcagtctggggctgaggtgaagagcctgggtcctcggtgaaggtctcctgcaaggcttctggaggcaccttctcagctatgtcttttattgggtgcgacagcccctggacaagggcttgagtggctgggaggatcatccctatcgttgngctatcgaattcgcacagagtttcaggacagatcacataccgacggacaactccacgagtacacgtacctacatggagctgaggcgggtcgtggacaaggcgacatagnannnnnnnnn

SEQ ID NO: 291753 - DNA, 578 bp, Homo sapiens
  misc_feature: GYAE6OF02FQ4KQ.44.36.D03.1.454.CMB.1.raw
  modified_base (302)..(302): a, c, t, g, unknown or other
  misc_feature (302)..(302): n is a, c, g, or t
  modified_base (340)..(340): a, c, t, g, unknown or other
  misc_feature (340)..(340): n is a, c, g, or t
tcagacagtatatacacgaccggtgctcgatttagctgcgtcacgatctctcttgggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtctgggggagagcggcccagcctgggaactccctgagactctcctgtgcagcctctggattcatcttcaggacctatgccatcgcacgtgggtccnccaggctccaggcaaggggctggagtgggtggcaattnatcagaagatggaattgaaagaacacgtacgggaagacgtaccggaagaacgggccgaagttccgaccgttcctaccgaacgacgaaccgtaattaccgaacggaacctacacgtgacacttcagacaaagtagtaacaaccgtacaacgtaagtacgacggacgacggtacgtgtaccttattacgttagttagacggtagtaccgtcccccgtaggaccgtacccggtacccccgg

SEQ ID NO: 291754 - DNA, 748 bp, Homo sapiens
  misc_feature: GYAE6OF02G0Z69.44.36.D03.1.454.CMB.1.raw
tcagacagtatatacacgaccggtgctcgatttagctgcgtcacgatctctcttggggatcacataacaaccacactcctcctactaaagaacgcccctgggagcacagctcatcaccatggactggacctggcggttcctctttgtggtggcagcagctacaggtgtccacgtccaggtgcagctggtgcagtcgtggggctgaggtgaagagcgtggtcctcggtgaggtctctgcaggtcttcgtggaggctaccttcttcgagtctatgttcgttttagttgggtgcgacgaccggtccccgtagggaacgtaaggggtccgttaggtacggtcgggtcggtagggggaaggggtacttcgtaacgttcccttaagtttccgttttgggtcgtacgtacgttacggtaaacgtttacgaccgtaacgtaaggtaacggtttacgaacgggtaacgtacggtacgttaacccaacccgttaacgttaaccccgggcgggtaaaccgtaaacgttacccgaacggtaacggttaacccgaacggttacccgtaacgtaacggttacgggaacgtccggtaggtaacggcgaacgggttccgaagggtacgtacgttacgtaaggaacggaaccgtaaccgggacctacgttacgtttacgtttcgtacggtttacgggaccggttaacgtacccggtaccccgttacggttaccttaaccgtttctaaccgttcccgtttaccccg

SEQ ID NO: 291755 - DNA, 571 bp, Homo sapiens
  misc_feature: GYAE6OF02GCERS.44.36.D03.1.454.CMB.1.raw
  modified_base (266)..(266): a, c, t, g, unknown or other
  misc_feature (266)..(266): n is a, c, g, or t
tcagacagtatatacacgaccggtgctcgatttagctgcgtcacgatctctcttgggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtggggggaggagcggcccagcctggggaactccctgagacctctcctgtgcagcctntggattcatcttcaggacctatgccatcgctacgtcgggtcccgccgaggcctccgaggcgaaggggctgggaggtggggtgactaattatatcgaagaagatagggaattagaaagaacacgtacggagacgtccgaaggaagggccgattccaccgtctaccagacgacaacttaccgacgaacacactgactactctagactaactacgtaaccaacctacaacaaggtagacgacgacggtcgtagtcttaattagttcgtgacgtacggaccgaccccgtcgaccggtaccggtaccccg

SEQ ID NO: 291756 - DNA, 774 bp, Homo sapiens
  misc_feature: GYAE6OF02HATTT.44.36.D03.1.454.CMB.1.raw
  modified_base (329)..(329): a, c, t, g, unknown or other
  misc_feature (329)..(329): n is a, c, g, or t
tcagacagtatatacacgaccggtgctcgatttagctgcgtcacgatctctcttgggggggagacgagcccagcactggaagtcgccggtgtttccattcggtgatcatcactgaacacagaggactcaccatggactttgggctggagattgggttttcctcgttgcttcttttaagaggtggccagtgtcaggtgcagctaggtggagtcgtgggggagagcggcccagccgtgggaacctcccgtgagactctcctgtgcagcctgtggacttcattccttacgacggtacctatcgacctagtcgacctacggttcggggtcccnccgagggtccctaccggagggaccggaacggggggtcctagggggtagggttcgggggtacggaaccttaaagtttaataacgtacggaaaggtaaaggtagttagggtaaagttacggaaaacggaaccgtaaccggttaacggggaacgtaacccggtaaccgggaaacgggtaaaccgggggtaccgtaaccgtttacccgtaacccggttaccgtacccggaaaggtaaccgaaccgtaaaccgttacccgaaacgggtaaaccaccgtactacgactaacgtcgtacgaaccgtaaagttaccgtaaccaaaccctacgtaaaccgaaggtacggaaccggtacgtaccggtacgttagttacgttaagttacggttcggtacggtacggtaccggtacccgttacccccggtacgggtaccggtccccggttaccccgg

SEQ ID NO: 291757 - DNA, 749 bp, Homo sapiens
  misc_feature: GYAE6OF02HHEOH.44.36.D03.1.454.CMB.1.raw
  modified_base (261)..(261): a, c, t, g, unknown or other
  misc_feature (261)..(261): n is a, c, g, or t
  modified_base (306)..(306): a, c, t, g, unknown or other
  misc_feature (306)..(306): n is a, c, g, or t
  modified_base (380)..(380): a, c, t, g, unknown or other
  misc_feature (380)..(380): n is a, c, g, or t
tcagacagtatatacacgaccggtgctcgatttagctgcgtcacgagtctctcttggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtctgggggagagcggcccagcctgggaactccctgagactctcctgtgcagcctntggattcatcttcaggacctatgaccagtgccacgtcggggtccnccagggcctccgagggtccaagggggcctaggggacgtgggggtgacctaaagttagtacgtcgaaggtaaagngttagggaaatttaggaaaagaaccaacgttaacgggaagtaacccgtaccggaagggtaaacggggacccgtaacgtttaccgaacccggttcgtacccgtaaaggaccgtaaaccgtaaactttacccgaaagggtaaacccaacgtaaccgtacggaccttaactccgttacggaaccgtaaaacgttaccggttaaacccaaacccgtttaccaaaccgtaaagggttacgaaacgggaacccgtaaccgggtaccgttacggttaacctttaaacgtttaacgtttagggtacggtaccggtaacgggtaacccccgtaccccccggttaacggtaaccgggtacccccgggtttacccccggg

SEQ ID NO: 291758 - DNA, 637 bp, Homo sapiens
  misc_feature: GYAE6OF02IH305.44.36.D03.1.454.CMB.1.raw
  modified_base (377)..(377): a, c, t, g, unknown or other
  misc_feature (377)..(377): n is a, c, g, or t
  modified_base (407)..(407): a, c, t, g, unknown or other
  misc_feature (407)..(407): n is a, c, g, or t
  modified_base (411)..(411): a, c, t, g, unknown or other
  misc_feature (411)..(411): n is a, c, g, or t
  modified_base (554)..(554): a, c, t, g, unknown or other
  misc_feature (554)..(554): n is a, c, g, or t
tcagacagtatatacacgaccggtgctcgatttagctgcgtcacgatctctcttggggagctctgagagcggagccccagcccccagaattccccaggtgttttcatttggtgatcagcactgaacacagaggactcaccatggagttcgggctgagcgtgggtttttccttgtttgtttattttacaaggttgtccagagtgaagtgcagttgggtggaggtccgggggagtacgttggtccagcctgggacgggtccctgacgactctcctgtgtccgcctcgtggtacttcaccatcagtcgaccactatagtggtacgtgggtcccgccgaggcctccgaaggggaagggcgtgggagtggtcgttggccganaaagtaaaaactacgtcgaccagtctttancaanagacgtcgccgtacgtctagtagaaacgcgaagtacttccaccctctacaaggtagtattacgtaccttacgaaacgtaacctctaattgtaacttcgagacgtaagttacgtaaacccttaaccgtaaacggaaaaaccggnggaaccgacgggactaagtgttaatttagttaggtttgttttaggttgtttagtacttacggtaacggtacgtcgttacccgg

SEQ ID NO: 291759 - DNA, 623 bp, Homo sapiens
  misc_feature: GYAE6OF02FOR3C.44.36.D03.1.454.CMB.1.raw
  modified_base (255)..(255): a, c, t, g, unknown or other
  misc_feature (255)..(255): n is a, c, g, or t
  modified_base (262)..(262): a, c, t, g, unknown or other
  misc_feature (262)..(262): n is a, c, g, or t
  modified_base (275)..(275): a, c, t, g, unknown or other
  misc_feature (275)..(275): n is a, c, g, or t
  modified_base (284)..(284): a, c, t, g, unknown or other
  misc_feature (284)..(284): n is a, c, g, or t
  modified_base (304)..(304): a, c, t, g, unknown or other
  misc_feature (304)..(304): n is a, c, g, or t
  modified_base (337)..(337): a, c, t, g, unknown or other
  misc_feature (337)..(337): n is a, c, g, or t
  modified_base (345)..(345): a, c, t, g, unknown or other
  misc_feature (345)..(345): n is a, c, g, or t
tcagacagtatatacacgaccggtgctcgatttagctgcgtcacgatctctcttggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggcccagcctgggaacctccctgagactctcctgtncagcctntggattcatcttnaggacctangccatcgcacgtcgggtccnccaggcctccgaggcgaaggggctggagtgggngctaattnagtcgagaagagtaggaattggaaagaactacgtacggagtaccgtacgaaggaacgggcgtacgttcgacccgtcgtaccgagaacgacgtaacgttccgaacggaaccacacgtacgaccgtactacgacgtactaaagtacgtaacctaaccctaccaaacgtaacgtacgaacggtaccgaccggtacgttacggttaccttagtttaacgttcgtacggtacggtacggtacccggtccccccgtacgggacccggtacccggttacccccgg

SEQ ID NO: 291760 - DNA, 601 bp, Homo sapiens
  misc_feature: GYAE6OF02G0BC3.44.36.D03.1.454.CMB.1.raw
tcagacagtatatacacgaccggtgctcgatttagctgcgtcacgatctctcttggggagctctgagagcggagccccagccccagaattcccaggtgtttccattcggtgatcagcactgaacacagaggactcaccatggagttttggctgagctgggttctccttgttggacttttaaaggtgtccagtgtgaggtgcggctgatgggagtctggaggaggcttagtccagccgtggggggtcccagagactctcctgtgcagcctctgggctcaccgtcagcagcaactacatggaggttgggtccgccgaggcctccgaggggaacggggctgggaggtgggtctcgagtcatttactacgtggtgtatttcactatactacgcagacctcggtagaacgggccgtatccaccatcctccgagggtactaacgttccgaacggtaactacggtttactcgttacaaatacgaaacctaaccgtgaacggacggccgaacggaccgaccgggtccgttacgttacttaccgtggtacgaccggtaagaacgtaacggtccggacggtccgtacggggtacgttgggttaatttacgg

SEQ ID NO: 291761 - DNA, 677 bp, Homo sapiens
  misc_feature: GYAE6OF02HJWIK.44.36.D03.1.454.CMB.1.raw
tcagacagtatatacacgaccggtgctcgatttagctgcgtcacgatctctcttggggatcacataacaaccacactcctcctctaaagaagcccctgggagcacagctcatcaccatggactggacctggcggttcctctttgtggtggcagcagctacaggtgtccagtcccaggtgcagctggtgcagtctgggctgaggtgaagagcctgggtcctggtgaaggtctcctgcaaggcttcgtggaggcacctttcttcagctatgtctttttatttgggtgcgacgacggccccttgggaaccgaaggggtccttggaggtgggccgttggggagggtatccgattccccttattccgtttggtcgactattcggaatttaccgctaacgaggtaacgtttcgagggtaacagtacgtaccaacctacgttaccggcggtaacgtaactccgaacggacgttaccacggtacctaacgagttaggacgtcgtaggacgacgagggtcctaggaagtaccttcttaagggaaaccgaccgtaaccggggtaccctaagttttccgtttaacgtttttcccggacggtttacgggaaccggttaacggtaccgtcccccgtttaggtaacccctttaacccggtttttacaaccggttttaccccgttacccccg

SEQ ID NO: 291762 - DNA, 623 bp, Homo sapiens
  misc_feature: GYAE6OF02GRY9W.44.36.D03.1.454.CMB.1.raw
  modified_base (337)..(337): a, c, t, g, unknown or other
  misc_feature (337)..(337): n is a, c, g, or t
tcagacagtatatacacgaccggtgctcgatttagctgcgtcacgatcgtctcttggggggactcctgtgccccaccatggacactctttgctaccacactcctgctgctgaccaccccttcctgggtcttgtcccagggtcaccttggaaggagtctggtcctgtgctggtgaaacccacagagaccctcacgctgacctgcaccatctctgggttctctctcaacgatatagaatgggtgtgagctggactccgtcacgcccccgaggggaacggcccgtggagtggcttgcacacatcttctcgaatgaacgaaaaatcctaacagtacatctntagaagagactaagttaaccatcctaccaaggaccacctaccgaaaacggcagggtcgttactttaagtacgtacgaaccaactagtcggaccctcggacggaacacgaggacacgattacttactgtacgcgtaacgggtaatcgggaacgggtaaagaacgaggtcgttaggtttactaggttaattagtaacgttacgttaccgattccgtaggttaccggtcggttaggggaaccgaaaccggggtacgaaccgggttacacccggttcctacccgtaccgg

SEQ ID NO: 291763 - DNA, 775 bp, Homo sapiens
  misc_feature: GYAE6OF02IQLK9.44.36.D03.1.454.CMB.1.raw
  modified_base (370)..(370): a, c, t, g, unknown or other
  misc_feature (370)..(370): n is a, c, g, or t
  modified_base (427)..(427): a, c, t, g, unknown or other
  misc_feature (427)..(427): n is a, c, g, or t
tcagacagtatatacacgaccggtgctcgatttagctgcgtcacgatctctcttgggggggagacgagcccagcactggaagtcgccggtgtttccattcggtgatcatcactgaacacagaggactcaccatggactttgggctgagattgggttttcctcgttgcttcttttaagaggtcggccagtgtcaggtgcagctaggtggagttcggtgggggaggagccggcccaggccgttaggggaacctcccgtaggaacgtacctctccgtaggtcgcacggtcccttgtggtaacttcacttcctttaccgaacggtacccttagtccggaccctagttcggccgtaaccgggttcggggtccccnccgaacggtcccgtaccggagggacggaagggggtccgtaggggtacgggttcgggngaacctaagttagtaggtggttatggaagttagggaaaagttaattaaatctagtcggaactacgtaccgttcggaagggaaccgggtctacttaccgacctataccgtacgaagtaacgaaaccgttaactaacccgaaaggaaccctacgaccgtttagttaactccgaaacggtaactaaacgtacgtaaaacccgtcgggtaccctaaggtaaccgggaaccggaccggggaaacgccccgggtaacgggttaccgttaacggggtttacgtttaaaaccggtttccggtacgggtaacggtaacccggtaaagggttaacctttagtttaacgtttaaccggg

SEQ ID NO: 291764 - DNA, 742 bp, Homo sapiens
  misc_feature: GYAE6OF02HL4DK.44.36.D03.1.454.CMB.1.raw
  modified_base (343)..(343): a, c, t, g, unknown or other
  misc_feature (343)..(343): n is a, c, g, or t
tcagacagtatatacacgaccggtgctcgatttagctgcgtcacgatctctcttggggagctctgagagcggagccccagccccagaattcccaggttgttttcatttggtgatcagcactgaacacagaggactcaccatggagttcggctgagtcttgggtttttccttgtttgtttattttacaaggttgtccagtagtgaagtgctaggttgggtggacggtccgggggagtacgttggtccaggccgtgggacgggtcctgacgactctcctgtgtccgcttcgtggtacttcacctatcaggtcacctaactagtacgtcggaccgttcggggtccnccgacggccgtccggaaggggtaacggggctggggtagtggtcggttcggccgaacgtaaacgtaaaaaacgtaaggttcgacctagtacttttacacacgaagacgtacgccgtcgtgtaggtagaaacgcctagtacctttcccgaccttactacgaagacgtaattcgtacttaacgtaaacgaaccttacagtttcgttaagtttccgtagtaacgtaacgttaacgtaaccgtaaacccgtaaaggaaaaaccccgggaggtaaccggaacccggggtaacttaacggtttacggtttaacgtttttaagtttggttttacggtttttacggtttaaggtttttaaacgtcggttttaaccggtaacggtttacgtacccgggttaaccccggg

SEQ ID NO: 291765 - DNA, 770 bp, Homo sapiens
  misc_feature: GYAE6OF02H9OU7.44.36.D03.1.454.CMB.1.raw
tcagacagtatatacacgaccggtgctcgatttagctgcgtcacgatctctcttggggatcacataacaaccacactcctcctctaaagagcccctcgggagcacagctcatcaccatggactggacctggcggttcctctttgtggtggcagcagctacaggtgtccagtcccaggtgcagctggtgcagtcgtggggctgaggtgaagaagccgtgggtcctcggtggaacggtctccgtgacgaaggtcttcgtgggacggtcctacctttcttcgacgtcttagttgtctttttagtttgggtgccgtacgacgggtccccgtaggaccgtaagggtccttaggaggttcgggcggtgggggtaaggtatccgtaacttcccgttagtttccgttttggtcgtctaacgttacggtaaacgtttaccgacgtaacgtaaacggtttaacggtttaccgaacgggtaaccgtaacgggtaaccggtttaacccgtaaccccgttaacggttttaaccccgggaaccgggtaaaccgtaaaccgttaccccggaaacgggttaacgttaaaccgacggtaaccctaacgtaaggtttcgggaaacgtcggttacggaacggtcggtaacgggtccgtaggaaccgtaacgtttacgtaacgggaaacgtaccgacggaccttagttccgtttaaggttttccaggttaccggacggaacgtcccgtaccgttacgttaccttaaccgtttcaacgtttcccgttcccc

SEQ ID NO: 291766 - DNA, 685 bp, Homo sapiens
  misc_feature: GYAE6OF02J0335.44.36.D03.1.454.CMB.1.raw
  modified_base (570)..(570): a, c, t, g, unknown or other
  misc_feature (570)..(570): n is a, c, g, or t
tcagacagtatatacacgaccggtgctcgatttagctgcgtcacgatctctcttggggatcacataacaaccacactcctcctctaaagaagcccctgggagcacagctcatcaccatggactggacctggcggttcctctttgtggtggcagcagctacgaggtgtccagtcccaggtgcagcgtgggtcgcgagtcgtggggctggaggtgaaagacgtccgtgggtcctcgggtagacggtcctccgtgcgaacggcttcgtggacgtcctaccttcttcgagtcttagtgttcgttttaggttcgggcgcgacgtccggtcccgtaggaacgtagggtcttggaggtcggcgtaggggacggtatccgtacgttcccgttagtttccggttgggtacgtacgtaacgtaccgtaaacgttaccgaccgtaacgtaggttaaacgttcgaacgtaacgtaggtaccgtaccgtaaccgtaacgttacccggacggtaactaaaccgtcccgaaagtacgtaccgtaacgtcctaagaggtacggacgtcgtaggacgtacgacgggnttaacgggaagtcgtactaaggaaacgtacgacccgtatattcgtttacgttccgaggtcggtaacgacgtcgttaccctacggttaccttaccgtttacacgttacccttcccg

SEQ ID NO: 291767 - DNA, 661 bp, Homo sapiens
  misc_feature: GYAE6OF02H71BO.44.36.D03.1.454.CMB.1.raw
  modified_base (221)..(221): a, c, t, g, unknown or other
  misc_feature (221)..(221): n is a, c, g, or t
  modified_base (311)..(311): a, c, t, g, unknown or other
  misc_feature (311)..(311): n is a, c, g, or t
  modified_base (371)..(371): a, c, t, g, unknown or other
  misc_feature (371)..(371): n is a, c, g, or t
tcagacagtatatacacgaccggtgctcgatttagctgcgtcacgatctctcttggggcagagctctggggaggaactgctcagttaggacccagacggaaccatggaagccccagcgcagcttctcttcctcctgctactctggctcccagataccactggagaaatagtgatgacgcggtctccagcccaccctgtctgtcgtctaccgaaggggaaancgcccaccctctcctgcagggccagtcagagtgttagcagcaacttagcctcgtaccagacagaaatctggccaggcctccaggcctccncatctatggtgcactccaccgagggccacgtggtactcccagccaggttcaggtcggacnggtcgggtcgtacgggacagtacgttcactctaccacctagtccagccacgtccttagactacgttacgtaggtaaacgtttacgttttacgacgtttaggtttttaactttacgtttaccggtaccgttaaacgtcgttaaacgtttaagttaaacgttacggttaaccgttccgggttaaccccctttacccccgggtttaccggaacccgggtaaacggtaaccggtaaccggttaaccggttagggaaaccgttaaacgttttaaaaccgggaccgtttaacgggg

SEQ ID NO: 291768 - DNA, 653 bp, Homo sapiens
  misc_feature: GYAE6OF02GXDC2.44.36.D03.1.454.CMB.1.raw
  modified_base (381)..(381): a, c, t, g, unknown or other
  misc_feature (381)..(381): n is a, c, g, or t
tcagacagtatatacacgaccggtgctcgatttagctgcgtcacgatctctcttggggatcacataacaaccacactcctcctctaaagaacgcccctgggagcacagctcatcaccatggactggacctggcggttcctctttgtggtggcagcagctacaggtgtccagtcccaggtgcagctggtgcagtcgtgggctgaggtgaaagacgccgtgggtcctcgggtagaacggttctccgtgacaaggtcttacgtgggacggcctaccgttcttcgagtcttagttagttctttttagtttgggtcgcgacgacggccccgtaggaacgaagggtcgttggagtggcgtgggaggatcactccttagttcgttggngtctagtacgtaacgttacgactaacgtaagtaagtttacgaggtaacgtagacgtaccaccgtaacgttaccgacggtaacgtaaacgtaccgaacgtaacgtaccgaacgtaccctaagtacggtcggaattccgaaggacgcgtacggtctaaggacgtaagttccgtaaaggaaaccgaaccggtaccgtaaccttagttacgtttagtttcggagttcggacgacgtaccgtccgttacgtaccgttaacttcgtacttcgttaccc

SEQ ID NO: 291769 - DNA, 652 bp, Homo sapiens
  misc_feature: GYAE6OF02FQNJP.44.36.D03.1.454.CMB.1.raw
  modified_base (278)..(278): a, c, t, g, unknown or other
  misc_feature (278)..(278): n is a, c, g, or t
  modified_base (391)..(391): a, c, t, g, unknown or other
  misc_feature (391)..(391): n is a, c, g, or t
tcagacagtatatacacgaccggtgctcgatttagctgcgtcacgatctctcttggggagctctgagagcggagccccagccccagaattcccaggtgtttcatttggtgatcagcactgaacacagaggactcaccatggagttcgggctgagcttgggttttccttgttgttatttacaaggtgtccagagtgaagtgcaggttggtggaggtccgggggagacgttggtccagccgtgggacgggtccctggacgacctctcctgtgtccgcctntggattccaccatcagtcgaccactatagtggactgggtccgccgaggctcgaggggagggctgggagtggctcggccgacgaaagtaaaaacaagttcgacctagtctttancaacgagacgtacgccgcgtctgtagaaacgccaagtacttccacccttctacgaaagatacttacgaacctttacgaaacgtaaccttctaagtttcgtaactttcgtacgacgtaaatacgtaaacccttaaaccgtaacggaaaaccggacgggaacccgacggggtataacggttacgttaagttttacggtttggtttaggttttaggtttaggtttttaacacgttacggtaacgggttaacttcggtaaccccg

SEQ ID NO: 291770 - DNA, 663 bp, Homo sapiens
  misc_feature: GYAE6OF02HRUYY.44.36.D03.1.454.CMB.1.raw
  modified_base (269)..(269): a, c, t, g, unknown or other
  misc_feature (269)..(269): n is a, c, g, or t
tcagacagtatatacacgaccggtgctcgatttagctgcgtcacgatctctcttgggggggagacgagcccagcactggaagtcgccggtgtttccattcggtgatcatcactgaacacagaggactcaccatggactttgggctgagattgggttttcctcgttgcttcttttaagaggtggccagtgtcaggtgcagctaggtggagtcgtgggggagagcggcccagcctagggaacctccctgacgctctcctgtgcagcctcgnggtacttcattcttcacggtacctagtcgaccctagtgacctacggtcgggtacccgccacgggtccctccgagggacgagggggctggggtaggtcgggtggactaaagttactaagtcgaaggtaacgagtagggtaattacgggaaaagtaactaccgtaacggacgaccgtaccggaaggaacgggtaccgtacgtaccgtaccgtctaccgagaacgacaacgttccgaagaccacactcgacctagttctagacctaaagtactaacccaacctaccaaacgaagtacggaggtacgacccggtacgttcgttaacgtttacgttacgttggtacgaccggtacggtacccgtacccccgtaacgggaccggtaccccggttccccgg

SEQ ID NO: 291771 - DNA, 809 bp, Homo sapiens
  misc_feature: GYAE6OF02H00ET.44.36.D03.1.454.CMB.1.raw
tcagacagtatatacacgaccggtgctcgatttagctgcgtcacgatctctcttggggagctctgagagcggagccccggccccagaacttcccaggtgttttcatttggtgatcagcactgaacacagaggactcaccatggagttcgggctgagtcgttgggttttccttgtttgtttatttttacgaaggttcgtccgaaggtagtaggtaaggtgcgtaggttggggtagggtacgggtccgggggatacggtttcgggtcccgacgtccggtaggggtacgggttcccgtggacgtaccttcgtccgttaggtcggtccgtaccgttcgtacggtacttaccgaacctacgtaccgtaggtacgtaacctaacgttaagtaacgtcgggtaccgttaccggggtacccgaccggacggtccgtaccggaacgggggtaacggggtcgtagggacggtcgggtcgttacgggccgtaacgtaaaacggttaaaaaaccgtaaggtttaccgacctaacggtttacctttaacgaccgaacgaacggtacgtaccggtcccggtacgttacgttaggtaacgaaaccgtcccgtaaagtaccgttaccctaacccgttcgtaacgaacggtagtacttacgaaccttacgaaacgtaccttagtacttacgtcttcgtacgacgtaagtaccgtaaccgttaaccgaaacgggaaaccgtaggaccgacggtatagtttagtaagtttgttgttacgtttagttatttaacgtgtacggtaacggttactccggttacgaaccggg

SEQ ID NO: 291772 - DNA, 849 bp, Homo sapiens
  misc_feature: GYAE6OF02IWOXC.44.36.D03.1.454.CMB.1.raw
tcagacagtatatacacgaccggtgctcgatttagctgcgtcacgatctctcttgggggggagacgagcccagcactggaagtcgccggtgtttccattcggtgatcatcactgaacacagaggactcaccatggactttgggctgagattgggtttcctcgttgctcttttaagaggtgccagtgtcaggtgcagctagtggagtcgtgggggagagcggcccagcctgggaacctcccgtgacgactctccgtgtcgcacgtcctcgtggtattccaagttccttcgaaggtaccctaatcggacctagtcggcctacggtcggggtcccgccgagggccttccgaaggggtacccgaaagggggtcgttggggtaaggttcgggggtacggtacgttaaaagttacgtaacgtaccgtaaagggaaaggtaacgttaaggggtaaaactttagggaaaacgtaaccgtaaacccgggttaaaccggggtaacgtacccggttaacccgggaaacgggtaaacccgggggtacccgtaacgtttacccggtaaccccggtttaccaaccggtaaacgggtaaaccggaaccttaaaccgttacccggtaaacggtaaacccaaccgtaccgttaccggacgttacctacgttaacgtaaccgtaaacggtaccgtaaacccgaacccttaaccggaaacgtaaacgggtacggaaccgggtaccgtaaccgggtaccgttacggtttaaccttaagttttaacggtttacggtacggtaacggtacccgttaaccccgggtaccccccggtaacggtacccggggttaacccccggttacccccggg

SEQ ID NO: 291773 - DNA, 658 bp, Homo sapiens
  misc_feature: GYAE6OF02IBCXA.44.36.D03.1.454.CMB.1.raw
  modified_base (274)..(274): a, c, t, g, unknown or other
  misc_feature (274)..(274): n is a, c, g, or t
  modified_base (288)..(288): a, c, t, g, unknown or other
  misc_feature (288)..(288): n is a, c, g, or t
  modified_base (303)..(303): a, c, t, g, unknown or other
  misc_feature (303)..(303): n is a, c, g, or t
  modified_base (340)..(340): a, c, t, g, unknown or other
  misc_feature (340)..(340): n is a, c, g, or t
  modified_base (345)..(345): a, c, t, g, unknown or other
  misc_feature (345)..(345): n is a, c, g, or t
tcagacagtatatacacgaccggtgctcgatttagctgcgtcacgatctctcttggggggggagacgagcccagcactggaagtcgccggtgtttccattcggtgatcatcactgaacacagaggactcaccatggactttgggctgagtacggtttccgttcgttgtctcttttaagtaggtggcgagtgtcaggtgcgagctagtggaggtcgtgggggaggggagcggcccgcgaccgtcgggaaccgtcctcgacgactcctctcgtgcngcctctgtgtactntctcgagactatgcnacgcacgttcgggtccgcacgctccgaggacgagggngtggnggtgggtcggctaaatattacacgaaggtaaagagtacggtaagtaacgtaagaaacctacggtaacggaaccggtactaccggaacgggaacgggaccggtaacgttaccgtaaccgtacccgtaccgtacgaaacgtaacgtaacgttaaccgaacgaaaccgaacaccgtactacctactacgtacgaaccgtaacgaactaacaaccttaaccgaactaagtaacgaaggacacggtactcggtctaagttacttggttacgtcggacgtaccgtccccggtaccggcggtaccccggtcccgtaccgg

SEQ ID NO: 291774 - DNA, 733 bp, Homo sapiens
  misc_feature: GYAE6OF02IQV2F.44.36.D03.1.454.CMB.1.raw
tcagacagtatatacacgaccggtgctcgatttagctgcgtcacgatctctcttgggggggagacgagcccagcactggaagtcgccggtgtttccattcggtgatcatcactgaacacagaggactcaccatggactttgggctgagattgggttttcctcgttgcttcttttaagaggtggccagtgtcaggtgcagctaggtggagtcgtgggggaggagcggcccaggcctgggaactcccgtgagacctctccgtgtcgcagccctgtggtattcattcttacgaggacctatcgccagtcgcctacgtcggggtcccgacagggcctacgaggccggaagggggctaggggacggtggggtacggactaaagttatatacgaaggtaaagagttaacggtaaattggaaagtaaaccaacggtacgggaacgtaccgtaccggaacgggaaacgggaccgtaacttcccgtaacccgttacgtacccgaacggaaccggaactaaccgttaaccgaaacgggtaaacccaacgtaaccctacgaccgtaacttacctacgaaaccgtaaacgttaccgttaaaccctaaaccttaaccgtaaacgtaaacgttaggaaccgggtacggaccggtaccgttacgttaaccttaagtttaacgtttcgggttacggtacggacggtaacccgtacccccggttaccggtaccggtacccggtaccccgg

SEQ ID NO: 291775 - DNA, 653 bp, Homo sapiens
  misc_feature: GYAE6OF02GK7DL.44.36.D03.1.454.CMB.1.raw
  modified_base (294)..(294): a, c, t, g, unknown or other
  misc_feature (294)..(294): n is a, c, g, or t
  modified_base (393)..(393): a, c, t, g, unknown or other
  misc_feature (393)..(393): n is a, c, g, or t
tcagacagtatatacacgaccggtgctcgatttagctgcgtcacgatctctcttggggagctctgagagcggagccccagccccagaattccccaggtgtttcatttggtgatcagcactgaacacagaggactcaccatggagttcgggctgagctgggttttccttgttgttatttacaaggtgtccagagtgaagtgcagttggtggagtccgggggagacttggtccagcctgggagggtccctgagactctcctgtgtcgcctctggattcaccatcagtgacccactntatggactcgggtccgccaggcctccgaaggggaaggggctgggagtcggcgttgggcccgagtaaacgtaaaaaacaaggttcacccaggtcttttanccgaacaggaacgtacggcccgtcggtcgtacgtaggaaacgtcccgaaggtacttcccaaccccttctaccgaaaggagtacgttcgaacctttacaaacggtaactcgtaagtttgtaactttcgtacgtacgtaaattacgaacccttaaacccgtaaccggaaaaaccggacggtaaccgaccggggtactaaggtagttatttacgtggttagtttggttagttttaatacgttcgaacggtactgttaacccgg

SEQ ID NO: 291776 - DNA, 615 bp, Homo sapiens
  misc_feature: GYAE6OF02FLGF8.44.36.D03.1.454.CMB.1.raw
  modified_base (217)..(217): a, c, t, g, unknown or other
  misc_feature (217)..(217): n is a, c, g, or t
tcagacagtatatacacgaccggtgctcgatttagctgcgtcacgatctctcttggggcagagctctggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaangcccaccctctcctgcagggccagtcagagtgttagcagccaacttagcctcgtaccagcaagaatctagccaggctcccgaggcctcctcactctattggtcgcactccgaccgagggtccacgtggtactcccgagtccgtaggttacgagttcggacgtaggtgggtctggggacaggagtttccacttcgtcctaccgtcacgtacgtaattgtacgacgtcctaggaattgtttgactttagtttataccgttgtacagtctacgtccgttccgccgacgggtcctacgttaccggtaaccgggtttccgggggaaccgggggtaaccgtaaggggttacggtaaccgtaacggttaccgaaacgggtaacccggtacggtttacggtacggg

SEQ ID NO: 291777 - DNA, 639 bp, Homo sapiens
  misc_feature: GYAE6OF02IX9E0.44.36.D03.1.454.CMB.1.raw
  modified_base (228)..(228): a, c, t, g, unknown or other
  misc_feature (228)..(228): n is a, c, g, or t
  modified_base (485)..(485): a, c, t, g, unknown or other
  misc_feature (485)..(485): n is a, c, g, or t
  modified_base (514)..(514): a, c, t, g, unknown or other
  misc_feature (514)..(514): n is a, c, g, or t
  modified_base (557)..(557): a, c, t, g, unknown or other
  misc_feature (557)..(557): n is a, c, g, or t
tcagacagtatatacacgaccggtgctcgatttagctgcgtcacgatctctcttggggagctctgagagcggagccccagccccagaattcccaggtgttttcatttggtgatcagcactgaacacagaggacctcaccatggagttcgggctgagcttgggttttccttgtttgtttatttacaaggttgtccagagtgaagtgcagttggtggaggtccggggganacgttggtccagtcctgggacggtccctgagactctcctgtcgtcgtcctcgtcggatttccgaaccatcagtcgaccattatacgtggacgttcggggtccgccgaggccttccggaacgggaaggggcgtggaggtggtacgttcgggcccgagaagtaaaaaacgtaacggttcgaccgtacgtacttttatacgacagaggtaaccgccgtacgtctcggtagaaagccaagtacttccaccttcacaaaggntattacgtacttacaacgtactcaagttntatttctagacgtaatcgaacttaaaccgtacgaaaacccggngaaccgacggactacgttagttaatttagttgtttacgttagtttatttacgttaatacggaacgttacgttcgtaacccgg

SEQ ID NO: 291778 - DNA, 679 bp, Homo sapiens
  misc_feature: GYAE6OF02FIYDX.44.36.D03.1.454.CMB.1.raw
  modified_base (223)..(223): a, c, t, g, unknown or other
  misc_feature (223)..(223): n is a, c, g, or t
  modified_base (603)..(603): a, c, t, g, unknown or other
  misc_feature (603)..(603): n is a, c, g, or t
tcagacagtatatacacgaccggtgctcgatttagctgcgtcacgatctctcttggggatcacataacaaccacactcctcctctaaagaagcccctgggagcacagctcatcaccatggactggacctggcggttcctctttgtggtggcagcagctacaggtgtccagtcccaggtgcagctggtgcagtctgggctgaggtgaagagctgggtcctcggngaaggtctcgtgcaaggcttcgtggaggctaccttcttcagtctatgtctttttagtttgggtgacgtacgacggccccgtagggaactaaggggtccttaggacggttcgggtcggttagggggacggggtacttcaacttcccccgttaagttcccgttttggggtcgtaccgtaacgtttaccggtaaacgtttaccggacctaacgtaaggttaaacggttttcgaaacggtacaaggtacgtacacccgtagttacccggacggtacgaaactcccgaacgagtacacggtcctaacgtagtcggagctggacgtcgagggctaggacgtagttacgtagaaacgcgacggaccttacgtccgttagtttaccgnggttacggccgtaacggtaccgtaccccgttacggttaccggttaaaccttttcccggaaattcccggtaaccccg

SEQ ID NO: 291779 - DNA, 714 bp, Homo sapiens
  misc_feature: GYAE6OF02ITKXD.44.36.D03.1.454.CMB.1.raw
  modified_base (324)..(324): a, c, t, g, unknown or other
  misc_feature (324)..(324): n is a, c, g, or t
tcagacagtatatacacgaccggtgctcgatttagctgcgtcacgatctctcttggggagctctgagagcggagccccagccccagaattcccaggtgttttcatttggtgatcagcactgaacacagaggactcacaatggagttcgggctgagctggggttttactgttgttattttacaaggtgtccagagtgaagtgcgagttgggtggaggtccgggggagtacgttggtccagcctgggacgggtccctggagactctcctgtgtcgcctcgtggacttcaccatcagtcgacccactatagtggacgtggggtcccncgagcctccgaggggaacgggctagggaggtggcgttcgggccgacgaaaagtaaaaaacaaggttcgaccctaaggttacttttaatacccgaaacgtaaggaaccggttaccgacccgtcgttacgtacggtagaaacggtccctaaggtacttaccctacccctacgttaccgaaacggtagtaacgttaccgtaactttaccgaaacgtaactacctaaggtttacgtaagtttccctaggtacccgtaaagttaccgaaaacccgttaaacgtaaaccggaaaaaccggtacggaacccggacgggtctaaagttcgttaagtttacttaggttaggttactttaggtttagttaactacggttaccggtaggtaccttaccggg

SEQ ID NO: 291780 - DNA, 726 bp, Homo sapiens
  misc_feature: GYAE6OF02F7C4O.44.36.D03.1.454.CMB.1.raw
tcagacagtatatacacgaccggtgctcgatttagctgcgtcacgatctctcttgggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggaggagcggcccagcctgggaacctcccgtgacgactctcctgtgcagcctctggattcatcttcaggtacctatgcctatcgctacgtcgggtcccgccgacggcctccgagggacgaacgggggtcctagggacggttggggtacgaccgtaaatttacgtataccggaaggaaagtagttaggtaaacttgggaaaactaaccgaacgttacgggaagtacccgtaccggaaggaacgggtccgtaacgttccgacccgttcgtaccgagaacggtaacttaacgtaaccgaacggaacctaaccgacgttacgacctaacgttaccgtacgtaacctaaaacgttcgtaaacccgtaaaccgttaccgaaacgtaacggtaacggtaaccgggaacgtaccggtaccggttaggttaaccgtttaagttttaacgttacggtacggtaaccggtaccggtaacccgtccccccggtaacggtacccgggtaccccggttaccccccgg

SEQ ID NO: 291781 - DNA, 758 bp, Homo sapiens
  misc_feature: GYAE6OF02G83UT.44.36.D03.1.454.CMB.1.raw
  modified_base (256)..(256): a, c, t, g, unknown or other
  misc_feature (256)..(256): n is a, c, g, or t
  modified_base (260)..(260): a, c, t, g, unknown or other
  misc_feature (260)..(260): n is a, c, g, or t
  modified_base (264)..(264): a, c, t, g, unknown or other
  misc_feature (264)..(264): n is a, c, g, or t
tcagacagtatatacacgaccggtgctcgatttagctgcgtcacgatctctcttgggggactcctgtgccccaccatggacactctttgctacacactcctgctgctcgacccaccccttccgtgggtcttgtcccaggtccaccttgaaggagtcgtggtcctgtgctggtacgaaacccacaggacgaccctcacgctgacctgccacatcgttcgtgggttctctcgtacaacgattagtagaagtgggttgngagngtgntccgcaccggccccgagggaacggtccgtaggaggtcggtctcgacacgactattccttcgacgtaataacgaaacgtaaaaaccttctaacgtaactaactacttactacgtaagaacggtactaaccgttaacgttaacctaactaccgtaaccgaaacggaaccctaaccgtaaaccgtaaaacggtaccgtaaggggtacgttttacgttttaacgtacgttaacgaaaccgtaaactttaccgggtacgtaccccggtacgggtaaaccacggtacgaacgggaacctaataaagtttacgttacgtaggtcgaacggtaaacgggtaactacgggaaacgggtaaactaacgtaccggttcggttacgttttactaaacgggtttaattaacggttaacctttaccgtaactcggtaccgtacggggttaccgttacggacggggaaacgttacgggacctaccgggtcctacggttactccgtaacg

SEQ ID NO: 291782 - DNA, 727 bp, Homo sapiens
  misc_feature: GYAE6OF02H3678.44.36.D03.1.454.CMB.1.raw
  modified_base (382)..(382): a, c, t, g, unknown or other
  misc_feature (382)..(382): n is a, c, g, or t
tcagacagtatatacacgaccggtgctcgatttagctgcgtcacgatctctcttggggagctctgagagcggagccccagccccagaattcccaggttgttttcagtttggtgatcagcactgaacacagaggactcacagtggagttcggctgagtcgtggttttcttgttgttatttacgaggtgtcagagtagaagtgacgtaggttggtgggaggtccgggggagtacgttcggtaccgagccgtaggggaccgggttcccgtaggacgtactccttcgtggttcgtccgtccttcgtaggtacttccgacctagtcgacggtcaacctactagtagtcggtacgtcggtccgacgtacgtccgcggagggacggcgngggtacggtcggacggttcggaccgaacgtaaacggtaaaaacgtaggttacgaccgtacgttaccgtttaagtaccgaacgtacgtacggtaccggtcgttacgtcgtaggtacggaaacgccgtaagtaccgttacctacccgtacgttaaccgaagtaacgtacgtacgtaacgtaacaaacgttaactacgtaagttcgtaacgttcgtacgtaacgtacgtacgttaaacgtaaccgtaaacggaaaccgaagtaccgacgtagtaacgttagttaacgtttaggtgtttaggttacgtttagttaacgttagtaccggtaagttaccgtacgttaccgg

SEQ ID NO: 291783 - DNA, 610 bp, Homo sapiens
  misc_feature: GYAE6OF02FGPV1.44.36.D03.1.454.CMB.1.raw
  modified_base (186)..(186): a, c, t, g, unknown or other
  misc_feature (186)..(186): n is a, c, g, or t
  modified_base (325)..(325): a, c, t, g, unknown or other
  misc_feature (325)..(325): n is a, c, g, or t
  modified_base (364)..(364): a, c, t, g, unknown or other
  misc_feature (364)..(364): n is a, c, g, or t
  modified_base (391)..(391): a, c, t, g, unknown or other
  misc_feature (391)..(391): n is a, c, g, or t
tcagacagtatatacacgaccggtgctcgatttagctgcgtcacgatctctcttggggagctctgagagcggagccccagccccagaattcccaggtgtttcatttggtgatcagcactgaacacagaggactcaccatggagttcgggctgagctgggttttccttgttgttattttacaaggtntccagagttgaagtgcaggttggtggaggtccgggggatacgttggtccaggcctgggacgggtccctgacgacctctcctgtcgtccgcctctggtattccaccatcagtcgacctactatacgtggactcgggtccnccaggcctccgaggggaagggctggagtggcttgggccnaagtaaaacagttcgaccagtctttancacgagacgtccgcgtcgtctagtagaacgccaagtactttcccacccttctaccgaagagtactagaccttacaaacgtactctattcgattcgagtacgaatacgtaaacctaacttaacggaaaccggacgacgaccgggactagttacgttaagtttattggttagtttaggttacttttaagaccttcgaaacgggttacttaccggttacccg

SEQ ID NO: 291784 - DNA, 796 bp, Homo sapiens
  misc_feature: GYAE6OF02JBKCA.44.36.D03.1.454.CMB.1.raw
  modified_base (346)..(346): a, c, t, g, unknown or other
  misc_feature (346)..(346): n is a, c, g, or t
tcagacagtatatacacgaccggtgctcgatttagctgcgtcacgatctctcttggggagctctgagagcggagccccagccccagaattcccaggttgttttcatttggtgatcagcactgaacacagagactcaccatggagttcgggctgagtcgttgggttttccttgttgtttatttacgaaggtcgtccagtagtgtaagtgcgtaggttgggtggacggtccgggggagtacgtttggccagccgtgggacgggtccctaggacgtacttccgtccgtggtcgtccgccttcgtggtacttcacctatcagtcacctatatgcggtacgtcgggtcccncgacggtccgtacccggagggggaacgggtctagggtacggtcggtccgttacgggacccgtaacgtaaaacggtaaaaaacgtacggttcgaacccgtaggttacctttaagaccaacgaacggtacggtacccggcccggtacgttaccgtaggaaccgtaaaacgccctaaaggttacccctttcccaacccttagtaacgaaaacggtacgttaacgttaccggtaaccgttaaacccgaaagttaccccttagtaacgtttacggttacgttacttaccgggaacttaaacgttacgttaaacccttaaaccgggtaaaccggaaaaccgggtgaacccggtacgggtaactaacggttacgtttaacgtttaaggtttccggttagtttttaggttaaccgttttgtaaccggttacggaacggtttaaccgttcgtaacccgg

SEQ ID NO: 291785 - DNA, 965 bp, Homo sapiens
  misc_feature: GYAE6OF02F4FFU.44.36.D03.1.454.CMB.1.raw
tcagacagtatatacacgaccggtgctcgatttagctgcgtcacgatctctcttggggagctctgagagcggagccccagccccagaattcccaggtgtttcatttggtgatcagcactgaacacagaggactcaccatggagttcgggctgagcttgggttttccttgttgttatttacaaggtgtccagagtgaagtgctaggttggtggaggtccgggggagtacgttgggtccagccgtgggacgggtccctggagacctctccgtgtcgtcgccttcgtggtacttccgacctatccaggttacgacctaacttaagttagtacggaccgttcggggtacccgaccgacgggtccgtaccggaaggggggtaacgggggcgttaggggaggttcggggtaccgttacggggcccgtaacgtaaaacggttaaaaaaaccgtaaaggtttccggaacccgttaaggttacccgtttttaaacgtaccgtaaaaccgtaaacgggtaacccgggttaacccggtacccccgggtcggtttacccggtttaaggggtaaaaccggtaaaaccggtaccccgtaaagggttaaccctttaaccccgtaaacccccgtttacgtaaaccggaaaaacgggtaacggtaaacgttaacccgggtaaacccttttaaacggaaaaaccggttaacctttacgttaaacggtttacgttaacttttccggtagggtaaacccgttaaagttacggtaaaaccccgtttaaaaaccccggtaaaacgggaaaaaaccccggggtacgggaaaccccgggtaaccgggggtaaccttaacggttttaaaggttttaaaccgtttttaaggttttacgggttttagggtttttacgggtttttaattttaaccggtttaaacggttaccggggtaaacgggtttaaaccgtttcccggggttaaaccccgg

SEQ ID NO: 291786 - DNA, 718 bp, Homo sapiens
  misc_feature: GYAE6OF02F2460.44.36.D03.1.454.CMB.1.raw
  modified_base (257)..(257): a, c, t, g, unknown or other
  misc_feature (257)..(257): n is a, c, g, or t
  modified_base (495)..(495): a, c, t, g, unknown or other
  misc_feature (495)..(495): n is a, c, g, or t
  modified_base (560)..(560): a, c, t, g, unknown or other
  misc_feature (560)..(560): n is a, c, g, or t
  modified_base (581)..(581): a, c, t, g, unknown or other
  misc_feature (581)..(581): n is a, c, g, or t
  modified_base (653)..(653): a, c, t, g, unknown or other
  misc_feature (653)..(653): n is a, c, g, or t
tcagacagtatatacacgaccggtgctcgatttagctgcgtcacgatctctcttgggatcacataacaaacacactcctcctctaaagaagcccctgggagcacagctcatcaccatggactggacctggcggttcctctttgtggtggcagcagctacaggtgtccagtcccaggtgcagcgtggtgcgtagtcgtggggctggaggtggaagagccgtgggtcctcggtagacggtctcgtgctaacggcttcgngggacggctacccgtttcgttccgaggtaccttagttcggtttcgttttttacgttttgggggtcggtccggtaacggtccgggtacccccggttaggaacccgggtaaggggtccgtttaggacgggttcggaccggtttaggggggacgggtacttacgaaccgtttccctaagttcgtttgggtcgtctacgttacgtaataccggacacgtaaacggtatttacggaacggtanacggtgtacaccgtagttacccggacggaactacgtaccaacggactaaccgacgtcctaaacgnggtacggaacgtcgtaggacncggggtaacttgaacgaacgacgtacgtagggaaacgtcgaacggcctaagttacccggtgtttaacccggnggttagacccgtaggtacccgtaccggttccgtaaccgttaagttttaccccagttcgtaacccg

SEQ ID NO: 291787 - DNA, 702 bp, Homo sapiens
  misc_feature: GYAE6OF02HBH6R.44.36.D03.1.454.CMB.1.raw
  modified_base (306)..(306): a, c, t, g, unknown or other
  misc_feature (306)..(306): n is a, c, g, or t
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgtttgttattttacaaggtgtccagagtgaagtgcagttggtggaggtccggggagacgttggtccagccgtgggacggtccctgacgtactcgtcctgtcgtcgcctctggattccactatcagtcgaccatatagnggacgtcggggtccgacgagggccgtaccgggggaaggggctgggtaggtcggtcgttcgggccgtagaaaacggtaaaaacgtaagttcgaaccgtagtactttaacgccaacgaagtacgttaccggccgtacggtcgttgaaggtaaacgcccgtaagtactttccccacccttcgtaacgaaacggtgtaacgttacgtaacctttaacgaaaacgtaaccttcgtaattacggtacttttacgaacgtaactaaaacgtcgtaaaaccgttaaccgtaaacggaaaaccggacggaaccgaaccgggtctaagttccggtttaaatttgtttaggttccgtttagtttacgttaattacgtacgtaacggtacttccggtaaccgtcgggg

SEQ ID NO: 291788 - DNA, 764 bp, Homo sapiens
  misc_feature: GYAE6OF02GH7D1.44.36.D03.1.454.CMB.1.raw
  modified_base (268)..(268): a, c, t, g, unknown or other
  misc_feature (268)..(268): n is a, c, g, or t
tcagacagtatatacacgaccggtgctcgatttagctgcgtcacgatctctcttggggatcacataacaaccacactcctcctctaaagaagcccctgggagcacagctcatcaccatggactggacctggcggttcctctttgtggtggcagcagctacaggtgtccagtcccaggtgcagctggtgcagtctggggctgaggtgaagagccgtgggtcctggtgaaggtctccgtgcaaggtcttcgtggaggctaccttcttcanctatgtcttttagttgggtgcgtacgacggtcccctgggaaccgaaggggtcttaggaggtcgggcgttagggggagggtactccgtaacttaccccgttagttccgttttagggtcggtccgtaacgtttaccggtaaacgttttaccggaccgttaaaccgtaagggttaaacggtttttaccggaacgggtaaccgtaaacgggtaaccgttaacccgtaacccgtaaaccggtttaaccccgggtaaccgggtaaacccggtaaaccgttaaccccgtaaacggtaaccgggtttaaacccgaacggttaccccttaaacggtaagttacggggaacggtaccgttacgggaacgtccggaaccggggtctagggaacggtacttacgtacggaaaccgaccgaccggtacctagtccgtttaactttcgtaggtcgaccggtagccgttaccccgttacgtaccttaacgtttctacgttaccgttccccg

SEQ ID NO: 291789 - DNA, 838 bp, Homo sapiens
  misc_feature: GYAE6OF02GZ0TB.44.36.D03.1.454.CMB.1.raw
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcaggttggtggaggtccgggggagtacttgggtccagccgtgggagggtccctggacgactctcctgtgtcgcctctggattcaccgatcagtcgaccactatagtggacgtcgggtccgaccgacggccgtaccggagggggaacggggtcgtaggggtaggtcgggtccgttgggcccggtacgaaacggttaaaaaaaccgtaaaggtttacggacccgtaacggtacctttttaaagtaccgtaaccgtaacggtaaccggttaacccgccccgggttaccggttccggtttagggttaaccggaaaaccggtcccgtaaacggtaacctttacccccgaaccccttacccgttaaccgaaaacgggtaacgaagttaccgtaaccgttttaccaaaacggttaacccttaactaacgtttacggtaacctttcgtacgggtaaccgtaaagttcggaaaacccttaaacccggttaaaaccggaaaaaacccgggtagggaaacccgggtacccgggtaacgtaacggtttaggtttaaacgtttttaggtttacggtttaggttttacggtttaacggtttttatttaaccggttaacggtaaacgggttacgtttacccgggtaacccgg

SEQ ID NO: 291790 - DNA, 990 bp, Homo sapiens
  misc_feature: GYAE6OF02G4II6.44.36.D03.1.454.CMB.1.raw
  modified_base (265)..(265): a, c, t, g, unknown or other
  misc_feature (265)..(265): n is a, c, g, or t
tcagacagtatatacacgaccggtgctcgatttagctgcgtcacgatctctcttgggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggaggagcggcccagcctgggaactcccgtgacgactctcctgtgcagcctntggattcatcttcaggacctatgaccatcgcacgtcgggtcccgccgacggccttacccgagggtaccgaaaggggggtcccgttaggggggaacgggttcgggggggtcgggaacccgttaaaagttttaaagtttaacgttaccgtaaaaggggtaaaacggtaaggtttaacggggtaaaagtttttaacgggaaaaacgggtaaaaacccgtaacccggttaaaccgggggtaaacggtaacccgttaaccccggggaaaacgggaaaaccgggggggtaccccggtaaacgttttaccccggtaaacccccgggtttacccgttaaccccggaaacgggtaaacggtaaaccccgtaaaacggttttaacccccggaaacggggttaaaacccaaacccggtaaacccgtttaccgggaaccgttaaccgttaacccgttaacgggtaaaccccgtaaaaaacgttttaccggttaaaacccgtaaaaccccctttaaacggtaaaaccccggttaaaaagggttaaccggggtaaaccgggtaaaccccgggtaacccggggtaaccgggttttaacgggtttaacccgttttaaacggttttaaccggttttaaccgggtttaggggttacccgggaacggggttaaccccccgtaacccccccgggttacccggggtaaccccggggttaaccccccgggtttaccccccccggggg

SEQ ID NO: 291791 - DNA, 783 bp, Homo sapiens
  misc_feature: GYAE6OF02IKUSW.44.36.D03.1.454.CMB.1.raw
tcagacagtatatacacgaccggtgctcgatttagctgcgtcacgatctctcttgggggggagacgagcccagcactggaagtcgccggtgtttccattcggtgatcatcactgaacacagaggactcaccatggactttgggctgagattgggttttcctcgttgctcttttaagaggtggccagtgtcaggtgcagctagtggagtcgtgggggagagcggcccagcctgggaacctccctgagactctcctgtcgcagccctcgtggactttcattcttacgaggtacccttagtcgccctaatcggaccgtacggttcgggggtcccgaccgacgggtcctacccgagggtaccggaaacgggggtctagggggaacgggttcggggtacggtaactaaagttttaacgtactaccggaaaggtaaaggtagttaagggtaaactttaagggaaaaccgtaaacccgaacggttaaccgggaacgtaaacccgtacccgggaaagggtaaaaccggggtccgtaacgtttacccgaaccccggttcctaacccggaaagaacgtaaacctaaacgtttacccgaaacggtaaacccgaacctaacgtcgacctacgttaccgtacggaacctaaaattccgtaaaccctaacctacaaacgtaagtacggaaccggtacgtaccggtcgttacggttaccttaagtttacgttacggtacgtaccggtacggtaacccccggtaccccgtacgggtaaccggtacccggttacccccgg

SEQ ID NO: 291792 - DNA, 623 bp, Homo sapiens
  misc_feature: GYAE6OF02FXIF6.44.36.D03.1.454.CMB.1.raw
  modified_base (165)..(165): a, c, t, g, unknown or other
  misc_feature (165)..(165): n is a, c, g, or t
  modified_base (218)..(218): a, c, t, g, unknown or other
  misc_feature (218)..(218): n is a, c, g, or t
  modified_base (323)..(323): a, c, t, g, unknown or other
  misc_feature (323)..(323): n is a, c, g, or t
  modified_base (333)..(333): a, c, t, g, unknown or other
  misc_feature (333)..(333): n is a, c, g, or t
tcagacagtatatacacgaccggtgctcgatttagctgcgtcacgatctctcttggggcagagctctggggaggaactgctcagttaggacccagacggaaccatggaagccccagcgcagcttctcttcctcctgctactctggctcccagactaccaccgganaaattgtgttgacgcagtctccaggccaccctgtctttgtctccgaggggaancgccaccctctcctgcgacgggccagtcagagtgttgaccaccaccaccagtcttctacgcctggtaccagcaagacgccgtggccaggcctcccgaggcctccncatactacgntcgcactccgagacgaacggccgtgtacggcctaacgtcccgaagtacgtacggttcaggtcggacgtagggtcgggtcgtacgggactacggtacttccgactcgtacagtactacgtcgaggacggtacgtcggacgtccgtaggtacggtacttcgagtacgttaagttttacttacgttcgtactaggtacgtagttggttacggttcggtaccgttaccgtcgttacggtaccggttaccggaccggtaacgggtaaccgggtaaggtaaggtaacgtaaaccgg

SEQ ID NO: 291793 - DNA, 629 bp, Homo sapiens
  misc_feature: GYAE6OF02JOQ2B.44.36.D03.1.454.CMB.1.raw
  modified_base (315)..(315): a, c, t, g, unknown or other
  misc_feature (315)..(315): n is a, c, g, or t
  modified_base (381)..(381): a, c, t, g, unknown or other
  misc_feature (381)..(381): n is a, c, g, or t
  modified_base (404)..(404): a, c, t, g, unknown or other
  misc_feature (404)..(404): n is a, c, g, or t
  modified_base (590)..(590): a, c, t, g, unknown or other
  misc_feature (590)..(590): n is a, c, g, or t
  modified_base (611)..(611): a, c, t, g, unknown or other
  misc_feature (611)..(611): n is a, c, g, or t
  modified_base (620)..(620): a, c, t, g, unknown or other
  misc_feature (620)..(620): n is a, c, g, or t
tcagacagtatatacacgaccggtgctcgatttagctgcgtcacgagtctctcttggggatcacataacaaccacactcctcctctaaagaagcccctgggagcacacgcctcatcaccatggactggcctggcggttcctctttgtggtggcagcagctacaggtcgtccagtcccaggtcgccagctgggtcgcagtcgtggggcttggaggtgaaagagcccgtgggtcctcggtgaacggtctccgtggacaaggtctttcgaggaggcctacctttcgtcacgcttagtgttcgtttttagttcgggtanaccggaagccggtaccccgttaggaacgaagggtccgtttgaggcggcgtggggacggtattaccncgttacccgtattccggttggtnacctagtacctaggttacacgagtagttaattcgagggactaggactacgtaccagttacccggaggtaacaactccggaacagtaccacggaccttacgagtccggattaccgagtacgaccgagttccgagtaacgtcttaaacgcggtaagacgtcgacagttacttagttcgagtaccgcgngtaaccgcccgttagtacctnttaaccggntaccggtcc

SEQ ID NO: 291794 - DNA, 683 bp, Homo sapiens
  misc_feature: GYAE6OF02JF505.44.36.D03.1.454.CMB.1.raw
  modified_base (295)..(295): a, c, t, g, unknown or other
  misc_feature (295)..(295): n is a, c, g, or t
  modified_base (321)..(321): a, c, t, g, unknown or other
  misc_feature (321)..(321): n is a, c, g, or t
tcagacagtatatacacgaccggtgctcgatttagctgcgtcacgatctctcttggggagctctgcttcagctgtgagcgcagaaggcaggactcgggacaatcttcatcatgacctgctcccctctcctcctcacccttctcattcactgcacagggtcctgggcccagtctgtgttgacgcagccgccctcagtcgtctgccggccccaggacaggaggtcaccatctcctgctctaggaacaacctccaatgtaggaaaatattatgtatcctggaccagcaactcccaggnacgacgaccccaaatcctacatttanagaacaataactacgcctaccctgacggtactccgtagaaccgtattctcgtacgtcctacctaaggttcctcgggacctacggtacctacgtaccctacccgtcggaccctactacccgtaaccgggaccttaccgaccggtaaccggttacggggggaccgtaaccggggtacccgttaaagtttaaccctttaacgggtacccggtacgggggtaaaccggttggggaacttaccggacgtaccgtacccggtaggtacggtcggtccgggtacgggtacgttaccgttgggtttacccggtacggggtaccggggaacggtaaccgggacgggttaccggtcccggtttaaacccggg

SEQ ID NO: 291795 - DNA, 713 bp, Homo sapiens
  misc_feature: GYAE6OF02HTGHJ.44.36.D03.1.454.CMB.1.raw
  modified_base (344)..(344): a, c, t, g, unknown or other
  misc_feature (344)..(344): n is a, c, g, or t
  modified_base (521)..(521): a, c, t, g, unknown or other
  misc_feature (521)..(521): n is a, c, g, or t
tcagacagtatatacacgaccggtgctcgatttagctgcgtcacgatcgtctcttggggagctctgagagcggagccccagccccagaattcccaggtgttttcgatttggtgatcagcactgaacacagaggactcaccagtggagttcgggctgagtcgttgggttttccttgttgttatttacaaggtgtccagtagtgaagtgcaggttggtggacggtccgggggatacgttggtccagccgtgggacgggtccctggacgtactcctccttggtcgtccgccttcgtggacttccaccatcgagtcgacctactaatacgtggtacgtcggggtcccnccgacggtcctacccggaagggggaacggggtccgtagggtacgggtcgggtacgttcgggacccgtaacgtaaaacgtaaaaaacgtaacggttcgaacctagtacttttaacactaaccgaggtacgtaccgccgtcgtcgtaggtacgaaacgtcccgaagtacttccaccctnacgaagagtatcgtacttacgaataactctaagttgacttagtacgtaacgtaatacgtaaacccttaacggtaacggaaaacccgtagggaaccgaccgggtacttaaggttaggtttaactttagtttcgggtttagtttacggttaagttttactacggttacgtaacgggttacttcggtaaccccgg

SEQ ID NO: 291796 - DNA, 754 bp, Homo sapiens
  misc_feature: GYAE6OF02IRCJS.44.36.D03.1.454.CMB.1.raw
  modified_base (257)..(257): a, c, t, g, unknown or other
  misc_feature (257)..(257): n is a, c, g, or t
  modified_base (304)..(304): a, c, t, g, unknown or other
  misc_feature (304)..(304): n is a, c, g, or t
  modified_base (339)..(339): a, c, t, g, unknown or other
  misc_feature (339)..(339): n is a, c, g, or t
tcagacagtatatacacgaccggtgctcgatttagctgcgtcacgatctctcttggggatcacataacaaccacactcctcctctaaagaagcccctgggagcacagctcatcaccatggactggacctggcggttcctctttgtggtggcagcagctacaggtgtccagtcccaggtgcagctggtgcagtcgtggggctggaggtgaagagccgtgggtcctcggtgaacggtcctccgtgacgaaggtcttcgnggacggctaccttcgttacagtctagttgttactttttagttgggtncgacgacggtcccgtaggacgtaagggtcttaggngtggtcgtgggaggtactacactcccttattcgttcggtagctacgtacgtaaacgttacgacgtaacgtaaggttaacggtttacgaacgggtaacgtaaggtacgttaaccccgaaaccttacggttaaaccccgggacgggaaacccgtaaaccttacccgaaacggtacgtaacccgaacggttaccctaacggaggttacggacggttacgtacggacggtccggaacggggttcgtaacgggtacggtaaccgttacgtaaacggggtaaacgtacccgtaacgggtaccctttaacgttaccgtttaaccggttttcgttaacgggtccggaacgggtaaccgttcccggtaacccgtttaggttaaacccgttaccggttttaaccgtaaccgtttacccggttccc

SEQ ID NO: 291797 - DNA, 734 bp, Homo sapiens
  misc_feature: GYAE6OF02GY23P.44.36.D03.1.454.CMB.1.raw
  modified_base (164)..(164): a, c, t, g, unknown or other
  misc_feature (164)..(164): n is a, c, g, or t
  modified_base (217)..(217): a, c, t, g, unknown or other
  misc_feature (217)..(217): n is a, c, g, or t
tcagacagtatatacacgaccggtgctcgatttagctgcgtcacgatctctcttggggcagagctctggggaggaactgctcagttaggacccagacggaaccatggaagccccagcgcagcttctcttcctcctgctactctggctcccagataccactgganaaatagtgatgacgcggtctccagccaccctgtctgtgtctccgaggggaaancgcccaccctctcctgcgagggccagtcagagtgttaccagcaacttagcctggtacccacacgaaaccgtgggcaggcctccccgaggccttcctcactactaagtcggaaccactacccaacccgacggggaccctacgttcggttaacctcccccgaacccgtagggttcgacggttgggccgtaacgggttcgggggtacccggggactacgggtaccgtttaccgaaccttccgtacaacccgtattcccgaacgggcccggtcccgttacggccgtaggttcccgtagggtacggtttactttttacggacgtttacgtttttaacttaccgttcggtacgacggttactaaagttattaaaacgttaccgttcgggtacccctttaccccggttaccgggacccggtaaacggggtaccctaaccgggtaacgtacgggtaaacgttaacggttaaaccgtaagttcgggtacggtccgttaccggaccctaaccgtcgttaccgttccg

SEQ ID NO: 291798 - DNA, 723 bp, Homo sapiens
  misc_feature: GYAE6OF02JPPN8.44.36.D03.1.454.CMB.1.raw
tcagacagtatatacacgaccggtgctcgatttagctgcgtcacgatctctcttggggatcacataacaaccacactcctcctctaaagaagcccctgggagcacagctcatcaccatggactggacctggcggttcctctttgtggtggcagcagctacaggtgtccagtcccaggtgcagctggtgcagtcgtggggctggaggtgaagagccgtggtcctcggtgaacggtcgtctgcaaggtcttcgtgggagtcaccttcgttacacgtctagttgttctttttacggttggggtcgtcggtaaccgaccgggtcccccgtagggaccgtaaacggggtccgtttagggtacggttacggggtccgttaggggggagggtaccttaccgacgtttccccgttaagtttccgtttggggtcgtacgtaagttacccgtaaagtttaccggacgtaacgtaaggttaacggtttacgaacgggtacaacgggtaccgttaccaaacccgtaggtttaccccgggaacggaacgtaactaccgacgtaacgtaccagtccctaagagtcgggacgtcgtagaccgacgtagggactaggaatcgttacgtaaggaacgtaaccgacggtcctaattcgtttaacgtttcggaggtacgtaccggtaaggtaccgttccccgttggttaccttaacgtttcggtaacctttaccgttccccg

SEQ ID NO: 291799 - DNA, 817 bp, Homo sapiens
  misc_feature: GYAE6OF02G1AML.44.36.D03.1.454.CMB.1.raw
  modified_base (255)..(255): a, c, t, g, unknown or other
  misc_feature (255)..(255): n is a, c, g, or t
  modified_base (264)..(264): a, c, t, g, unknown or other
  misc_feature (264)..(264): n is a, c, g, or t
tcagacagtatatacacgaccggtgctcgatttagctgcgtcacgatctctcttgggggactcctgtgccccaccatggacactctttgctacacactcctgctgctgaccaccccttcctgggtccttgtcccaggtcaccttgaaggagtcgtggtccgtgtgcgtggtcgaacccacaggacgaccctcacgctagacctgccacacttctcgtgggttctctctacaacgtattagtagtaagtggggttntggagtcgnggtacgtcccgtcgaccggccccgaaggggaaccggcccggtagggacggttcggcgttcggaccgacctactaccgttcttaccgttactaagtacggaaactaaaaacgtcctaaactacgtaactactacttacgacgtaaggacgtaccttaaagtttaacctactaccgtaccgtaaacggaaccctaaacccgtaaccggaaaaggtaccgtaagggttacgggtttaacttttacggtaacgttacggtaaacccgaacgtaagttacccgggaacccgtacggtaccggaacgtaaccggacggacaaccgtaagttacttaacgttcggtaacggtaccgtaagggtaaccgtaggggtaacggaaaaccggtaacgaaacggttaccgttagggtttaacttaggttaagtttaacgtaacgtttaccgttaacttacggtaacgttacccggttaagggttacccgggtaacgggggaaccgtaaaccggggtaacccgggttacccgtacccgggtacccgtttaccggttaccctaacgg

SEQ ID NO: 291800 - DNA, 1119 bp, Homo sapiens
  misc_feature: GYAE6OF02G0QVP.44.36.D03.1.454.CMB.1.raw
tcagacagtatatacacgaccggtgctcgatttagctgcgtcacgatctctcttgggggggagacgagcccagcactggaagtcgccggtgtttccattcggtgatcatcactgaacacagaggactcaccatggactttgggctgagattgggttttcctcgttgcttcgttttaagaggtggcctagtgtcaggtgcagcgtaggtggagtcggtaggggggaggacgccgggcccgaggccgtcggggaacccttcccgtaggacggaccttccgtccgttaggtcgccacggtcccgttcgttgggtactttccgtacttaccgtttacgaacgggtacccgttaacgtacggtacccgtagttaccggaccgtaaccgggttaccgggggttcccccggacccggtaaccggggtcccccgttacccggaaccgggggtaacccgggaaaacgggggggttcccgggttacggggggtaacgggggtttacggggggttaacggggtaacccgtttaaaagttttaaacgtttaaacgtaccggtaaaaaggggttaaacggtaaaggtttaaacgggggttaaaagtttaaaacggggaaaaaacccggtaaaaacccggtaaacccgggtttaaaaccggggtaaacccggttaaaaccccgggtaacccggggaaaccggggtaaaccgggggtaaaccccggtttaaccggtttaccccggttaaaccccggttacccgtaacccggtaaacggtaaaccggtaaacccgttaaaaccggttaaccccggaaacgggtaaaacccccgaaaccgtaaccgttaaccggtaacccgttaaccgttaaccggttaaccggtaaaccgtttaaaaccgttaaacccgttaaaaccccgttaaacccccgttaaacccgttaaacccggtaaaacggggttaacccgaaaccggggtaacccgtaacccgggggttacccgtttaacgggtttaacctttaacggtttttaaccggttggtttaaccggtaaccggtaacccgggttaaccccgggtaacccccccggtttaacccggggaacccgggttacccccccggggtttacccccggg

SEQ ID NO: 291801 - DNA, 668 bp, Homo sapiens
  misc_feature: GYAE6OF02JB1XO.44.36.D03.1.454.CMB.1.raw
  modified_base (164)..(164): a, c, t, g, unknown or other
  misc_feature (164)..(164): n is a, c, g, or t
  modified_base (201)..(201): a, c, t, g, unknown or other
  misc_feature (201)..(201): n is a, c, g, or t
  modified_base (355)..(355): a, c, t, g, unknown or other
  misc_feature (355)..(355): n is a, c, g, or t
  modified_base (468)..(468): a, c, t, g, unknown or other
  misc_feature (468)..(468): n is a, c, g, or t
tcagacagtatatacacgaccggtgctcgatttagctgcgtcacgatctctcttggggcagagctctggggaggaactgctcagttaggacccagacggaaccatggaagccccagcgcagcttctcttcctcctgctactctggctcccagataccactgganaatagtgatgacgcggtctccacgccacctgtctgtntctcgaagggaagcgccaccctctccgtgcgacgggccagtcaagtagtgttagcacgactaacgttacgtccgtacgtaccgacgacaacgtaaacgttccgtacgggcccgtaggtcccgtcccgaggtcctcctcacttctagtcgggtcnctacctacccgaccgacggccctacgtacggtacctcccgacgaccgtaggttacgaggtcggtcgagggttgggtcgtagggaactaggtacgttccacttctacgactacncacggccacgtcgacgtcgttacgtagtacgtaagtttactttacggtacttaagttttacttacgttacgtagtaacgtaacgtaagttacgttaagttacttaccggtccggttacccgttacccggtcggtaaccggtaacggtaaccgtacggtacgggtaaccggtaacggtaacgttaaccggtagttaccggg

SEQ ID NO: 291802 - DNA, 724 bp, Homo sapiens
  misc_feature: GYAE6OF02GA1LA.44.36.D03.1.454.CMB.1.raw
tcagacagtatatacacgaccggtgctcgatttagctgcgtcacgatctctcttgggggactcctgtgccccaccatggacactctttgctacacactcctgctgctgaccaccccttcctgggtcttgtcccaggtcaccttgaaggagtctggtcctgtgcgtggtacgaaacccacagagaccctcacgctgacctgcacatctctggttctctctcaagatattagaagtgggtgtagagcgtggacgtccgtcgacgcccccgaaggggaacggcccgtggtacggtggcgtttggaccacactatcttcctacgaacttagaaaccgtaaaaacgtcctaacgtaacgtactactccgttactaaggaagacggtactaacgttaaaccattacctaaccgaaaggacctaaccgtaacgaaaacggacgtaacgggttcgttaactttaacggtactacggaaaccctaacgtagtaccggtacccgtaggaccgtaacgaccgacggactaacgtaacttacgttacgtagtaccgtacgtaaccgggttaagacgggaaccggaaaagaaacccgtagtaccgttagttacgtaagttaatttaaacgtacgtttacgttaccgaatttcccggaaggttaccggtacgttaacgggggaaccttaaacggggacccttaaacggtacccgtaccgttaccgtacccgtaaccgg

SEQ ID NO: 291803 - DNA, 784 bp, Homo sapiens
  misc_feature: GYAE6OF02H1ZNF.44.36.D03.1.454.CMB.1.raw
  modified_base (162)..(162): a, c, t, g, unknown or other
  misc_feature (162)..(162): n is a, c, g, or t
  modified_base (276)..(276): a, c, t, g, unknown or other
  misc_feature (276)..(276): n is a, c, g, or t
tcagacagtatatacacgaccggtgctcgatttagctgcgtcacgatctctcgttgggggggagacgagcccagcactggaagtcgccggtgtttccattcggtgatcatcactgaacacagaggactcaccatggactttgggctgagattgggttttccncgttgcttctttaagaggtggccagtgtcaggtgcagctagtggaggtcgtgggggagagccggacccaggtccgtggggaacctcccgtggaacgccttctccgtggtacgcncggtccctgtaggattccagttccgttacgaacggtacccttagtcgaccagtcgaccgtacgtcgggtacccgcgacggtcctaccgaggaccggtaggggtccgtggggaggtcgggtagactaaatttacgagtacgaaaggtaagtagttaagggtaacttaacgaaaacggtaaaccgtacgtaacgggaacgtacccgtaccgggaaacgggaaacggggtcccgtaacgtacccgtaccggtaccgtaaccgtaacggaaccgtaaaccgtaaccgttacccgaaacggaacctaaccgaaccgtcggacctaacgttccggtaacgaaaccgtaaacgttaccgtaaaaccctaaccgttaaacccgaaagtaaaccgggtacggtaaaccggacccggtaaccggttaccgttaagttacccgtttaagttaccggtttagaaccgggcggtaaccggacccggtaccccgtaccggtaccgggtacccgttaccccgg

SEQ ID NO: 291804 - DNA, 633 bp, Homo sapiens
  misc_feature: GYAE6OF02FMWWM.44.36.D03.1.454.CMB.1.raw
tcagacagtatatacacgaccggtgctcgatttagctgcgtcacgatctctcttggggcagagctctggggaggaactgctcagttaggacccagacggaaccatggaagccccagcgcagcttctcttcctcctgctactctggctcccagataccactggagaatagtgatgacgcggtctccagccaccctgtctgtgtctccgaggggaaagcgcccacccctctcctgcgacgggccagtcagagtgttagcagcaacttagcctcgtacagcagaaatcgtaggccgaggcctcccgaggcctcctacatcctagtcggtgcacgtcccaccgacgggccctaacgtcggtaacctacccgacgtcccgtagggttcacggtcggcctacggttcggggtcgtaggggacgtaggtacgttactactctacctaccgtactacacgcctacgtccgtagcctacgtcgtagtaacgttacgttttacggtcttaagttttacgttaacgttcgtacgtaagtaccgtaagttactagggtacgtaccgtaccggtccttaccgttacctaccggtttccgtaccgtaccgggtacctacgtacgtacgttacgttaccgtaaaccgg

SEQ ID NO: 291805 - DNA, 822 bp, Homo sapiens
  misc_feature: GYAE6OF02G74O0.44.36.D03.1.454.CMB.1.raw
  modified_base (255)..(255): a, c, t, g, unknown or other
  misc_feature (255)..(255): n is a, c, g, or t
  modified_base (269)..(269): a, c, t, g, unknown or other
  misc_feature (269)..(269): n is a, c, g, or t
  modified_base (348)..(348): a, c, t, g, unknown or other
  misc_feature (348)..(348): n is a, c, g, or t
tcagacagtatatacacgaccggtgctcgatttagctgcgtcacgatctctcttggggagctctgagagcggagccccagccccagaattcccaggtgtttcatttggtgatcagcactgaacacagaggactcaccatggagttcgggctgagctgggttttccttgttgttatttacaaggtgtccagagtgagtgcaggttggtggagtccgggggatacttggtccagcctgggacggtccctgagacctntcctgtgtcgcctntggacttccaccatcagtcgaccactatagtggacgtgggtcccgccgaggccgtccggaaggggtacgggcgtcgggnggtcgggtacgttcgggccgacgtaaacgtaaaaccgtaagttccgaccgtagttactttacacaacgacggtacgtaccggcccggtcgttacgtggtaaccggaacgaccgtaacgtacgttaccctaccctacgtagaacggtacgtaacttacgaactttaacgaaacgttaaccgttactaacgtttcgttaacgtttaccgtacggtaaccgtaacgttaaccggtaaacccgttaaaaaccccggtaaaccgggaaaaaccgggttacccggggtaaacccgggaacccggggtttaccgttaacggtttaaacggtttttaaacggtttttacggtttttaaacgggtttttcgggttttttaacgggttttttaaacggttttttaaacgggtttaaaccccgtttaacccggggttaaaacccggggttttaaaccgtttaccccgggtttaaacccccggggg

SEQ ID NO: 291806 - DNA, 712 bp, Homo sapiens
  misc_feature: GYAE6OF02IGGE0.44.36.D03.1.454.CMB.1.raw
  modified_base (326)..(326): a, c, t, g, unknown or other
  misc_feature (326)..(326): n is a, c, g, or t
  modified_base (425)..(425): a, c, t, g, unknown or other
  misc_feature (425)..(425): n is a, c, g, or t
tcagacagtatatacacgaccggtgctcgatttagctgcgtcacgatctctcttggggagctctgagagcggagccccagccccagaattcccagatgttttcatttggtgatcagcactgaacacagaggactcaccatggagttcgggctgagcttgggttttccttgttgttattttacaaggtgtccagagtgaagtgcaggttggtggaggtccgggggagtactttggtccaggcctgggacgggtccctggagactctccgtgtgtcgtcctctggtattcaccatcagtcgacctactatagtggacgtcggggtccnccgtaggctaccggagggaaggggcgtagggaggtcggtcgttcgggcccgtacaaaacggttaaaaaactaaggttacgacccgtaacgtcttttaanaaccgtaaccgaaggtaaccggtaaccggtcccggcgtttacgtggtaaacggaaacgtccgaagtaacgtttaccccaccccgttactaacgaaacgtaacgacttacgtaccttaacgaaataaccttacgtaactttacgtaagtttcctaggtaaccgtaattaccgtaaaccgttaacctaaaccggtaaaacccggagggtaaccggaccggtactagttagttaactttaagttcgtttagttggtttagttttagtacgtacgtaggtaaccttacggg

SEQ ID NO: 291807 - DNA, 633 bp, Homo sapiens
  misc_feature: GYAE6OF02JGEM7.44.36.D03.1.454.CMB.1.raw
  modified_base (323)..(323): a, c, t, g, unknown or other
  misc_feature (323)..(323): n is a, c, g, or t
  modified_base (368)..(368): a, c, t, g, unknown or other
  misc_feature (368)..(368): n is a, c, g, or t
  modified_base (395)..(395): a, c, t, g, unknown or other
  misc_feature (395)..(395): n is a, c, g, or t
  modified_base (399)..(399): a, c, t, g, unknown or other
  misc_feature (399)..(399): n is a, c, g, or t
  modified_base (414)..(414): a, c, t, g, unknown or other
  misc_feature (414)..(414): n is a, c, g, or t
  modified_base (483)..(483): a, c, t, g, unknown or other
  misc_feature (483)..(483): n is a, c, g, or t
  modified_base (539)..(539): a, c, t, g, unknown or other
  misc_feature (539)..(539): n is a, c, g, or t
tcagacagtatatacacgaccggtgctcgatttagctgcgtcacgatctctcttgggagctctgagagcggagccccacgccccagaacttcccaggtgtttcatttggtgatcagcactgaacacagaggactcaccatggagttcggctgagcgtggttttccttgttgttatttacaaggtgtccagtagtgaagtgctagttggtggaggtccggggagacgttggtccagccgtgggagggtcccctggacgtactcctccgtgtcgtccgcctcgtggacttcaccatcagtcgaccactatagtggactgggtccnccgaggcctaccggagggaacggggctgggagtggctggccgtanaagtaaaaacgagtcgaccagtcttanacanagtacgtacgccgtntcgtagtacaaacgccagtacttcccaaccgttctaacaaggactatacgtaactacgaaagaccttanaattcgtaattccgtagacgtaactacggtaaccttaaaaccgtagaaaaaccggngtaaacccgcgggtactacgtagtttaacttagttcggtagtttttaggtactttttaacgtactacggtaagggttaacccttgtaaccccgg

SEQ ID NO: 291808 - DNA, 890 bp, Homo sapiens
  misc_feature: GYAE6OF02GGBXO.44.36.D03.1.454.CMB.1.raw
tcagacagtatatacacgaccggtgctcgatttagctgcgtcacgatctctcttggggagctctgagagcggagccccagccccagaattcccaggtgttttcatttggtgatcagcactgaacacagaggactcaccagtggagttccgggctgagtcgttgggttttcctttgtttgtttattttacgaaggtgtcagagtgaagtgcaggttggtggaggtccggggagtacgttggtcccagcccgtagggtacgggtcccttggaacgtactccttaccgttggtcgttccgcccttcgttacggtactttcccgaacctacgtaccgtaacggttaccgtaaccccgtaacttaacgtacgtttacggggtacccggtttcgggggtacccccgtaccccggtaagggtccccggttaaccccgggtaaaggggggaaccggggggtcgttacggggtagggttaccggggttccggtttacggggaccccggtaacgtaaaaacggttaaaaaaaccgaacggtttccggaacccgtaacgtttaccgttttaagtacccgtaacgaaacgggttaccggttacccggacccggttacggttacggtaacggtaacggtaaaacggcccgtaaagtttacctaccccgaacccgttacgttaaaccgaaggtaacggtattaccggtaaaccgtttaacgaaaccttaacttacgtaagtttacgtaacgtttcgtacggacttaaacgtacgttaaacccttaaaaccgaaccgggaaaaaccgtaacggggttaaccacgggtactacggttaagttaactttgtttaggttagttttagttagtttagttacgtacgtaacggttactcggttaacccgg

SEQ ID NO: 291809 - DNA, 662 bp, Homo sapiens
  misc_feature: GYAE6OF02GDKHZ.44.36.D03.1.454.CMB.1.raw
tcagacagtatatacacgaccggtgctcgatttagctgcgtcacgatctctcttgggatcacataacaaccacactcctcctctaaagaagcccctgggagcacagctcatcaccatggactggacctggcggttcctctttgtggtggcagcagctacaggtgtccagtcccaggtgcagctggtgcagtctggggctgaggtgaagaagcctgggtcctcggtgaaggtctcctgcaaggcttctggaggcaccttcttcagctatgtcttttagtttgggtgcgacaggcccctggacaagggcttgagtggctggggaggatcacttccctagtctttgggtgcagttcgaattacgctaacagtaagtttacaggtaacagtacgtacaccgtaacgttacccggacgggaaaccgtaaacgtacccgaacgaacgtaaccacgtcccgtaaactagtacgggaacgtccgttaggaacggtcgaacgggccgttaggaacggtacgttaccgtaacgaaacgggtaaccaaccgggtcccttaagttccgttaagttttaccggttaacggtcggtaaccggacggtaacccgtccccgttaccggttaacccgttaaacccgttttacccgttaagttaacccggtttacccccc

SEQ ID NO: 291810 - DNA, 809 bp, Homo sapiens
  misc_feature: GYAE6OF02FMTI4.44.36.D03.1.454.CMB.1.raw
  modified_base (256)..(256): a, c, t, g, unknown or other
  misc_feature (256)..(256): n is a, c, g, or t
tcagacagtatatacacgaccggtgctcgatttagctgcgtcacgatctctcttgggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggcccagcctgggaacctccgtgagactctcctggncacgcctcgtggacttcattccttcgaggtacctatcggacctagtcggcctacggttcggggtcccgccgaacgggtcctacccggagggaccggtaaacgggggtccttagggggacggttgggggtacggactaaagtttagtagttaccgaaaggtaaaggagtttaacggggaaagtttacggaaaaacggtaaacccgtaacgggttaaacccgggaacgaacccggttaacccgggaaacgggtaaacggggacccgtaacgtttacccggtaacccggttaccgtacccggaacggtaaccggtaaccgtaaacgttaacccggaaacggtaaacccgaaccgtaaccgtacgaccgtacgtaccgtaccgaaccgtaaacgttaccggttaaacccaacccgttaacgtaaccgtaaaggtaacgggtaacggtaaccgtacgggtaccgttacggtaacgttaacgttttaacgttacggtacggtaaccggtaccgtacccggtaccccccgtacgggtaccgtaccccgggttacccccgg

SEQ ID NO: 291811 - DNA, 752 bp, Homo sapiens
  misc_feature: GYAE6OF02GA42L.44.36.D03.1.454.CMB.1.raw
  modified_base (276)..(276): a, c, t, g, unknown or other
  misc_feature (276)..(276): n is a, c, g, or t
tcagacagtatatacacgaccggtgctcgatttagctgcgtcacgatctctcttggggagctctgagagcggagccccagccccagaattcccaggtgtttcatttggtgatcagcactgaacacagaggactcaccatggagttcgggctgagctgggttttccttgttgttattttacaaggtgtcagagtgaagtgctagttggtggaggtccgggggagtacgttggtccaggcctgggacgggtccctgacgtactccgtcctgtcgtccncctctggtattcctactttcgagtaaccgtccgtaggactcggacccgtggggtcccgaccgacggtcctccggaaggggaacggggcgtacggggtaggttcggggttcggacggttaacgttaacggaaaaccgtaaaggtccgtaggggtaaccgggttgggggaaacctagggaccgaacggtaacccgtacgacccgtaggacccgtaacccggtaagggaaacggctaaacggtcttaacccgaacctaacttcccgtaacgaaaggtaccgtaagtacgtaaacttaaaccggaaaaagttacggttacgggttcgtacgtccgtaggaccaaggtactagaaacctcgtaccaacggtaaaccgcggaaggaccacgtaccggtccgttactttaagttaaccgtcggttaccgtgggtaactttcgggtttaacaccggtttccgggaccgtaaccgggttaccccg

SEQ ID NO: 291812 - DNA, 716 bp, Homo sapiens
  misc_feature: GYAE6OF02GQP7B.44.36.D03.1.454.CMB.1.raw
  modified_base (367)..(367): a, c, t, g, unknown or other
  misc_feature (367)..(367): n is a, c, g, or t
tcagacagtatatacacgaccggtgctcgatttagctgcgtcacgatctctcttggggatcacataacaaccacactcctcctctaaagaagcccctgggagcacagctcatcaccatggactggacctggcggttcctctttgtggtggcagcagctacaggtgtccagtcccaggtgcagctggtgcagtctggggctgaggtgaagagcctgggtcctcggtgaaggtctcctgcaaggcttcgtggaggctaccttcttcagtcttatgtctttttagttgggtgacgacgtacggcccctggacgtaagggtcttggaggtgggcgtggggagggtactctacgtcccgttattcgtttggngtctacgttacgtaatttaccgctaacgtaagtaacgtttcgaggacaaggtacgtcctaactaacgttacccggacggtaaccgtaactacccggaacgtacgtaaccgaacggtaccttaacgagttacgggaacgtccgtaggacggcgtaacgggcgtaaggaaccggtacttaccgggttaacggaaacggtaacccgacggggtaaccttacgtttaccgtttacgttttaaccggttacgggttacggtacccggtaaccgggtacccgttacccccgtttacggttaacccgtttaaacccgtttttacggtacccggtttaccccggtttaacccccccg

SEQ ID NO: 291813 - DNA, 1047 bp, Homo sapiens
  misc_feature: GYAE6OF02FS2UT.44.36.D03.1.454.CMB.1.raw
  modified_base (217)..(217): a, c, t, g, unknown or other
  misc_feature (217)..(217): n is a, c, g, or t
  modified_base (288)..(288): a, c, t, g, unknown or other
  misc_feature (288)..(288): n is a, c, g, or t
tcagacagtatatacacgaccggtgctcgatttagctgcgtcacgatctctcttggggcagagctctggggaggaactgctcagttaggacccagacggaaccatggaagccccagcgcagcttctcttcctcctgctactctggctcccagataccactggagaaatgtgatgacgcggtctccagcccacctgtctgtcgtctccgaggggaaancgccaccctctcctgcagggccagtcagagtgttagcagctaacttagcctcgtaccagcaagtaaatcgnggacccaggtccctcccgaggcctccctacgtacttcgtaacgtcgggtcgtaccgtacgttccccaaacccggtagggacccctaacggttaccgggttaaccttacccccggaacggtaccccggttaaggggtttaccgaacggggtttaccggggccgttaacggggggtttccggggggtttaccggttacgggggggtaaacccgtaacgggggtttaaccggttttaaccccgtaacccggttttacccgttaaccccgtaaaacccccggttaacgttaaccccggtaaccgggtaaccccggtaaccgggttacccccgttacggggttaaccccgttaaaccggggttttccgggttaaaacgggtttaaaaccggggttttaacccgtttttttttaaccgggaaacccggtttttttaaaccgggtttttttttaaacccggtttttaaaccccggttttaacgggttttaacccggttaaaaccgggtttaaacccgggtttaaaacgggttttaaaaaccggttttaaaccggtttaccccggggttaaaccggttttacccccggggtttaacccccccgttttaccccccgggggttttaaacccggggtaaccccccggggttaaaaaccgggggttaaccccccgtaaaccgggggtttaaacccggttaaacgggggttaaaacccggtttaaaaacccgggttttaaaaacccgggtaacccggttttaaacccggggg

SEQ ID NO: 291814 - DNA, 706 bp, Homo sapiens
  misc_feature: GYAE6OF02GEXRO.44.36.D03.1.454.CMB.1.raw
  modified_base (196)..(196): a, c, t, g, unknown or other
  misc_feature (196)..(196): n is a, c, g, or t
  modified_base (546)..(546): a, c, t, g, unknown or other
  misc_feature (546)..(546): n is a, c, g, or t
tcagacagtatatacacgaccggtgctcgatttagctgcgtcacgatctctcttggggagcttctgagagcggacgccccagccccagaattcccaggtgttttcatttggtgatcagcactgaacacagaggactcaccatggagttcgggctgagtcgttgggttttcctttgtttgtttattttactaaggtnttccagtagtgaagtgcagttggtggaggtccggggagtacgttggtccacgccgtggacggtcccgtgacgactcttccgtgttcggtcgtccgtcgtggtacttccacctatctacgtccgaccctaacttagtacgtacggtaccggttcgggtacccgtaccgcggccgttaccggaagggggacgggtacgtgggacggttggtccgttcgggccgtacgaaagtaaaacgtaagttcggctaagtacgtttacacacgtagacgtacgccggtctcgtggaagaaaccgcgaagtaccttaccacccttctacgaagtacgtatacggtactaacgaagaactntagttactagtttcacggacttaacgtacgtaaccgttaaacccgacggaaaacggacgaaccgttacggaactacgtttagtttaactttacggtttagttttcggtttagttttagtttaacgtacgttacgtaacggttaccgttacgtaacccggg

SEQ ID NO: 291815 - DNA, 912 bp, Homo sapiens
  misc_feature: GYAE6OF02H4IYR.44.36.D03.1.454.CMB.1.raw
tcagacagtatatacacgaccggtgctcgatttagctgcgtcacgatctctcttggggggggagacgagcccagcactggaagtcgccggtgtttccattcggtgatcatcactgaacacagaggactcaccatggactttgggctgagattgggttttcctcgttgcttcgttttaagaggtgccagtgtcgaggtgcagctaggtggagtcgtgggggagagccggccagcctagggaacctcccgtagagacctctctgtgccgagtcctcgtgtactttacgattccttcgaaggtacctagtcgtactacgcgtaccgacggttccgggcccgtaccgtaaagggcccttaaccgggaacgggtaccggtaaacgggggtcttacggggggagggttacggggtaggtaaccgttaaaagttataacggtaccgtaaaggtaaaggttaaaggtagggttaaacgtaaagtaaaacgggaaacccaaaccccgggtaaacgggaaacggtaccccggtaacgggaaaacggggtaaacccgggtaacccggttaaaccgttacccggtaaaccccggttaccggtaacccgtaaacgggtaaacccggtaaacgtaaaaccggtttaccccggaaaagggtaaacccaaaccgtaaccgtaacggtaacccgttaacgttaacgtaacgaaacgtttaaaacgtaacccgttaaacccgaaacccgtaaacggtaaaccgaaacgggtttaacgggaaaccggtaaccccggtaaccgggtttaaccgttaacggtttaaccgtttaaggtttaaccgtttacgggtaacggtacccggttaaaccgggtaccccggtaacccccccgggttaacggtaacccgggttacccccgggttaaccccgg

SEQ ID NO: 291816 - DNA, 739 bp, Homo sapiens
  misc_feature: GYAE6OF02G3VAZ.44.36.D03.1.454.CMB.1.raw
  modified_base (162)..(162): a, c, t, g, unknown or other
  misc_feature (162)..(162): n is a, c, g, or t
  modified_base (323)..(323): a, c, t, g, unknown or other
  misc_feature (323)..(323): n is a, c, g, or t
tcagacagtatatacacgaccggtgctcgatttagctgcgtcacgatctctcgttggggggagacgagcccagcactggaagtcgccggtgttccattcggtgatcatcacttgaacacagaggactcaccatggtactttgggctgagagtgggttttccncgttgcttcgttttaagaggtggccagtgtcaggtgcagctagtggagtcgtgggggagagccggcccaggccctggggaacctcccgtggacgtacctctcctgtgcaggcctcgtggattcattcttcagtcctagtgcctatcgctacggtggtcccncgtacggcctaccgggagggaacggggtctcgggacggttcgggtctcgaacgtcgttaaatttacgtacgttgggttctacgtttcaaacgtcttaaaccgacgtccgaaagtcccgttacggtaggaaccgggtccgtaacgttccaaccgtacttcccgtaacggacgggtaacctaaccgttaaccgtaaagggtaaccgttaaccggtttacgttaccgttaaccgtaaacgtacgaaaccgtaaacccgtggtaaccggaccgggtaacggaaccggtaaccggtaccggtaacccgtttagttaaccgttacgttacgggtaacggtaccgaacggtaccgtaaacggtcccggacggtacccggttagggttacgttacggtttacgttttacgttaccggtttacgg

SEQ ID NO: 291817 - DNA, 770 bp, Homo sapiens
  misc_feature: GYAE6OF02GZL41.44.36.D03.1.454.CMB.1.raw
  modified_base (207)..(207): a, c, t, g, unknown or other
  misc_feature (207)..(207): n is a, c, g, or t
  modified_base (221)..(221): a, c, t, g, unknown or other
  misc_feature (221)..(221): n is a, c, g, or t
  modified_base (499)..(499): a, c, t, g, unknown or other
  misc_feature (499)..(499): n is a, c, g, or t
tcagacagtatatacacgaccggtgctcgatttagctgcgtcacgatctctcttggggagctctgagagcggagccccaggccccagaattcccaggtgtttcatttggtgatcagcactgaacacagaggactcaccatggagttcgggctgagctgggtttccttgttgttatttacaaggtgtccagagtgaagtgcagttggnggagtccggggganacgttggtccagcctggaggtccctgacgactctcctgtgtcgcctctggattccaccatcagtgacctactatagtggtactggggtcccgccgaggcctaccggagggggaacgggcctgggtacgtcgggtccttgggcccgtacgtaacggttaaaaaacaacggttcgacccgtaagttccttttaacgaccaaccgtaggtacggtaccggcccgtcgttacgtaggtaacgaaacgccctaaggtacttacccacccgttcacgaaacggngtaacttacgtaacctttacgaaacggtaccttcgtaacgtttacgtactttaccgtacggtaccgtaaaacgttccggtaaaacccttaaaccccgggttaaaggaaaaaacccccgggtagggttaaccccgaaccggggggtacctaacgggtttcggtttaaagtttttaacgtttcgggttttaacgggtttttcgttttaacggtttttaacggttaaccgtttaccgggtaaacgggtttaacccttccggggttaaaccccgg

SEQ ID NO: 291818 - DNA, 729 bp, Homo sapiens
  misc_feature: GYAE6OF02HHGM7.44.36.D03.1.454.CMB.1.raw
  modified_base (161)..(161): a, c, t, g, unknown or other
  misc_feature (161)..(161): n is a, c, g, or t
  modified_base (178)..(178): a, c, t, g, unknown or other
  misc_feature (178)..(178): n is a, c, g, or t
  modified_base (337)..(337): a, c, t, g, unknown or other
  misc_feature (337)..(337): n is a, c, g, or t
tcagacagtatatacacgaccggtgctcgatttagctgcgtcacgatctctcgttgggggggagacgagcccagcactggaagtcgccggtgtttccattcggtgatcatcactgaacacagaggactcacatggactttgggctgagattgggttttccncgttgcttcttttaagnggtggccagtgtcaggtgcagcttagtggagtcgtgggggagagccggccaggccctagggaacctcccgtggacgtactcgtccgtgtcgcgagccttcgtggattcattccgttacgaggtacccttatcgacctatcgaccgtacgtcgggtcccncgacggctcccgaggacgaggggtcgtggaggttgggtagtaaacttatacgtcaagaagtagtaggaactttaggaagtaaacctacgtacggaacgccgttaacggaacggaacgggtccgtaacgttaccgaccgtccgtaccgtaacggaacgtaaccgtaaacttaccggaacggtaaaccgtaacctaaccgttacgacgtacgttaccgtacggtaaacctaaacgttaccgtaacctaaacccgttaccgaaacctaagggtaacgaacggtaccgacccgggttacgttcgttaacgttaccgtttaggttacggtaacgtaccggtaacggtaccccggtaccccgtacgggtacggtacccccgggtaccccgttacccgg

SEQ ID NO: 291819 - DNA, 736 bp, Homo sapiens
  misc_feature: GYAE6OF02HNO4W.44.36.D03.1.454.CMB.1.raw
  modified_base (194)..(194): a, c, t, g, unknown or other
  misc_feature (194)..(194): n is a, c, g, or t
  modified_base (238)..(238): a, c, t, g, unknown or other
  misc_feature (238)..(238): n is a, c, g, or t
  modified_base (729)..(729): a, c, t, g, unknown or other
  misc_feature (729)..(729): n is a, c, g, or t
tcagacagtatatacacgaccggtgctcgatttagctgcgtcacgatctctcttggggcagagctctggggagaactgctcagttaggacccagacggaaccatggaagccccagcgcagcttctcttcctctgctactctggcctacccagactaccacgtggaacgaaagttgtgatggaccgtccggtccnccgacgccctaccctggtctagtcgttccaccggaaggggaacnccgccctacccgtctccgtgacgacgggaccaagtcgaacggagttcgtacgcgacgtactaacgttcgcccttacgtaccgagacgaagtaacgtccgacgggtacccacggtcccgtacccggacggtcccttaccgtacgtactacgttaggttcggtacaccgtacgtaccccggaacggaccggtacctaccggtacggtaacctcccgaacggtccgtaacgggttctacgggtcggacggttcggtacgggtccgtacggggtaactacggttaccgtcccttacgtaccgtaccgtacgtacgtacgaccgtacgacggtccgtcgacgttaccggtcttaagggtaacctttgttacggtaactttacgtttacgtacgtgaacgtacgtactaagttacctaaggtaccgtacgtcccggttccttacccggaggaccgtaaccgacgacgtttaggacggttaagtaaacccgttacggngttacgg

SEQ ID NO: 291820 - DNA, 809 bp, Homo sapiens
  misc_feature: GYAE6OF02HZZK3.44.36.D03.1.454.CMB.1.raw
  modified_base (181)..(181): a, c, t, g, unknown or other
  misc_feature (181)..(181): n is a, c, g, or t
tcagacagtatatacacgaccggtgctcgatttagctgcgtcacgatctctcgttgggggactcctgtcgccccaccatggacactctttgctacacactcctgctgctgaccaccccttccgtgggtcttgtcccaggtctaccttgaaggagtctggtcctgtgctggtacaaacccanagacgaccctcacgctgacctgcctaccatctcgtggttctctctacaacgtattaagtaagagtgggtgtaggagtcgtaggactccgtaccgaccggacccccgaggggaccggtccgtagggtacggtcggtcttacgcctaaccgcgtacttcgtttaccgtaacggtaactaacggaaaacgttaaaacctccgtaaaccgtaacgtacctactaccggttactacgggtaaacgtacggtaacctttaacggttaaaccacgttacctaaaccggtaaaccggtaaccctaaacccgtaaccggaaaacggtcgtaaagggtttcgtttaactttaacgggagtaaccgtaccgaaacgttacggtacggtaccccgaggtacccgaagtaccgacggtacctaacttaaacgtttacgtacgttcggtacgtaccggtaaccgggttaagtaccgggaaacgtaaacgaacgttacggttccgttagggttttactaaagttaacgtttaacgtaccgtttaaccgttagtttaccgtcggtacggttaccggtgggtaaccgggacggtaaaccgggttacccggtacgtaaccccggtcttacccggacgttaacccgg

SEQ ID NO: 291821 - DNA, 739 bp, Homo sapiens
  misc_feature: GYAE6OF02I2Y7N.44.36.D03.1.454.CMB.1.raw
tcagacagtatatacacgaccggtgctcgatttagctgcgtcacgatctctcttgggggggagacgagcccagcactggaagtcgccggtgtttccattcggtgatcatcactgaacacagaggactcaccatggactttgggctgagattgggttttcctcgttgcttcttttaagaggtggccagtgtcaggtgcagctagtggagttcgtggggggaggaggcggccccaggccgtggggtaacctccccgtggacgaccttcctccgtggtcgccacgtccctcgtggactttcatccttacacgggtaaccctagtcggacctactcggcctacgttccgggggtcccgacccggagggtcccttaccccggagggacggtaaacggggggccgtgggggaacgggttggggggtcggacgtaaacttagtaacttcgaaaggaacggtagtacgggtaaattaggaaacgtaaaccgtaacgtaccgggtaacgtaccgtaccgggaacgggaacgggtaccgtacgtttaccgacccgtctaccgaagacgtaacctaacgttaccgaagaaccactaccgtagacctataccgtagaactaaagtacgtaaacccaactaccgaaactaaggtacgacggacgtaccggtacgtcgttacgttagtttacgttcggtacggtacgaccggacccgtacccccgtacggtacccggtacccggttcccccgg

SEQ ID NO: 291822 - DNA, 896 bp, Homo sapiens
  misc_feature: GYAE6OF02IJ1M3.44.36.D03.1.454.CMB.1.raw
tcagacagtatatacacgaccggtgctcgatttagctgcgtcacgatctctcgttgggggggagacgagcccagcactggaagtcgccggtgtttccattcggtgatcatcactgaacacagaggactcaccatggactttgggctgagagttgggtttcctcgttgcttacttttaaggagggtggcctaggtgtcaggtgcagctaaggtggagtcggtgggggagacggccggcccaggccgtacgggaaccttcccgtaggacgtaccgttcctccgtggtacgccgaacgtccctcgtagggtcttacctacttccgttacggaacggtaccctataccggacctagtaccggaccgtaccgggttccgggggtaccccgaccggtaccgggtcctacccggaaggggtaccgaacggggggtccgtggggtaggggttacgggggtacggtaaccgtaaattttaaacgtacgtacggaaaaggtaaacggtaagggtaacggttaaaaggtttacgggaaaaaccgtaaaacccgggtaacggttaaccgggtaaacgtaacccgtaaccggggaaacggggtaaccggggacccgttaaacgttacccgtacccggttactacccggaaaggtaaccggtaaaccgtaaccgttaaccggaaccgggaaaccctaccgtaaccgtaggaaccctacggttaccctaaggtaacccttaaagtacccgttaaacccgtaacctaccggtaaacggtaaagggtacgggaaaccggtaccgtaccgggtcgttaacggtttattaacggtttacggttcggtaacggccggtaaccgggttacccccggaccccggtttaaccgggaccgggttacccccggtaccccgg

SEQ ID NO: 291823 - DNA, 791 bp, Homo sapiens
  misc_feature: GYAE6OF02IWDAU.44.36.D03.1.454.CMB.1.raw
  modified_base (225)..(225): a, c, t, g, unknown or other
  misc_feature (225)..(225): n is a, c, g, or t
  modified_base (259)..(259): a, c, t, g, unknown or other
  misc_feature (259)..(259): n is a, c, g, or t
tcagacagtatatacacgaccggtgctcgatttagctgcgtcacgatctctcgttggggggagacgagcccagcacgtggaagtccgccggtgtttccattcggtgatcatcactgaacacgagaggacctacaccagtggtacctttgggctagagtagtttcgggttttcctcggttgtcctttagttttaaaggacggtcggacctagttcggtcgtaggtncgagtacgttaggtcggtacggtcggtagggggngacgccgggccaggccgtacggtaacctccgtagacgtacctctcgtgcgtacacgtctcgtaggtacttcacttaccgttgaacggtacctagtccgtacgactcggtaccgtaccggtccggtcccgcgtaaccggtccgtaccggacgaccggggtaaggtcgtacgggtagggttcggtaacgtacctaagttaagtacgtaaccgaagtaaccggagttagtaaaacgttagaaacgaacgtaacggtaacgaacggaccgtaaggaaccggtaaacggtccgtaacggttaacccaccggttaacgtaccgtaaagggtaacgtaaacgtaccgaaaccggtaaaccgaccgttaaccgaacgttacaaccggttactacgttaccggaaacttaacggtaaccctaacccggtaatacccggtaaaagtaccgtagtaaacccgacgtaaccgtcgttaagtaactttacgttaagttccgaaggttacgaccgtccgtacccggtactaccgggaacccgttcg

SEQ ID NO: 291824 - DNA, 750 bp, Homo sapiens
  misc_feature: GYAE6OF02H8Q7V.44.36.D03.1.454.CMB.1.raw
  modified_base (196)..(196): a, c, t, g, unknown or other
  misc_feature (196)..(196): n is a, c, g, or t
  modified_base (217)..(217): a, c, t, g, unknown or other
  misc_feature (217)..(217): n is a, c, g, or t
  modified_base (339)..(339): a, c, t, g, unknown or other
  misc_feature (339)..(339): n is a, c, g, or t
  modified_base (477)..(477): a, c, t, g, unknown or other
  misc_feature (477)..(477): n is a, c, g, or t
tcagacagtatatacacgaccggtgctcgatttagctgcgtcacgatctctcttggggagctctgagagcggagccccacgcccagaacttccaggtgtttcatttggtgatcagcactgaacacagagactcaccatggacgttcgggctgagcgtgggtttcttgtattagttacaggtgtcagagtgaatcgngtagtggtgaggtccgggganacgttggtaccagccgttagggacgggttcccaggacgtactccgtccgtgtcgccggtcgtactagggtcttaccacgtatcaggttacaacaccttaagagtcggaaccgtttcgggccnccgtaagccgtccgaagggggtaaggtccagggtaccttggccgttggaccggactaaaagttaaaaaaacacgttcggacctaagggtactttaggactaaccggtaaggtaacgtcccggaacgccggttttaaanacggttaacaaaccggtacgtaacgtaaccgtacctacccgtacacgtaaggtaacggtcgtaacgtacttaaacgaaccgttaaactaccgagtttaacgaaccgtttacggaaccgtaacgtacctaaacgtaaaccgttaaaccggtaaacgtaaaaaccgggaaggtaaccccggtaacgggaacttacggtaagtttaagttattaaccggttaggtttaacggtttagtttaactacgttaacggtaacgttacccgtagtacccgg

SEQ ID NO: 291825 - DNA, 869 bp, Homo sapiens
  misc_feature: GYAE6OF02GXQKK.44.36.D03.1.454.CMB.1.raw
  modified_base (779)..(779): a, c, t, g, unknown or other
  misc_feature (779)..(779): n is a, c, g, or t
tcagacagtatatacacgaccggtgctcgatttagctgcgtcacgatctctcttggggagctctgcttcagctgtgagcgcagaaggcaggactcgggacaatcttcatcatgacctgcctcccctctcctcctccacccttctctacttcactgaccacgacgggttcctcgggccctagtctgtgttcgaccgcacgcccgcctcagtgtccgtcggccggggcccccggggtcacggtacgggtaccaacccgtacttccttaccgtcgaccgacggtgggacgacgtaggaactacccaacgacggtccggggaacacgttacgtttccggtagtacgtccgttaccctacggttaaccgggttaaccctaaacccctacccgttacccggaaacggtaaccccgaaccccggtaacccccctaaacttcccttaaccgttacgtttaccggtttaaacggtaaacctaaccgttaaccggttccccggtacccgttaccgggtaacccggggtttccccgttaaccggacccgtttacgtttacccttaccggttaaccggtacccgtttaaccgtacgggtttacccggccggtaccctacccgttaccggtacccgtacccgttcccggtacgggcccttaacgtaccccgtcggttaccggtacccgtcggtaccggtacgtaaggtaacggtacggttacggggtagggtttaaccgttagtttaccggtttaacgtaccgtaacggtttcgtaaccgtagtacggtacncgtaccggtcggtaccttaggggttaccgggttgggtttcgggtacgggttcgggtaccgggaacggtacccggtacggtccgtaccggg

SEQ ID NO: 291826 - DNA, 638 bp, Homo sapiens
  misc_feature: GYAE6OF02HCN12.44.36.D03.1.454.CMB.1.raw
  modified_base (319)..(319): a, c, t, g, unknown or other
  misc_feature (319)..(319): n is a, c, g, or t
  modified_base (504)..(504): a, c, t, g, unknown or other
  misc_feature (504)..(504): n is a, c, g, or t
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgttgggttttccttgttgtttatttacaggtgtccagagtgaagtgactagttgggtggaggtccgggggatacgttggtccagcctgggacggtccctgagtactctccgtgtcgtcgctctggacttcaccatcagtgaccactatagtggactgggtccncgacggctccgaggggacgggcgtggaggttggcgttggccgacgaaacgtaaaaacgtagttcgacctagtacttttagaccgaacgagtagtaccgccgtcgttactaggtacgaacgtccgtaagactttacccgacctctacgaaggatagttacacttacaacgtaacctctagttacgnttacgtagaacgtaatacgttaacctaacgacggaaaaccgtacggaccgtacgtacgtgtaagtttacgttagttaggtttcgttagtttagtttaacgtacgttacggaacggttaccgttcggtaacccgg

SEQ ID NO: 291827 - DNA, 614 bp, Homo sapiens
  misc_feature: GYAE6OF02JHX7F.44.36.D03.1.454.CMB.1.raw
  modified_base (163)..(163): a, c, t, g, unknown or other
  misc_feature (163)..(163): n is a, c, g, or t
  modified_base (178)..(178): a, c, t, g, unknown or other
  misc_feature (178)..(178): n is a, c, g, or t
  modified_base (266)..(266): a, c, t, g, unknown or other
  misc_feature (266)..(266): n is a, c, g, or t
  modified_base (459)..(459): a, c, t, g, unknown or other
  misc_feature (459)..(459): n is a, c, g, or t
  modified_base (496)..(496): a, c, t, g, unknown or other
  misc_feature (496)..(496): n is a, c, g, or t
  modified_base (567)..(567): a, c, t, g, unknown or other
  misc_feature (567)..(567): n is a, c, g, or t
tcagacagtatatacacgaccggtgctcgatttagctgcgtcacgatctctcttggggatcacataacaaccacactcctcctctaaagaagcccctgggagcacagctcatcaccatggactggacctggcggttcctctttgtggtggcaggcagctacgnggtgtccgagtcccnggtagcgagcgtggtcgcgagtcgtaggggcttggaggtgaagaagccgtgggtcctcggggtgaacggtctcgtgcagtcttgcggngctaccttctcgagtctagtgttctttagttggtgtcgacgacggtcccgtagacgtagggtccttggaggtggtcgtggggacgggtactaccgtacgtacccgttacgttgtttacgggtcggtacctagtaacgtaagttaccgacacgttaacggtaagttcagggactagaacgtcacgagttcccgnggtaccagtcacgtacactcgactacgacgtaggacngtgaacggtccggaagtccggagtagacgttccgagaaacgcgaccgttaatccgtacgtatttcggtacncggtacgacgttaaccggtccgtattacgtactaggcttacggtccc

SEQ ID NO: 291828 - DNA, 632 bp, Homo sapiens
  misc_feature: GYAE6OF02I3E52.44.36.D03.1.454.CMB.1.raw
  modified_base (419)..(419): a, c, t, g, unknown or other
  misc_feature (419)..(419): n is a, c, g, or t
tcagacagtatatacacgaccggtgctcgatttagctgcgtcacgatctctcttgggggactcctgtgcccaccatggacactctttgctacacactcctgctgctgaccacccttcctgggtcttgtcccaggtcaccttgaaggagtctggtcctgtgctggtgaaacccacagagaccctcacgctgacctgcacatctctgggttctctctcacgatatagaatgggtgtgagctggactccgtcaccgccccgagggacgcccgtggaggtgcttgcacgactatcttctacgatacgaaacgtaaaactcctaactacgtacagtactgtagaagaggactaacgttaactacttcctaccgaacggacctacctaacgaaaacggcgtacggttacggttactttacgtaanacgaaacctaactaagtccggaccctggtaccgactacggacgacaaccttaagtacgttactgtacgacgtaacgggtaagtcgggaaacgggtaaacaacggtgtaaccggttgtttacctgttaagttaactacgtacttaccgtagtcgtaggtaccgtggtaacggggacgtaaacgggtccaaccggttacaccggttctccctacg

SEQ ID NO: 291829 - DNA, 697 bp, Homo sapiens
  misc_feature: GYAE6OF02IFPTU.44.36.D03.1.454.CMB.1.raw
  modified_base (264)..(264): a, c, t, g, unknown or other
  misc_feature (264)..(264): n is a, c, g, or t
  modified_base (284)..(284): a, c, t, g, unknown or other
  misc_feature (284)..(284): n is a, c, g, or t
  modified_base (564)..(564): a, c, t, g, unknown or other
  misc_feature (564)..(564): n is a, c, g, or t
tcagacagtatatacacgaccggtgctcgatttagctgcgtcacgatctctcttggggatcacataacaaccacactcctcctctaaaagaacgcccctgggagcacagctcatcaccatggactggactggcggttccttctttgtggtggcagcagctacaggtgtccacgtcccaggtgcagtcgtggtgcagttcggtgggtctggaggtagaacgtagccgtgggtccgtggtagaaggtcctacctgcaggtcttcgnggacggtctaccgtttctcngtcttagtgttacgtttttagtttggtcgaccgtacgtaccggtccccgttaggaacgacggtctttggacggttggcggtagggacggtatccgtaccttccgttactttcgttaggtcgtacgtagtacgtaacttcgacaacttaaggttacgtttacgagggtaactaggtactaccgtaaaccgtaccgtttaaccggacggaacgtaaaccgacgaacggtacgtacgaccgtacctaagtagacggtactagaggctaggagaccgtaggtanacgttacgaacggaaacacgtaccgtactacgtttacgttacgtttcggtaaccgttcggtaacgtaaccgtcccgtttaacccggtaccgtttaaccgtttaactttaacccggtagtttaccccttacccg

SEQ ID NO: 291830 - DNA, 647 bp, Homo sapiens
  misc_feature: GYAE6OF02IP3BS.44.36.D03.1.454.CMB.1.raw
  modified_base (273)..(273): a, c, t, g, unknown or other
  misc_feature (273)..(273): n is a, c, g, or t
  modified_base (397)..(397): a, c, t, g, unknown or other
  misc_feature (397)..(397): n is a, c, g, or t
  modified_base (417)..(417): a, c, t, g, unknown or other
  misc_feature (417)..(417): n is a, c, g, or t
  modified_base (431)..(431): a, c, t, g, unknown or other
  misc_feature (431)..(431): n is a, c, g, or t
tcagacagtatatacacgaccggtgctcgatttagctgcgtcacgatctctcttggggagctctgagagcggagccccagcccccagaattcccaggtgtttcatttggtgatcagcactgaacacagaggactcaccatggagttcgggctgagctgggttttccttgttgttatttacaaggtgtccagagtgaagtgcagttggtggaggtccgggggagacttggtccagcctggagggtccctgagactctcctgtgtcgcctctggnttcacctatcagtcgacctactaactatcggacgttggggtcccgaccagggcctccgaggggaacggggctgggagtggcgttggccgacaaacgtaaaaacgaagttcgaccagtactttanacaagacgaagtaccgccgngtctagtagaaacnccaagacttccaccctcacaaggagtactgtaaccttacaacgtactcctaagttcgactttcgtagactaactacgtaccttaaaaccacggaaaaacccgtagggaaccctaccggggtacaaggttacggttaacgttttaggtttcggttggttttagttacgtttttaagttacgttaaccggtaacgggttaacccgttcggtaaccccg

SEQ ID NO: 291831 - DNA, 780 bp, Homo sapiens
  misc_feature: GYAE6OF02IJ7CB.44.36.D03.1.454.CMB.1.raw
tcagacagtatatacacgaccggtgctcgatttagctgcgtcacgatctctcttggggagctctgagagcggagccccagccccagaacttcccaggtgttttcatttggtgatcagcactgaacacagaggactcaccatggagttcggctgagcgttgggttttccttgtttgttattttacaaggtcgtcagtagtgaagtgctaggttggtggaggtccgggggatacgttggtccagtccgtaggggacggtccctaggacgacttcctccgttggtcggttccggccttcgttaggtacttacaccgtactcgtaggtacgaaccctaacttaattacgtcgggtaaccggttccggggttacccgccggacgggtacccgtccgggaacggggggtaaacgggggtcgtacggggtagggtacgggtccggttcgggaccggaacgtaaaacggtaaaaaaacgtaacggttcggaccgttaaggtaccttttaaactaccgaaacggtaacggtaacggtacccggaccgggtcggttacgtacggtacggtaaaacggaccctaagtaacttaccctaacccgtactacggtaaacgacgtacgttacgtaaccgttacaaaacgtactacgtattacgtacttacgtacgtaacgtaacgtacgtaaacctaaccgtaaacggaaaccgtaacggacgacggtatacgtattaacgttgttagtaggtttagttagttacgttacgtacgtaacggttcctagtacccgg

SEQ ID NO: 291832 - DNA, 631 bp, Homo sapiens
  misc_feature: GYAE6OF02GXLQ6.44.36.D03.1.454.CMB.1.raw
  modified_base (222)..(222): a, c, t, g, unknown or other
  misc_feature (222)..(222): n is a, c, g, or t
  modified_base (314)..(314): a, c, t, g, unknown or other
  misc_feature (314)..(314): n is a, c, g, or t
tcagacagtatatacacgaccggtgctcgatttagctgcgtcacgatcgtctcttgggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtgagtctgggggagattggnacgaggccgtgggggtccctggacgactctcctgtcgcagcctcgtcggccttcccctttaaggcgtctatcggccatcgaccgtgggtccncgaggcctccggaggggagggcgtcggaggttgggtcctcgaacctagttcggcggacgtagtcgcaacgtgaacgacacgtaacgtaccgggagtaccggtaccggtaggaccggggccgtaccttccgaccacgtcctaccgaagacgaactaacgtaccgaaactccttacttttcagtaagacgaactagactagagacgttacgaacgacgtaccgttccttttattcgtagtcgaacggaaggggagggggggtactagggactccgagtagggttggggttcgggttggttacgtaccgtcggtacgggg

SEQ ID NO: 291833 - DNA, 741 bp, Homo sapiens
  misc_feature: GYAE6OF02GKE3Y.44.36.D03.1.454.CMB.1.raw
  modified_base (309)..(309): a, c, t, g, unknown or other
  misc_feature (309)..(309): n is a, c, g, or t
tcagacagtatatacacgaccggtgctcgatttagctgcgtcacgatctctcttggggggagacgagcccagcactggaagtcgccggtgtttccattcggtgatcatcactgaacacagaggactcaccatggactttgggctgagatgggttttcctcgttgctcttttaagaggtggccagtgtcaggtgcagctaggtggagtcgtgggggaggagcggcccagccgtgggaacctccgtgagactctcctgtgcagcctcgtggattcatcttcaggacctatcgccatgcacgtggggtcccncgcggcctcgagggaccgaaggggtcctagggagttggggtgacgtaattatatcgaagtaacggtatagggtaattaggaaagtaaaccgtaacgttaaaccgggactaacccggtacccggaaaggtaacggggaccggtaacgttacccgtaacccggtacctaccgaacggaaccgtaaccgtaaacgtttacccggaaacggaaaccaaccgtaaccgtcggacctacttaccgtagtaaccgtaaacttaacgtaaaccgtaaaccctaccgaaacgtaaacgtacgggaaccggtaaccgaccggttaccgttaacggttaccgttttaacgttaaggttttacggttaccggaacggttaccgggtaaccccgggttacccccccgttacgggtaacccgggttaccccgggttaaccccccgg

SEQ ID NO: 291834 - DNA, 769 bp, Homo sapiens
  misc_feature: GYAE6OF02H3QVO.44.36.D03.1.454.CMB.1.raw
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgtgggttttccttgttagttatttaaaaggtcgtcctagtggtgacggtgcaggtgagtggtaagttggggacgtctaggttcgggcccggggggccctaaggactctccgtgtcgtcgtctctacgaaccccgtacctttaacgcagcctagtcggattggacctacggtcgggtacccgacctaagccttacccggaaggtaaaaccggtccgtaaggcgtcggttgggtactccgtaacggttaacttaaccgacggtaatcgggtaacgtactcctaacggttacgttaccgtacggaacgtaacccggttacgtacgggaaccgggccgttaagtttccacgtacctctaccgtccgaacgtacgtacgtaagtacgtaacgtaaacgtacggtaattaaacgtttacaaaacgtactaacgtaacgtaacgtaacgtaggtaacgacgggtaaccgacgtacgtagttccgttaacgtttagttaggttacgttacggaattacccgttaagttaccgttaacggttttctacggggtttaacgggttacgggtttacggtttccggtttacccggggtccccgttaccgtacgggttaacccgggg

SEQ ID NO: 291835 - DNA, 678 bp, Homo sapiens
  misc_feature: GYAE6OF02GMYDB.44.36.D03.1.454.CMB.1.raw
  modified_base (176)..(176): a, c, t, g, unknown or other
  misc_feature (176)..(176): n is a, c, g, or t
  modified_base (265)..(265): a, c, t, g, unknown or other
  misc_feature (265)..(265): n is a, c, g, or t
  modified_base (309)..(309): a, c, t, g, unknown or other
  misc_feature (309)..(309): n is a, c, g, or t
  modified_base (354)..(354): a, c, t, g, unknown or other
  misc_feature (354)..(354): n is a, c, g, or t
tcagacagtatatacacgaccggtgctcgatttagctgcgtcacgatctctcttgggggggagacgagcccagcactggaagtcgccggtgtttccattcggtgatcatcactgaacacagaggactcaccatggactttgggctgagatgggttttcctcgttgctcttttaagnggtggccagtgtcaggtgcagctagtggagtcgtgggggagagcggcccagcctgggaacctcccgtgagacctctcctgtgcagcctntggattcgatctcaggacctatcgccatcgcacgtcgggtaccncacggctccgaggcgaaggggctgggaggtgggtggactaaattntatcgaagtaagagttgggaaatttaggaaacgaaacgaccgttaaacggggaacgtaccgtacccgggaaaggaaacggggtacccgtaagtttacccgaacccggttcctacccgaaggtaaccgaactaaacgttacccgaaagggtaaccaacgtaacgtcgaactacgtcgtaacgtaacgtaaattaccgttaaccaaacccttacgaaactaaacggttacggaacgggacaccgggtactaggttacttaagttaacgttcgtagacggtaacgacccggtacccccgtacggaccggtaccccggttacccccgg

SEQ ID NO: 291836 - DNA, 675 bp, Homo sapiens
  misc_feature: GYAE6OF02HJX7A.44.36.D03.1.454.CMB.1.raw
  modified_base (187)..(187): a, c, t, g, unknown or other
  misc_feature (187)..(187): n is a, c, g, or t
  modified_base (417)..(417): a, c, t, g, unknown or other
  misc_feature (417)..(417): n is a, c, g, or t
  modified_base (422)..(422): a, c, t, g, unknown or other
  misc_feature (422)..(422): n is a, c, g, or t
  modified_base (446)..(446): a, c, t, g, unknown or other
  misc_feature (446)..(446): n is a, c, g, or t
  modified_base (567)..(567): a, c, t, g, unknown or other
  misc_feature (567)..(567): n is a, c, g, or t
tcagacagtatatacacgaccggtgctcgatttagctgcgtcacgatctctcttggggagctctgagagcggagccccagccccagaacttcccagggtgttttcatttggtgatcagcactgaacacagaggactcaccatggagttcggctgagcttgggttttcctgttgttatttacaaggtntccagagtgaagtgcaggttggtggaggtccgggggatacttggtccaggtcctagggacgggtcctggacgaccttctccgtgtcgtcgcctcgtggattcacctatcagtcgacccactatagtcgggacttcggggcccgtccgacggccgtccggaagggggaacggggtctgggagttcggcttgggccacaaacggtaaaaactaaggttcgccagtactttanctaanagacgtacgcgtcgtctgagaacncagtactccactctacgaagacgtatacggtaacctcgaaacgtacctacgtatttaaccggtctttacggacgtacgttaacgtaaccgtaacccgttaaaccgtaaacggaaaacccgngtaaccgggaccggtactaaggtttcgttaacggttaattttcgggttaagtttaggttttactttaacgttacgttaccggtaaagggttaccttaccggtaccggg

SEQ ID NO: 291837 - DNA, 645 bp, Homo sapiens
  misc_feature: GYAE6OF02GYLDE.44.36.D03.1.454.CMB.1.raw
  modified_base (313)..(313): a, c, t, g, unknown or other
  misc_feature (313)..(313): n is a, c, g, or t
tcagacagtatatacacgaccggtgctcgatttagctgcgtcacgatctctcttgggggggagacgagcccagcactggaagtcgccggtgtttccattcggtgatcatcactgaacacagaggactcaccatggactttgggctgagattgggttttcctcgttgctcttttaagaggtggccagtgtcaggtgcagctagtggagtcgtgggggagagcggtcccagcctagggaacctcccgtgacgctcgtcctgtgcagcctcgtggattcagtcttcaggacctatcgccatcgcacgtgggtcccncaggctccgaggcaagggctgggtaggtgggtcggacaatttagatacaagtaagactagggtaacttaggaaacgaacgtacgttaacgggaagtaaccgtacccgggaaaggtaacgggacccgtaagttcccgtaccgtccgtaccgaaggaacgaacctaaacgttcccgaagggaaacccaacgactacggactacgtctacgaccaaatacgtaactaaccgtacaacgaaacgtcgaacgtacgaccggtacgtcggttaccttagttacgttaggtccgtacggtacgtacgtaccccctacggacccgtaccggttcccccgg

SEQ ID NO: 291838 - DNA, 616 bp, Homo sapiens
  misc_feature: GYAE6OF02JLMRJ.44.36.D03.1.454.CMB.1.raw
  modified_base (126)..(126): a, c, t, g, unknown or other
  misc_feature (126)..(126): n is a, c, g, or t
  modified_base (166)..(166): a, c, t, g, unknown or other
  misc_feature (166)..(166): n is a, c, g, or t
  modified_base (186)..(186): a, c, t, g, unknown or other
  misc_feature (186)..(186): n is a, c, g, or t
  modified_base (215)..(215): a, c, t, g, unknown or other
  misc_feature (215)..(215): n is a, c, g, or t
  modified_base (238)..(238): a, c, t, g, unknown or other
  misc_feature (238)..(238): n is a, c, g, or t
  modified_base (264)..(264): a, c, t, g, unknown or other
  misc_feature (264)..(264): n is a, c, g, or t
  modified_base (420)..(420): a, c, t, g, unknown or other
  misc_feature (420)..(420): n is a, c, g, or t
  modified_base (476)..(476): a, c, t, g, unknown or other
  misc_feature (476)..(476): n is a, c, g, or t
  modified_base (489)..(489): a, c, t, g, unknown or other
  misc_feature (489)..(489): n is a, c, g, or t
  modified_base (592)..(592): a, c, t, g, unknown or other
  misc_feature (592)..(592): n is a, c, g, or t
tcagacagtatatacacgaccggtgctcgatttagctgcgtcacgagtctctctggggcagagctcgtggggaggaactgctcagtaggacccagacggaaccatggaacgcccagcgcagcttcncttcctctgcttactctggcctccagactaccactggaanaaatgtcatgacgcgtctcncgccacctgtctgcgtcctcgagggaaancgtccaccgtctccgtaggccgngggtccaggttcagtcgttaggtacntagacctaacgttacgccctacgtacagacctaagaactcgtcgggaccaggtcctaccgtacgtcctccgtactactactacggtggacctacgactaccggaccgacggtctacggttcggactccgaggtccgtaagttccggagtaccgggntacgggttcgggtcgaacggacgtaacgtcgtaacgtcctacgacacgtatcgacncgacgtctcgacncgtagagtacgttattcgtactagtttacgttactcgtcgagtactaagttagtacgtacgtaccgtacgtcccgttacgcggtaaccgacgtacgacggtancggttaacgtacgttacgctacgg

SEQ ID NO: 291839 - DNA, 547 bp, Homo sapiens
  misc_feature: GYAE6OF02F8EME.44.36.D03.1.454.CMB.1.raw
  modified_base (102)..(102): a, c, t, g, unknown or other
  misc_feature (102)..(102): n is a, c, g, or t
  modified_base (266)..(266): a, c, t, g, unknown or other
  misc_feature (266)..(266): n is a, c, g, or t
  modified_base (333)..(333): a, c, t, g, unknown or other
  misc_feature (333)..(333): n is a, c, g, or t
  modified_base (352)..(352): a, c, t, g, unknown or other
  misc_feature (352)..(352): n is a, c, g, or t
  modified_base (369)..(369): a, c, t, g, unknown or other
  misc_feature (369)..(369): n is a, c, g, or t
  modified_base (502)..(502): a, c, t, g, unknown or other
  misc_feature (502)..(502): n is a, c, g, or t
tcagacagtatatacacgaccggtgctcgatttagctgcgtcacgatctctcttggggatcacataacaaccacactcctcctctaaagaagcccctgggancacagctcatcaccatggactggaccctggcggttcctctttgtggtggcagcagctacaggtgtccagtcccaggtgcagctggtgcagtctggggctgaggtgaagagccgtgggtcctcgggtgaaggtctccgtgcaagggcttcgtggaggctaccttntcagtctatgtctttttagttgggtgcgacacggccctggacaagggcttgagtggcgtgggaggtntcagtccctagttcttggngcagtcgaattcgcaanagtaacgttcagacagatcaacgtactaccgaggaaccaatcccgaagagtacacgacctacgagtggagctggagcgaggtctaggaagtattcgaacgaaacgaccgacgggcctagttcttaagtttcgnggtacgcgagtccgtccctcgtactacgttaccagttccgtcccc

SEQ ID NO: 291840 - DNA, 860 bp, Homo sapiens
  misc_feature: GYAE6OF02FJZM0.44.36.D03.1.454.CMB.1.raw
  modified_base (159)..(159): a, c, t, g, unknown or other
  misc_feature (159)..(159): n is a, c, g, or t
tcagacagtatatacacgaccggtgctcgatttagctgcgtcacgatctctcttggggggagacgagcccagcactggaagtcgccggtgtttccattcggtgatcatcactgaacacagaggactcaccatggactttgggctgagatgggttttccncgttgctcttttaagaggtggcctagtgtcaggtgcagctagtggacgtcgtgggggacgagccggcccagccgtgggaacctcccgtaggacgaccttcctaccgtgtacggcctacggcccttcgtaggcttcgactttccttacgacggtacccttagtcgaccctaagttcgacgtaccgttcgggggtaccctacccggtaacggtccttacccgggtaacgggaaccggtaaacggggggtccttacggggggtaacgggttcggggggttacggaaccgtttaaaacgttttaacggtaacgttaccggaaaagggtaaaaccggttaacggttaaggggtaaacggttttaacggaaaacgtaaacccgtaaacccggggttaaaccgggaaccgtaaccccggtacccgggtaaacgggtaacccgggggtacctaacccggttttacccgaaccccgggttccctaaccggaacgtaaccgtaaacccgtaaacctttaacccggaacgggaacccttaaccgaccgttaccgccgaaacgttctaaacgggtacctaaaacgtacgtaaaccctaaccttaaccaacggtaacggtacaacgggacccaaggtccgtaacgtacttaacggttacgttggacggtacggaccgtaccccggtccctacgggaccgtacccgggttccccg

SEQ ID NO: 291841 - DNA, 782 bp, Homo sapiens
  misc_feature: GYAE6OF02HBHGD.44.36.D03.1.454.CMB.1.raw
  modified_base (178)..(178): a, c, t, g, unknown or other
  misc_feature (178)..(178): n is a, c, g, or t
tcagacagtatatacacgaccggtgctcgatttagctgcgtcacgatctctcgttgggggggagacgagcccagcactggaagtcgccggtgtttccattcggtgatcatcactgaacacagaggactcaccatggactttgggctgagattgggttttcctgttgcttctttaaggnggtggccaggtgtcaggtgcagctaggtggagtcggtggggggagagccggcccaggccgtagggaacctcccgtgacgtcctccgtccgtgtgaccacggtccttcgtggtactttcacgttccttacgaggtaccctatcgacctatcgacctaccggtcgggtcccgaccgacggtcctacccggaagggtaccggaagggggtccgtagggggtagggtcgggggtacggaaccttaaagttacgtagtaacgaaagggttaagcggttaaggtaaactaggaaaacgtaacccgtaacggtaacgggacgtaccgtaaccggaagggaaccgggtaccgtaacgttcccggtaacccgtaccgtaacccgaagggtaaccgtaaaccttaccggttaacccggaaacgggtaaccctaaccgtacgttagacccgttaacgtcccggtaataacccggtaattaccgtaacccttaaccgtacccgaaaggtaacgtacggaaccggacctacgggtcctaggttaccttacgttagttacggtcggaccggtaccaccccggtccccggtaacggtaccggtacccccgttacccggg

SEQ ID NO: 291842 - DNA, 671 bp, Homo sapiens
  misc_feature: GYAE6OF02FFMI1.44.36.D03.1.454.CMB.1.raw
  modified_base (132)..(132): a, c, t, g, unknown or other
  misc_feature (132)..(132): n is a, c, g, or t
  modified_base (172)..(172): a, c, t, g, unknown or other
  misc_feature (172)..(172): n is a, c, g, or t
  modified_base (184)..(184): a, c, t, g, unknown or other
  misc_feature (184)..(184): n is a, c, g, or t
  modified_base (218)..(218): a, c, t, g, unknown or other
  misc_feature (218)..(218): n is a, c, g, or t
  modified_base (237)..(237): a, c, t, g, unknown or other
  misc_feature (237)..(237): n is a, c, g, or t
  modified_base (338)..(338): a, c, t, g, unknown or other
  misc_feature (338)..(338): n is a, c, g, or t
  modified_base (487)..(487): a, c, t, g, unknown or other
  misc_feature (487)..(487): n is a, c, g, or t
tcagacagtatatacacgaccggtgctcgatttagctgcgtcacgatctctcttggggcagagctctggggaggaactgctcagttaggacccagacggaaccatggaagccccagcgcagcttctcttccncctgctactctggcctcccagactaccactggataaatgngatgacgcgtcnccagcccacctgtctgtcgtcaccgaggggaaancgccaccctctcctgacgnggccctagtctaggtatagttagcgtagacttaatcggtccctcgtaacagctaagactcgaggccacggcctaccgcgtcctactcgatacgtgtacggngtacctacctccgaaccggtcggaccctcggttacgtaacctcccgaacggtcccgtaggtacgagttcgggacgttaggggtccggttacggagggtacgtagtcgttacctacctacgtacacccgtacgtacgacgtctaaccggntcgaccgtagtaccgttagtaaccgtttgttacgtctttaaagtttacgttcgttaggtaccttagtaacgttactaacgttaagtccgtaaccggtccggttacccccggttccgtaacccggaacggtaaccggtaacgaccggtggtaaacggaacgtaacgttaaagggtccttaacggg

SEQ ID NO: 291843 - DNA, 689 bp, Homo sapiens
  misc_feature: GYAE6OF02GQYS9.44.36.D03.1.454.CMB.1.raw
  modified_base (63)..(63): a, c, t, g, unknown or other
  misc_feature (63)..(63): n is a, c, g, or t
  modified_base (161)..(161): a, c, t, g, unknown or other
  misc_feature (161)..(161): n is a, c, g, or t
  modified_base (195)..(195): a, c, t, g, unknown or other
  misc_feature (195)..(195): n is a, c, g, or t
  modified_base (305)..(305): a, c, t, g, unknown or other
  misc_feature (305)..(305): n is a, c, g, or t
  modified_base (559)..(559): a, c, t, g, unknown or other
  misc_feature (559)..(559): n is a, c, g, or t
  modified_base (573)..(573): a, c, t, g, unknown or other
  misc_feature (573)..(573): n is a, c, g, or t
tcagacagtatatacacgaccggtgctcgatttagctgcgtcacgatctctcttggggggganacgagcccagcactggaagtcgccggtgtttccattcggtgatcatcactgaacacagaggactcaccatggactttgggctgagattgggttttccncgttgcttactttaagaggtgccagtgtcaggtncagctaggtggagtcgtgggggagacgccggcccagccgtagggaacctcccgtgacgtactcctccgtgtcgcacggcctgtaggacttcattccttacgaggtacctntcgaccctagtcggacctaccggttcggggtcccgacgacgggtccttaccggagggaccggaacgggggtcttagggggtagggttcggggacgtactaaagtttacgtacgtacgaaagggaaacgtagttacgggtaaattagggaaacaaccgtaacggtacgggaactaccggtacggaacggtacgggaccgtagttacccgaccgtactacggaagacgtaactaacgtaccgaagaacaccgtacncgtactactacganactaatacgtaccaacctacgaacgtaacgacgaacgaccgacggtactacgtacttacgttaagttcgtacggtcgaccggtaccgaccccgttacggaccggtacccgtcccgg

SEQ ID NO: 291844 - DNA, 768 bp, Homo sapiens
  misc_feature: GYAE6OF02IBDDR.44.36.D03.1.454.CMB.1.raw
  modified_base (283)..(283): a, c, t, g, unknown or other
  misc_feature (283)..(283): n is a, c, g, or t
tcagacagtatatacacgaccggtgctcgatttagctgcgtcacgatctctcgttgggggggagacgacgcccagcactggaagtcgccggtgtttccagttcggtgatcatcactgaacacagaggacctcaccagtggactttgggctgagtagtttcgggttttcctcggtttgctttacgtttttaaggaggtcggacctaggttcggttcgaggtgcaggtcgttaggtggagttcggtgggggagacggccgcccgagccgtacgggaccttcccgngacgctctccgtgacgcaggtcctgtaggtacttcattacttcgaacggtcctactgcccagtccgacgtaccggtccggtcccgacgacggcccttggacggtaccggaaggggtccgtagggggtacggtttgggacgtaacttaattacgttaccagggaaacgttaaaggtacgaagggttaaaccgtaggtaaaaacccacggttaccgtaagggaaccgtaccgtaacggaacggtaacgggaccgtaacgttaccctaccggtccgacgtagacgaactaacgttaccgaacgtaacccgaacaccgtcgactacgtacgtaccgtaataacgtaccttaacccgaccgtaaacgtaacgtaaacgtacggtaacgaccggtacttcgttacgtttaccgtttagtttacggtagtaaccggccggtaccggtaaccccggtcccggtacccggtacccggtcccgggtaacccccgg

SEQ ID NO: 291845 - DNA, 809 bp, Homo sapiens
  misc_feature: GYAE6OF02IC5VP.44.36.D03.1.454.CMB.1.raw
  modified_base (138)..(138): a, c, t, g, unknown or other
  misc_feature (138)..(138): n is a, c, g, or t
  modified_base (462)..(462): a, c, t, g, unknown or other
  misc_feature (462)..(462): n is a, c, g, or t
tcagacagtatatacacgaccggtgctcgatttagctgcgtcacgatctctcttggggatcacataacaaccacactcctcctctaaagacgcccgtgggagcacagctcatcacatggactggacctggcgttcctnttgtggtggcagcagtctacgaggttctccacgtcccgaggtcgcagcgttggtcgcgtaggtcggtgggctggaaggtaggaagtaacggccgttcgggtccgtgggtagtacggttctccgtaggcaggttctcggtggacggtacctccttcgttctacgcttagttcgttacgtttttaggtttcgggtacgacggtaccggtacccggttcccggtacggggtaacggtaacgggtcggttaggtacggggttcgggacgggttagggggacggttacgtaccgttaccgttaccccgttaagtttccgtttacgggtntacgttaaacgtttaaccgtaacgtttaaccgacgtaaacgtaacggtttaacgtttaccggaacgggttacgaacgtacgttaaccgtactaaccggtacccggtaacggaaccgtaacctaaccggacgtaacggtaacctaccggtaccttagacggtcgtaacggtactggaacgtcggtaacggtccggtaggtaactacgttaaccggagtaaaccgggaccgtacggtaccgttaccgtttacgtttacgtttacgtaccgggttacggtaccgtaccggaccggtttacccgtaccggtttaaccgtttaaactttccggtacccttaacccgggtccc

SEQ ID NO: 291846 - DNA, 759 bp, Homo sapiens
  misc_feature: GYAE6OF02G7NYT.44.36.D03.1.454.CMB.1.raw
  modified_base (143)..(143): a, c, t, g, unknown or other
  misc_feature (143)..(143): n is a, c, g, or t
  modified_base (176)..(176): a, c, t, g, unknown or other
  misc_feature (176)..(176): n is a, c, g, or t
  modified_base (185)..(185): a, c, t, g, unknown or other
  misc_feature (185)..(185): n is a, c, g, or t
  modified_base (287)..(287): a, c, t, g, unknown or other
  misc_feature (287)..(287): n is a, c, g, or t
  modified_base (388)..(388): a, c, t, g, unknown or other
  misc_feature (388)..(388): n is a, c, g, or t
  modified_base (563)..(563): a, c, t, g, unknown or other
  misc_feature (563)..(563): n is a, c, g, or t
tcagacagtatatacacgaccggtgctcgatttagctgcgtcacgatctctcttggggatcacataacaaccacactcctcctctaaagaagcccctgggagcacagctcatcaccatggactggactggcgttcctctttgnggtgcagcagctacaggtgtccacgtccaggtncagctggtncagtctgggggctggacggtgaagaggccgtaggggtcctcgggtagaacggtctccgtgcgaaggtctcgtaggaggtcctaccttctacgagtcttagtnttacctttttaggttcgggctacgacgaccgggtcccaggaccggaagggtctggaggtcggtcgtaggggtacgatccgtaacttcctattcgttcggtnactattcgaattccgactaacggtaagttaacgttacgaacgggaacgtaggtccgtaacccgtaaacccgttacggttaaccccgggaaggttaaacccggaaccttaccccggtaaaggtaaaccggtaaacccgtccgtaaacccggttaccttaaaagggtccgggtaacnccttaagggaacggtccgggtaaacgcggttaagggtaacctagtaccgggttaagaaaccggtaacccggtacgtacccgttaacttcccgggttttaaagtttcccgtacgggtcggacccgttaaccggtcccgttccccggtaaacgtttttaccaacccgtttttaggacccttacccggtttaacccccg

SEQ ID NO: 291847 - DNA, 833 bp, Homo sapiens
  misc_feature: GYAE6OF02G7HXG.44.36.D03.1.454.CMB.1.raw
  modified_base (183)..(183): a, c, t, g, unknown or other
  misc_feature (183)..(183): n is a, c, g, or t
tcagacagtatatacacgaccggtgctcgatttagctgcgtcacgatctctcttggggagctctgagagcggagcccagccccagaattcccaggtgtttcatttggtgatcagcactgaacacagaggactcaccatggagttcgggctgagctgggttttcctgttgttatttacaaggtntccagagtgaagtgcagttggtggagtccgggggagacgttggccagcctgggacggtccctgagactctcctgtgtcgcctctggattcaccatccagtcgaccactatagtggactgggtccgccaggcctccgaggggaacgggctgggagtcggacttcgggccgactaaggtaaaaaccgtaaggttcggaccgtaaggtacctttttaaacgtacctaacgaacggtaacggttaccccggtacccgtccgggtttaccgttacgggttaacggaaaaaccggtcccccgtaaagggtaaccttttaccccgaaacccccgtttacccgttaaccggtaaaacgggtaccgtaacggtttacggtaaaccctttttaaccgaaaaacggttaaacccgtttaccgtaaagtttttaccgaaagtttttccccgtagggttaaacccgttaaacgttaaccgggtaaaaccccttttaaaaccccgggtaacggtaaaaaaaccccgggtaggggtaaaccccggaacccggggtactaaacgggtttcgttaaaccgtttttaagggtttgggtttaacggttttacggtttaacgtttttaacgtaacttaccggtaaacgggttactaccggttaaccccgg

SEQ ID NO: 291848 - DNA, 709 bp, Homo sapiens
  misc_feature: GYAE6OF02JAXVV.44.36.D03.1.454.CMB.1.raw
  modified_base (183)..(183): a, c, t, g, unknown or other
  misc_feature (183)..(183): n is a, c, g, or t
  modified_base (534)..(534): a, c, t, g, unknown or other
  misc_feature (534)..(534): n is a, c, g, or t
  modified_base (545)..(545): a, c, t, g, unknown or other
  misc_feature (545)..(545): n is a, c, g, or t
tcagacagtatatacacgaccggtgctcgatttagctgcgtcacgatctctcgttgggggggagacgagcccagcactggaagtcgccggtgtttccattcggtgatcatcactgaacacagaagactcaccatggtactttgggctgagagttcggttttcctcgttgctttcgttttaagnggtggcctagtgtcgaggtgcagtctaggtggagtcgtggggggaagcggccggcctaggccgtagggaaccttcccgagtaacgctctccgtgcgcacgccttcgagtacttcacttctcgaggtacctatcgctacgtcgtcctccgggtcgggtacccgacggtacggtacccgtacggggaaggggggtaacgggtcgttggggttcggtcgggtaccttacggttaacgtttagtaaaggtggtaggtaggtacgggataacgactaagacggtcaccggcgtacgtcggaggaccggtactgtaccccatacgtaccgacgagaaccggacaccgactaaagacncgtatagtacncgtaacaacggtaaatacgtacgttaacgagagggaccgaaccggagggtaaccctacgggacctttagggttaagttaccgggttaattcccgggacgttaaccggaagggttcggtacccgggggtacggggttccgggtaaggggttttaaccgggtgggg

SEQ ID NO: 291849 - DNA, 603 bp, Homo sapiens
  misc_feature: GYAE6OF02HAJ24.44.36.D03.1.454.CMB.1.raw
  modified_base (254)..(254): a, c, t, g, unknown or other
  misc_feature (254)..(254): n is a, c, g, or t
  modified_base (276)..(276): a, c, t, g, unknown or other
  misc_feature (276)..(276): n is a, c, g, or t
  modified_base (317)..(317): a, c, t, g, unknown or other
  misc_feature (317)..(317): n is a, c, g, or t
  modified_base (436)..(436): a, c, t, g, unknown or other
  misc_feature (436)..(436): n is a, c, g, or t
  modified_base (533)..(533): a, c, t, g, unknown or other
  misc_feature (533)..(533): n is a, c, g, or t
  modified_base (581)..(581): a, c, t, g, unknown or other
  misc_feature (581)..(581): n is a, c, g, or t
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtcgttgggttttccttgttgttattttacaaggttgtccagagtgaagtgcagttggtggaggtccgggggagacgttggtccagcctgggacggtccngtagactctcctgtgtcgcctntggattcaccatcagtcgaccatatatcggacgtgggtccncaggctaccggaggggacgggctagggcgtaggcgttcgggccgacaaacggtaaaaactaagttcgaccgtagtacttttaagcgtaacaaggacggtaccgccgtacgtactggtanaaacgtcgaagtacttacgaccctctacgaagagatgaacttacgaagactacgtatcgtaactcgtagcgtaatcgaactaaacgtacgaaaacgngtaacgacggtctaaggttctaattagttcgtagttacgttagtttancgtaactaggtactagtaccgg

SEQ ID NO: 291850 - DNA, 971 bp, Homo sapiens
  misc_feature: GYAE6OF02FJE98.44.36.D03.1.454.CMB.1.raw
tcagacagtatatacacgaccggtgctcgatttagctgcgtcacgagtctctcttggggagctctgagagcggagccccagccccagaattcccaggtgtttcatttggtgatcagcactgaacacagaggactcaccatggacgttcgggcttggagcgttagggttttccttgtttgttattttaacaggttgtccagaggtgaagtgccgtaggttcggtgggacggtccgggggtataccgtttgggcccgtaacggtcccgttaggggtacgggggttcccccttaaggacggtacccttccgttcccggttaggttcgtccggtcccttacgttcggtacgtttaccaaccctaacgttaccgtagttccggtaacccctacttaacggttacgtacggtaaccggttcggggttaccccggcccgtaacgggtccctacccgggaaggggggaacggggtaccggttaggggtaacgggttacgggtccggtttacgggacccgggtaccgttaaaacgggttaaaaaaaccggtaaacggttttacggaacccgttaacggtaccgttttttaacgaacccgttaaaccgtaaacggggtaaccgttaaccgggtccccggtacgttacggtttaaccgggttaacgggtaaaaccggacccggttaacgtaaccgtttaccccgtacccttacggtaaccgaacggtaacgtacgttacgtaaccgtttaacgaaacgtaaccttcctaaggtttgtaacgtttccgtaaggtaacgttaaccgttaccgggttaaaaccttaacccgggtaaacggtaaaaccccgggtaacggacccgggttaacgggacctttaacggttaacggtttaagttaaacgttttcggggtttatttaccgggtttaatttttacggtaaccgtaaccggtttaacggttaacccgttacggtttacccggg

SEQ ID NO: 291851 - DNA, 708 bp, Homo sapiens
  misc_feature: GYAE6OF02G0SBE.44.36.D03.1.454.CMB.1.raw
  modified_base (254)..(254): a, c, t, g, unknown or other
  misc_feature (254)..(254): n is a, c, g, or t
tcagacagtatatacacgaccggtgctcgatttagctgcgtcacgatctctcttgggggggagacgagcccagcactggaagtcgccggtgtttccattcggtgatcatcactgaacacagaggactcaccatggactttgggctgagattgggttttcctcgtttgcttcttttaagaggttcggccaggtgtcaggtgcagctaggtggagtcgtggggggagaggcggcccagccgtggggaacctcccgngacgctctcgtgtcgcacgccttgtaggactttacctaaccctttaacgcgtcttacgtcgcctaagtacgaaccggttcgggtcccgaccgaggtcctaccggtgggggaacggttccggtgggtaggtccggggttactcggtaagggtttacgttaacgtagggggttcggggtatagttacgaacgtactaccgactacgtacgtaccgtacggtaagggaaaccggtccgttaacaccgtacttccgtaccgaagtacaacgtaactaccgaaggacctacttacctactactcttaagacctaagacgaacacgtacgtagacgtacggaccgaggacgacggttcgtaatttacgtacgtacgggtcgaaggtaaacgtaacggtttacgggtaccgtagggttacgggttgttaccggggtttaggggtttacggaaccgttcggg

SEQ ID NO: 291852 - DNA, 731 bp, Homo sapiens
  misc_feature: GYAE6OF02JKNGN.44.36.D03.1.454.CMB.1.raw
  modified_base (256)..(256): a, c, t, g, unknown or other
  misc_feature (256)..(256): n is a, c, g, or t
  modified_base (266)..(266): a, c, t, g, unknown or other
  misc_feature (266)..(266): n is a, c, g, or t
  modified_base (272)..(272): a, c, t, g, unknown or other
  misc_feature (272)..(272): n is a, c, g, or t
  modified_base (276)..(276): a, c, t, g, unknown or other
  misc_feature (276)..(276): n is a, c, g, or t
  modified_base (290)..(290): a, c, t, g, unknown or other
  misc_feature (290)..(290): n is a, c, g, or t
tcagacagtatatacacgaccggtgctcgatttagctgcgtcacgatctctcttggggggagacgagcccagcactggaagtcgccggtgtttccattcggtgatcatcactgaacacagaggactcaccatggactttgggctgagatgggttttcctgttgcttcttttaagaggtggccagtgtcaggtgcagctagtggagtcggtgggggagacgccggccagccgtagggacctccgtgacgctctctgngcacgcctgngattcntctnacggtctatcgacntcgactacggtcggtcccgacgacgccacgacggacgacgggctagggtaggtgggtcgactaagttataacgtacgaacgaaagtacggtaaggtaaattacgggaaaacgtaaccgtaacgggttaaccgggtaactaaccggtaccgggaaacgggtaaaccgggggtaccgttaaccgttacccgtacccggttaaccgtaacccgaagggtaaccgtaaaccgttaaccgttaacccgggaaacgaacccggtaaaccgtaccgtaccggaccttaacgtacctacggtaaactaaacggtacctaaacccgaaccttaccgaaagtaacgacggacgtaccgtaaccgggtacttacgttaccgttaattacggttacggtacggtaccgtacggaccccggttcccgtaaccgggtccgtaccccggttcccgg

SEQ ID NO: 291853 - DNA, 828 bp, Homo sapiens
  misc_feature: GYAE6OF02JUHLA.44.36.D03.1.454.CMB.1.raw
  modified_base (138)..(138): a, c, t, g, unknown or other
  misc_feature (138)..(138): n is a, c, g, or t
tcagacagtatatacacgaccggtgctcgatttagctgcgtcacgatctctcttggggagctctgagagcggagcccagccccagaattcccaggtgttttcatttggtgatcagcactgaacacagaggactcaccngtggagttcgggctgagtcgttgggttttccttgttgttatttacgaaggtcgtccagagtgaagtgcgtaggttgggtggacgggtccgggggatacgtttcgggtaccaggtccgtaggggtaccgggttcccttaggacgtacttccgtccgtggtcggtccgtacctcgtacggtacgttccacctatccgacgtacgtacctacttaactacgtcggacgttcgggtaccccgtccgaacgggtcccgttaaccggacggggggtaaacggggtccgttacggggagttcggggtaccgtttacggggcccggttaacgaaaacgggtttaaaaaaccgtaacggttccggaacccgttacggttacgttttaacgtaccgtaaacgtaacggaccggttaaccgcccgggttacgtacgttaggttaacgaacggtaccgtagtaacttcccgaacccttcgttaacgaaacgtcgttaacggtacgtaccttaacgaaaccgtcttaacgtacgttagtaactttcgaggacgttaaacgttacgtaaacccgtttaaaccgaaaccggtaaaacggtacggtaaccgacgggtaacctacggttaacgtttaattacggttagtttaggttagtttttacgttaattacggttaccgaacgggtttactaccggttaccggg

SEQ ID NO: 291854 - DNA, 812 bp, Homo sapiens
  misc_feature: GYAE6OF02JAQVV.44.36.D03.1.454.CMB.1.raw
tcagacagtatatacacgaccggtgctcgatttagctgcgtcacgatctctcttgggggactcctgtgccccaccatggacactctttgctacacactcctgctgctgaccaccccttcctgggtcttgtcccaggtcaccttgaaggagtctggtcctgtgctggtgaaacccacagacgaccctcacgctgacctgcaccatctcgttggtctctcctcaacgtatattagaacgtgggtgtgagtcgtggacttccgtacaccgcccccgtaaggggaaccggcccgtgggacgtcggcgttaggaccacacctaacttccgttactaccggtaagtacggaaaccgtaaaactccctacgtaagtacctaacttctacgtacggtaagacgtacttaagttaaaccctattacctaccggtaaacgtaccctaaccgtaacccgaaaacggaccgtacgggttacggttacgttttaacggttacgtaccgtaaacccaaccttaagggtaaccggtacccgtaccgggaaccggtaacccgaacgtaacccgggtaccaaacttaaggttaacctttaacggttcgtacgggtaaccgttaaacggggtaaacggttaggaaaccggggtaaaacgtaaaccgtaacggttacggtttaccgggttttaattaaacggtttaaacgttaaagttaaccgtttaccgttaacgttaccggttcgttaaccggggtacccggttagggaccggggttaacggaaacccgggtacggtaccgtaccccgtaaccgtcccttaccgtaccg

SEQ ID NO: 291855 - DNA, 839 bp, Homo sapiens
  misc_feature: GYAE6OF02HIY23.44.36.D03.1.454.CMB.1.raw
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttggttttccttgtttgttatttacaaggtgtaccagagtgaagtgcgtaggttgggtggacggtccgggggagtacgttcggtccagtccgtgggacgggttccctggacgtaccttctccgtgttcggtccgtcctcgtggtacttccgacctatcaggtacgaccctacttagtacgtggaccggtcggggtcccacccgacggtccggtaccggaagggggtaacggggtcgtaggggagggttcgggtccgttcggggacccgtaacgtaaaacgggttaaaaaaacctaagggttaccgaacccggtaagttcgttttaacgtaacccgaacaacggggttaaccggttaacccgcccgggtacggtttacctagggttaaacgggaaaccgtccccgtaagggttaaccttaccccgtaaccccttaggtaacctaaagtacggttactaaccggttaccttaacgaaccgtaacttacgtagtttactacgtttacgacgtaagtacgtacgtaaacccttaaccgtaaacgggaaaacccggtacgaaccggaccggttaacgtaacgtttacggttaacttttaggttaccgggttaggtttttaccggtttaagttttaaccgtaccgtttacgggtaaaccggtttaccggttacccgtaaaccccggggg

SEQ ID NO: 291856 - DNA, 641 bp, Homo sapiens
  misc_feature: GYAE6OF02JE630.44.36.D03.1.454.CMB.1.raw
  modified_base (256)..(256): a, c, t, g, unknown or other
  misc_feature (256)..(256): n is a, c, g, or t
  modified_base (359)..(359): a, c, t, g, unknown or other
  misc_feature (359)..(359): n is a, c, g, or t
tcagacagtatatacacgaccggtgctcgatttagctgcgtcacgatctctcttgggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggaggagcggcccagcctgggaactccctgagacctctcctgngcagcctgtggattcattcttcgaggtacctatcgccagtcgcacgtcgggtcccgccaggcctccgagggcgaaggggctggggagtggggtcgactaattntactacgaagaagtagtaggtaaacttagaaacgtaaccacggtaacgggagtaaccgtaccggaacggaacgggccgtaacgttaccgtacccggtcctaccgaaggaacgtaaccgtaacgttaccgaacggtaaccacctacgtacgaccattccgagtacgtaaactacgtaacccaacctacgaacgaacgtagaacggacgacggtacgttgtaacttagttaattcgtaggaccgtacggacccgtaccccgtacggaccggtcccggtaccccg

SEQ ID NO: 291857 - DNA, 760 bp, Homo sapiens
  misc_feature: GYAE6OF02FUPWM.44.36.D03.1.454.CMB.1.raw
  modified_base (218)..(218): a, c, t, g, unknown or other
  misc_feature (218)..(218): n is a, c, g, or t
tcagacagtatatacacgaccggtgctcgatttagctgcgtcacgatctctcttggggcagagctcgtgggggaggaactgctcagttaggacccagacggaaccatggaagccccagcgcagcttctcttcctctgctactctggctcccagactaccactggagaaatgtgatggacgcggtctccagccacctgtctgtgtcctcgaggggaaancgcccaccctctcctgcgacgggccagtcaggacgttgtagcagactaacgttacgcctacggtaaccacgtacgaagtaaactccggtacggaccgacgggtccctacccccggaggtcccttacctactacgtccgttaagtcgggtacaccgtaacgttccccgaaaccggtaccgggtaccctaacgttacgggttacccttaccccgaacggttcccgttaagggtttaccacggggtttaccggacgtacggggtttcgggttacgtaggggtaaccggtaacggttacggttaccgtaccgtaccgtaccgtaccgtacgtacgtaccgaccgtaccgtaccgtacgacgtacgtacgtacgtaacggttacgtttacgtacgttaacgtttacgttacgttacgtacgtacgtacgtacgttacgtacgtacgtacgtagtcccccccccccccccccccccccgttacgttacccggtaaccggtacggtaaccgtacgtacgtacggtaacgtaacgttaacgtacgtacgg

SEQ ID NO: 291858 - DNA, 946 bp, Homo sapiens
  misc_feature: GYAE6OF02F5WNO.44.36.D03.1.454.CMB.1.raw
tcagacagtatatacacgaccggtgctcgatttagctgcgtcacgatctctcttggggatcacataacaaccacactcctctctaaagaagcccctgggagcacagctcatcaccatggactggacctggcgttcctctttgtggtggcagcagctacgaggtgtccacgtccgaggtgcgacgcgtggtgacacggtcgtcgggggctagggagggtagaaggtaacggtccggttcgggttcccgtcgggtacggtaacggttccgtaccgtacggacgtaacggtccgtttacggtgggacggtcttacccttcttccgaagtccttaagttcgtttctttttaggtttcggggtcgtacccggtaccgaccgggtccccggtacggtaacggtacgggtccggtttagggaggtgggtcggtaggggtaggtactccgtacttcccgttagttcggtttacggtcgtacgttaacgttacggtaacgtttaccgacgtaaacggttaacggttaacggtttaccggaacgggtaaaccggacggtttaccggtaccctaaaaccgtttaccggttaaaccccggggaaacgggtaaaccggttaaacccgaacccgggtaacgtttaaaacccggaacccggtaaccccgtaacggttttaaaccggaacggtttagggggtaccgtaacccgggtttaggaacccgggtacggtaacgggtacccgtaaaggggttacctaacggggtttcggaaaacccggaacggtaaaccccgtcccggggtaaaccctttacgttttacccgtttaacggttttttcggaccgggttaacccggggttaacggtcccggtaaccccgggtttccccgttttaccgggttaaaccccgttttaaacccggtttaccctttaaaccccgggttaaccttttccccccgg

SEQ ID NO: 291859 - DNA, 661 bp, Homo sapiens
  misc_feature: GYAE6OF02GZ5W1.44.36.D03.1.454.CMB.1.raw
  modified_base (377)..(377): a, c, t, g, unknown or other
  misc_feature (377)..(377): n is a, c, g, or t
  modified_base (415)..(415): a, c, t, g, unknown or other
  misc_feature (415)..(415): n is a, c, g, or t
tcagacagtatatacacgaccggtgctcgatttagctgcgtcacgatctctcgttggggggagacgagcccagcactggaagtcgccggtgtttccattcggtgatcatcactgaacacagaggactcaccatggactttgggctgagagttcgggtttttcctcgtttgcctttacgtttttaaggaggtcggcctaggtgtcaggtgcagctaggtggagtcgtgggggagacgcggcccagcccgtgggaacctcccgtgacgtacctccgtcctgtcgacacgtcctgtggtacttcattcctacgaggtacctatcgcctatcgctacgtcggtaccacgcgctaccgaggcgagggtctggggagtcgggngactattagagtacgaagagtagtaggtaattagaaanaacgtacgacggagtaccgtacggaaggacggaccgtacgtaccgtacgtccacgagaacgacgtaactacgaacggaacacgtacgtcgactactcgtacacgtaaattacgaacctaccgtacaaacgtaaacgtcgaacgtacgtaccggtacgttacgttaaccgttagttaacgttacggtacggtacgtaccgggtacccggtaccccggttaacggacccggtaccccggttaccccgg

SEQ ID NO: 291860 - DNA, 939 bp, Homo sapiens
  misc_feature: GYAE6OF02ITON1.44.36.D03.1.454.CMB.1.raw
  modified_base (60)..(60): a, c, t, g, unknown or other
  misc_feature (60)..(60): n is a, c, g, or t
  modified_base (128)..(128): a, c, t, g, unknown or other
  misc_feature (128)..(128): n is a, c, g, or t
  modified_base (154)..(154): a, c, t, g, unknown or other
  misc_feature (154)..(154): n is a, c, g, or t
tcagacagtatatacacgaccggtgctcgatttagctgcgtcacgatctctcttgggganctctgagagcggagccccagcccccagaacttcccaggttgttttcatttggtgatcagcactgaacncagaggctcaccagtggtagttcggntgagtcgttcgggtttttcctttgtttaggtttaattttacgagggttcgtccaggtagtagagtgctaggttgggtaggtacgggtccgggggtagtacctttcgggtaccaggtaccgtgggggtacggttccctaggacgtaccttcgtcccgtggttcgtccgtaccgttcgtgtaccgttaccacccgtaatccgacggtactaccgaactttaagtcgttagggtccggtaccggggttccccggaccgcgggtaaccgttcccggggaagggggtaaccgggggtcggttacggggacggggttacggggtcggttaaccgggtccgggaaacgttaaaaaccgggtaaaaaaacgtaggttaacccggtaccgtaacgttaccgttttaaacctggtaaacccgtaaacgttaacgggtaccccggtaccggtcccgttcggtttaacggtaacggaaacggtaccgtaacggttacgttacccgtacccttaccgtaaccgtaaccggtagtaacggtttcgtaacgttaaccaaacggttaaccttaccggttaacgtttagtttaacgttacgttaaggtaaccgttaaaggtaccgttaaaccgttaaaccgtaaaacccggttaaaccggaaccgggtaaccgggtacgggtaaccggtttaacggttaacggtttttaaagtttacgtttttaagggttagttttaccggtttttagtttaacggtttacggttaacggtttaacgggttaccggttccggtttaacccgg

SEQ ID NO: 291861 - DNA, 809 bp, Homo sapiens
  misc_feature: GYAE6OF02JEI5Q.44.36.D03.1.454.CMB.1.raw
  modified_base (185)..(185): a, c, t, g, unknown or other
  misc_feature (185)..(185): n is a, c, g, or t
  modified_base (408)..(408): a, c, t, g, unknown or other
  misc_feature (408)..(408): n is a, c, g, or t
tcagacagtatatacacgaccggtgctcgatttagctgcgtcacgatctctcttggggggagacgagcccagcactggaagtcgccggtgtttccattcggtgatcatcgactcgaacacagaggactcaccatggactttgggctggagagtttacggtttcctcgttgcctttacgttaaggnggtcgacgtaggtcgtacgaggtcgacgtacgtacgttagggtaaccggtcgttgggggggaacggaagtccggggacccccaaggtccccttggggggaaaccttcccccgtaggacgacgttccgtccgtgttacggcctaaggccccttcgtcgggtaactttaccaacttccgtttacgaagggtacccttaaggtcccgaattttcggctaaaaccgngggttaacccggtccgggtaaccggcgttaccggtacggacgaaccgggggtaccgttagggggtaccgttagggggtaccggtcgtaaacgttaaccgttagtaactaacggtaacgtaggtacggtaaattcggaaactacgaaacgtaaccgggtacgtaacgtaccgggaacgaacgggtaccgacgttaccgtaaccgtacgtacccgtagtaccgtaacgtaacgtacgtaacggaactaacgtaacgtacgacgtacgtacgtacgtacgaacgtacgtaacgtaaccgtacgaaccgtacggtacgtaaacgacgaacggtacctacgtacgtgttaaacccgtgtacgtacgagtccgtaccgtacgtaccgtaccggtccgtacgtaccgg

SEQ ID NO: 291862 - DNA, 847 bp, Homo sapiens
  misc_feature: GYAE6OF02JWIU5.44.36.D03.1.454.CMB.1.raw
  modified_base (237)..(237): a, c, t, g, unknown or other
  misc_feature (237)..(237): n is a, c, g, or t
  modified_base (305)..(305): a, c, t, g, unknown or other
  misc_feature (305)..(305): n is a, c, g, or t
  modified_base (401)..(401): a, c, t, g, unknown or other
  misc_feature (401)..(401): n is a, c, g, or t
  modified_base (457)..(457): a, c, t, g, unknown or other
  misc_feature (457)..(457): n is a, c, g, or t
  modified_base (564)..(564): a, c, t, g, unknown or other
  misc_feature (564)..(564): n is a, c, g, or t
tcagacagtatatacacgaccggtgctcgatttagctgcgtcacgatctctcttggggcagagctctggggaggaactgctcagttaggacccagacggaaccatggaagccccagcgcagcttctctcctctgctactctggcctcccagactaccactggaagaatagtcgatggaccgccggtctccgacgaccctacccgtgtccgttgtcgtacctacggaagggggaaacncctcccgaccccttcgttcccgtacggaccgaccggggccgtaggtaccgaacggtaggttggttacncgacggtacctaaaccggtttaccgccccgttacggtaaccagtacgaacgtaacgtccgtacggacccgtaagtcccgaccgtacgccgttaccncgtaatccgtagttcggatccgacctaccgaccgggcggtactaccgttggtaccncccggacgtaccggtacgtcgtacggtcggacggtagggtcggttcggtacgggaactacttaccgtttaccgtaacctccggtaacctaaccgtacgttaaacccncgtaacccggtaccgttaacgtccgtaaccggtccgtaaccggtagtttaacccggtttaggttttaaccggtaccgtttttaagtttaaaccgtttacgttaggtaacccgtagttaaaccggttacgtaagttttaaccggtaccggttaccggtttacccggtcccgggtttacccggttaaaggtaaacccccgggttaacgggtaaaccgaccggtttaaccggggtaacggttaacgggtttaaacccggttaaacccggtacggtttaacccgggg

SEQ ID NO: 291863 - DNA, 1012 bp, Homo sapiens
  misc_feature: GYAE6OF02IQNCN.44.36.D03.1.454.CMB.1.raw
tcagacagtatatacacgaccggtgctcgatttagctgcgtcacgatctctcttggggatcacataacaaccacactcctcctctaaagaagcccctgggagcacagctcatcaccatggactggacctggtcggttcctctttggtggtggcagcacgctacgagggttcgtcctacgtccccgagggtcgaccgagcgtgggtgaccgtagttccggttcgggggccttagggtaagggtaggaaacggtaaacggtcccggtttcgggggttccccgttacggggtacgggtaacgggttccttaccgtaggaccgtaaacgggttccttttacggtggggtaaaccgggccctttaaccccgttttcgttaaccgaacggttccttaacgtttcggttttccgttttttttaagggttttcgggggtaccggtaccggtaacccggtacccggggttacccccggttaggggaaaccgggttaacggggggttctttttagggagggggtttaccgggtaccgggggtttaggggggaacgggttaaccttacggtaaaccccgtttcccgtttaggtttttacgggttttcggggtacgttaccgtaaccggtttaacggttaaaaccgttttacccggaacgttaacggtaaacggtttaacggttttaccgggaaacgggtaaccgtaaaggttacccgttaaccgtaaacccgttaaaggtttaaccccgggaacgggtaaaaccgttaaccgtacccgtaaaccgggtaacgtaacccgaccggttaacctttacggtaggtaccgggtaacgtaccggttacggacccgtacgggtaggtctagggtaacggtttactaacgggttaagggaaacccgtaaccgggtacgtaccgttactttacgtttaccgtttaggacggtttaacgggaaccgttacgacccgggtttaccctttccggtaccttttaacccgtcgttaaccggttccctttaaccccg

SEQ ID NO: 291864 - DNA, 819 bp, Homo sapiens
  misc_feature: GYAE6OF02IL54K.44.36.D03.1.454.CMB.1.raw
  modified_base (237)..(237): a, c, t, g, unknown or other
  misc_feature (237)..(237): n is a, c, g, or t
tcagacagtatatacacgaccggtgctcgatttagctgcgtcacgatctctcttggggcagagctcgtggggaggaactgctcagttaggacccagacggaaccatggaagccccagcgcagcttctcttcctcctgctactcgtggctcccagactaccacgtaggaagaatagtgatacggaccgtcggtctccgacgcctaccctgtctggtcgtcgtaccgaaggggaacgcncccaccctctccgtcgcgacggccagtcaggaggttgtacgcgagactaacgttacgccgtacgaccacgacaaagtaacgtcgtcgggacccgaacggtccctacccgaggtcccttacctcgacttacgtaggtacggcctacacctccgacggtacggtcctaacggtttcggaacctcccgacggtaccggttaggttccgaggttaccggcggttaggggttcgggtccgtaacgggtaacggttacggttaccgttaccgtaccgtaccgtaccgtaaccgtacgtaaccgaccggtaacccgtcgttacccttacgggtaaccgttaaccggtttacgttaaacggttaaacggtttagttttacgttaaccgttttagtttttaacgttaccggtttacgttaacgttaacgggttaacttaaaagtttaaccgtttaaacgtcccggttaaccgttccccggtttaccccggttacccgggttaaccggtaaccccgggaaccggtacccggttaaccggtaaccggttaacggttaaacgttaaaccggtttaaccggtaccggttaaccgg

SEQ ID NO: 291865 - DNA, 691 bp, Homo sapiens
  misc_feature: GYAE6OF02JMADN.44.36.D03.1.454.CMB.1.raw
  modified_base (178)..(178): a, c, t, g, unknown or other
  misc_feature (178)..(178): n is a, c, g, or t
  modified_base (251)..(251): a, c, t, g, unknown or other
  misc_feature (251)..(251): n is a, c, g, or t
  modified_base (545)..(545): a, c, t, g, unknown or other
  misc_feature (545)..(545): n is a, c, g, or t
  modified_base (588)..(588): a, c, t, g, unknown or other
  misc_feature (588)..(588): n is a, c, g, or t
  modified_base (607)..(607): a, c, t, g, unknown or other
  misc_feature (607)..(607): n is a, c, g, or t
  modified_base (626)..(626): a, c, t, g, unknown or other
  misc_feature (626)..(626): n is a, c, g, or t
tcagacagtatatacacgaccggtgctcgatttagctgcgtcacgatctctcgttgggggactcctgtgccccaccatggacactctttgctacacactcctgctgctcgaccacccttcctgggtcttgtcccaggtcaccttgaaggagtctggtcctgtcgctggtcgaaacccncagacgaccctcacgctcgacctgaccaccatcgtcgttcggttctctctcaacgtactatagaagttgggtntgacgcgtagactccgtcgaccgccccgagggaacggccgtggacggtcggtcttcgccacgactcttcgttacgtacgaacgtacgaaaccgtaaaactccgtaacgacgtaactacttctagtacgaacgtacgacttaacgttaacacgtacgttaccgaacgtacctaaccgtaaccgaaacggccgtaacggttcgtttaacgtttacggtacaccgtaaaccgacgttaacgcccggtacctacgggacctaacgacggaacgtaccgtaataccgttaacgttacgnggttaacacggtacggttaacgtagggaaacggactaaaccgnggttcgtttacgtaacgtntacgttaacagttactcgngttccgacggttcgaacggtacgggaacgtacggtacccgtactcggtaaccttcgtaccgtccg

SEQ ID NO: 291866 - DNA, 722 bp, Homo sapiens
  misc_feature: GYAE6OF02GADC1.44.36.D03.1.454.CMB.1.raw
  modified_base (565)..(565): a, c, t, g, unknown or other
  misc_feature (565)..(565): n is a, c, g, or t
tcagacagtatatacacgaccggtgctcgatttagctgcgtcacgatctctcttggggatcacataacaaccacactcctcctctaaagaagcccctgggagcacagctcatcaccatggactggacctggcggttcctctttgtggtggcagcagctacaggtgtccagtcccgaggtgcagtcgtggtgctagtcgtggggctaggaggtgaagacgtccgtgggtccgtcggtagtaacggtctccgtgacgaaggtcgttcgtaggacggtcctaaccgttcttacgacgtacgttagttacgtttacgtttttacggttcggggtagtaccggtacggaccggtccccggtaagggaaccggtaaggggtccgttaggaacgggtcggtaccggtaggggtaacggtactacgtaccgtccgttagttcggttcggacgtacctagtaacgtacgttaccgaatacgtaacgtacgtacgacgacgtagactcaactacgtccgaacgtaacgtacgtaccgaacgtactcggactccgttaagacgtaggactggtacncggagacggtgaacggtactacgttacggaaacgaacgtaacgggaaccgttcgttaaacttcgtttacgggttcgccgggtttaacggcggtaaaccgttccggttaccccgttaggtttaaccctaacgtttccgtaaccgttccgttaaccccg

SEQ ID NO: 291867 - DNA, 783 bp, Homo sapiens
  misc_feature: GYAE6OF02HT2DK.44.36.D03.1.454.CMB.1.raw
  modified_base (229)..(229): a, c, t, g, unknown or other
  misc_feature (229)..(229): n is a, c, g, or t
  modified_base (278)..(278): a, c, t, g, unknown or other
  misc_feature (278)..(278): n is a, c, g, or t
  modified_base (357)..(357): a, c, t, g, unknown or other
  misc_feature (357)..(357): n is a, c, g, or t
  modified_base (602)..(602): a, c, t, g, unknown or other
  misc_feature (602)..(602): n is a, c, g, or t
tcagacagtatatacacgaccggtgctcgatttagctgcgtcacgatctctcgttggggagctctgagaggcggagccccacgccccagaacttcccaggttgttttcatttggtgatcgagcactgaacacagaggactcaccatggagttcggctgacgtcgttcgggttttcttgtttgtttactttacgaaggttcgtccagtagtgaaagtcgcgtagttgggnggacgggtccggggagtcgttcggtccagccgtgggacggtcccgtganccgtctcgtgtcgtcgccgtcgtcgtacttccactagtcaagttcgacctaacttatacgtaggtacgtcggggtcccnccggagtcctacgggaagggaacgggtcgtagggaggttcggtcgttacgggccgtaaaacgtaaaggtaaaaaccgttaacgttcgacccgtaagttacctttacgtaccgtaaagacggtaagttacccggccgtcggttacgtacgaacgtaacgacctaacggtacctttacccgaccttaccacgaaacgtaagtgtaaccgttaaccgttaaccgtaaaccgtacgtaactaacggttntacgttaccgtaggaaccgttaagtaccctaaaccgtttaaaccggaaaccgaaaagggacccggtaacgacgggtacctttaaggtaacgttttaaccgttaaggttttccggttaaggttttagttaacgttttaacttaacgttaaccgggtaaactttaccggtaccggttaaccgg

SEQ ID NO: 291868 - DNA, 660 bp, Homo sapiens
  misc_feature: GYAE6OF02INOBM.44.36.D03.1.454.CMB.1.raw
  modified_base (321)..(321): a, c, t, g, unknown or other
  misc_feature (321)..(321): n is a, c, g, or t
tcagacagtatatacacgaccggtgctcgatttagctgcgtcacgatctctcttggggatcacataacaaccacactcctcctctaaagaagccccgtgggagcacagctcatcaccatggactggacctggcggttccttctttggtggtggcagcagctacgaggtcgtccgagtcccaggtcgacagctggtgctagtcgtgggctggaggtagaagacgtccgtacgggtcctcgggtagaggtcctcctgacgtaaggcttcgtggacgcctaaccgttctcgagtctagtcgttattttagttgggactcgaacnccggtccctaggaaccgtaaggtcttaggcggttggcgtaggggacggtaatccgtaacttcccgtaagtttcgttggacgtacaagttaccgaaacgttcgaccagtaaggtactttgaacggtacaggactacgaaccgtaattaccgacggtaacgtaacgtaccgaacgtaacgtacgaacgacctaacgtagtacggacgtgtacgacgacgaaggtcctaaggagtaacgttacaacggtaaagacgaaccggtactacggttacctaacgtttggtaggttacgacgtagacggtaccctagtaaccttaactttacgtacgtaccttaacc

SEQ ID NO: 291869 - DNA, 728 bp, Homo sapiens
  misc_feature: GYAE6OF02FOICS.44.36.D03.1.454.CMB.1.raw
  modified_base (176)..(176): a, c, t, g, unknown or other
  misc_feature (176)..(176): n is a, c, g, or t
  modified_base (195)..(195): a, c, t, g, unknown or other
  misc_feature (195)..(195): n is a, c, g, or t
tcagacagtatatacacgaccggtgctcgatttagctgcgtcacgatctctcttggggggagacgagcccagcactggaagtcgccggtgtttccattcggtgatcatcactgaacacagaggactcaccagtggactttgggctgagattgggtttcctcgttgctcttttaagnggtggccagtgtcgaggtncagtcgtagtggacgtcggtagggggagcgccggtccgaagccgtagggaacctcccgtagacgtacctctccgtggtcgcacgtcctcgtggtactctacttctagaggtacctatcgccatcgactacgtcggtcccgtccgaggtcctaccgacgtacggaacgggtccgtagggtacgggttcgggaggtaactagttaacgacgttacgaacggaagtaacggtagtaagttaacggtaaacgaaaccgtaacggtaacgggacgaaccggtacgaacgggacggttaccgattaccgacccgttacgacccgtacgaccgaacgtaacgtacccgtaacggaaacacgtaccgcgtactacgtcgtaacgaactaacgtaacgtaacccaacgtacccgaagttaacgacggtaaacggaccgtaaccggtccgtttaacgttaccggttaagtttaacgttacggtacccggtacggttacccggtacccggtacccccgtaggtaccccgggtacccgtccccgg

SEQ ID NO: 291870 - DNA, 887 bp, Homo sapiens
  misc_feature: GYAE6OF02FNDHM.44.36.D03.1.454.CMB.1.raw
  modified_base (211)..(211): a, c, t, g, unknown or other
  misc_feature (211)..(211): n is a, c, g, or t
tcagacagtatatacacgaccggtgctcgatttagctgcgtcacgatctctcttgggggggagacgagcccagcactggaagtcgccggtgtttccattcggtgatcatcactgaacacagaggactcaccatggtactttcgggctgagtattgggttttcctcgttgtcttacttttaagaggtaggccagtgtcgaggtgcagctagnggagtcgtagggggagaggccggccgagccgtgggaacctccgtagagacctccgtccgtggtcgcgtacgtcccttagtcggtacttcacttcgttacgacggtaacttacgtccgtccctagtcggtacctcgggttccgggtcccggacccgtacgggtccctaccgggacgggtaccgggtaacggggtccgtagggggaccgggtgggggttccggtaaacttaaattaacgtacgtaacggtaaaggtaaacgttaggttaaggttaacgtttaaacgaaaacgggtaaaccggtaacccggtacgggtaaacccggtacccgggttaaccgggtaacgggtaacccgggggtaaaccggttaccggttttacccggttaccccgttaccgttaaccccgtagggtaacccggtaaaccttaaccggtaaacccgtaaacgggttaaacccgtacccggtttaacggttaccttaaccgttaaaagtaaaccgttaagtaaacccgttaaggtttaacggtaacccggtaacgggtaaccggtaaaggtaacccggttccggtacctacggttctttaaccgtttaacgttacggtaacccggaccgttacccgtacgtttcggtaccggttagggtacccgggtaccggtaccgggtccgtaccccggg

SEQ ID NO: 291871 - DNA, 718 bp, Homo sapiens
  misc_feature: GYAE6OF02HFD3C.44.36.D03.1.454.CMB.1.raw
  modified_base (104)..(104): a, c, t, g, unknown or other
  misc_feature (104)..(104): n is a, c, g, or t
  modified_base (170)..(170): a, c, t, g, unknown or other
  misc_feature (170)..(170): n is a, c, g, or t
  modified_base (209)..(209): a, c, t, g, unknown or other
  misc_feature (209)..(209): n is a, c, g, or t
  modified_base (228)..(228): a, c, t, g, unknown or other
  misc_feature (228)..(228): n is a, c, g, or t
  modified_base (277)..(277): a, c, t, g, unknown or other
  misc_feature (277)..(277): n is a, c, g, or t
  modified_base (305)..(305): a, c, t, g, unknown or other
  misc_feature (305)..(305): n is a, c, g, or t
tcagacagtatatacacgaccggtgctcgatttagctgcgtcacgatctctcttggggcagagctctggggaggaactgctcagttaggacccagacggaaccngtggaagccccagccgcagtcttctcttcctctcgctactctggcctccagactaccgactggaanaaatgtgatgacgcggtctccgagcccacctgtctggtntacctcggaaaggggaacncgtccctaccctctaccgtgccgagggccagtcgagttactggttacgnacgtactaacgttacgcctacgtaccgngaaccgtaagtaactcgacggacccgaacggtccgtaacccgcggttccctaccgtatacgtccttagtcgggtcacctaacaccgtaacgaccgggtcacgttggtaccctaccgcgtaccggttatacggagtcgggtacgtgggttaggaccgtaggacgtaacggtactacgttacctacggtacctaacgtacgtacctaacgccgttaggtcccaggttacgtacgttaccgtacggttaactttacgttacggttaagtttaacgttttactaaccggttgtaacccgtaagtacccgtaaagttaccgtaagttccgtaagtccccggtaccttccgggttacccggacgaaaccggtaccgtaccggaggtaaccgttacggaaaccgttacgtaggtaaccgg

SEQ ID NO: 291872 - DNA, 954 bp, Homo sapiens
  misc_feature: GYAE6OF02ID8YC.44.36.D03.1.454.CMB.1.raw
tcagacagtatatacacgaccggtgctcgatttagctgcgtcacgatctctcttggggatcacataacaaccacactcctcctctaaagaagcccctgggagcacagctcatcaccatggactggacctggcggttcctctttgtggtggcagcagctacaggtgtccagtcccaggtgcagcgtgggtgctaggtccgtgggggctaggaggtagaacggaaggtcccgttggggtcccgttgggtaggtaaacggttccttccgtggaccgtaacggtcgtttcgtcggggtaggcctaaccgtttcttacgacggtccttaagttcggttactttttaggtttggggttcgaccgggtaaccggtaaccgggtccccccggttaggggaaaccggtaaacgggggttcctttaggggacgggtttcggggtaccggggttagggggtaacgggggtaacttacgtaaccgttaccccgtttaaggtttccggttttagggtacggtaccgtaacggtttaaccggtttaaacttaaccgggtaccgtaaccgttaaaggttaacgggttttaccggaacgggttaaaccggtacggtaaccgttaccgtaaaccctttaacccgggtaaccggtaaccggggaaacccggttaaaccgtacccgggtaaaccgggttaccgttaacggtaacccggtacccgttaaaccggtaaggtaccgggtaacgtccgggtaacggaacggtacggtaccgggggcgttaacgggacgtaacttaccgggtaaaggaaaccggtaacgaacccggtaccgttaacttaccggttttaactttccggttaacgggtaccggtaaccgggtaaccggttacccggttaccccgtttacccgggttaacccgtttaacccggttttaccgtaaaccccggtttacgtttaacccccccgg

SEQ ID NO: 291873 - DNA, 673 bp, Homo sapiens
  misc_feature: GYAE6OF02FZ0AA.44.36.D03.1.454.CMB.1.raw
  modified_base (309)..(309): a, c, t, g, unknown or other
  misc_feature (309)..(309): n is a, c, g, or t
tcagacagtatatacacgaccggtgctcgatttagctgcgtcacgatctctcttggggagctctgagagcggacgccccagccccagaattccccaggtgttttcatttggtgatcaggactgaacacagaggactcaccagtggagttgggctgagctggtattttccttgctgacttaattttaaaggtcgtccagtgtgaggtgcaggttggtggagtgtgggggtagttaggaagcgtgggatcctagactcgtcgtgtgcagcctgtgtattctacttcgagtacgctgatgacgtcgggtccncgaggccacggaggggacgggcgtgggaggttcgggttcggtaccgttaataaggaaaccaaggcgtaggacgggtacgggacagacgaagtacctacggctacggacccaacggtaggaaacggtctaaacgttactaaccaacccgtagttaccgtaacaaaggtactaactaacggttaacttaaacgaaaaggttaacttaccggggttactacggtttacgagtacgtaagacgttaagaacctaggacctaaagacccgtaacggacacctacgtaacctacggttaactagttaacgtcgttacggttaggcgttttacggttccgaacggtttcccgggacgtacggggtaacccg

SEQ ID NO: 291874 - DNA, 741 bp, Homo sapiens
  misc_feature: GYAE6OF02HS9TO.44.36.D03.1.454.CMB.1.raw
  modified_base (111)..(111): a, c, t, g, unknown or other
  misc_feature (111)..(111): n is a, c, g, or t
  modified_base (127)..(127): a, c, t, g, unknown or other
  misc_feature (127)..(127): n is a, c, g, or t
  modified_base (222)..(222): a, c, t, g, unknown or other
  misc_feature (222)..(222): n is a, c, g, or t
  modified_base (236)..(236): a, c, t, g, unknown or other
  misc_feature (236)..(236): n is a, c, g, or t
  modified_base (241)..(241): a, c, t, g, unknown or other
  misc_feature (241)..(241): n is a, c, g, or t
  modified_base (319)..(319): a, c, t, g, unknown or other
  misc_feature (319)..(319): n is a, c, g, or t
tcagacagtatatacacgaccggtgctcgatttagctgcgtcacgatcgtctcttggggcagagctctggggaggaactgctcagttaggacccagacggaaccatggaanccccagcgcagcttcncttcctctgctactctggctcccgagtataccagtggagaaatggagatgacgcagtctccagccaccttgtcctgtgtctaccgaaggggaacncgccaccgtctccngaccngggccaggtcacgagttacgtaccagctaacttacgccgttacggtaaccaccgacgtaaacgcgggaccacggtccncccgacggcctaccgtcacgtctaagtacggaaacctactacccgaaccgaccggtacctaacgttacggtaaccctaccccggtaaccgtacgggttaccgaacggttcgggacgtacggggttaccggggtaccgggaacgtacggttaaccggtttccacgtacccttaccgaacccgtacgtccgaccgggtccgtaccgtcgcgttaacgttcgtacggttaacggtttagtttacgttacgttaagttttaacgttccgtaacgttacgtacgtacttaacggttaacttaacgttaacgtccggttactaccgtttacgtacccgggtttcggggaccgggtaaccggagggttaacggagtaaccgttaccggaacttacgggtcgtacggtcgttaccgcgtaccgtaaccgg

SEQ ID NO: 291875 - DNA, 522 bp, Homo sapiens
  misc_feature: GYAE6OF01CRNQE.9.20.B09.1.454.CMB.1.raw
  modified_base (511)..(511): a, c, t, g, unknown or other
  misc_feature (511)..(511): n is a, c, g, or t
tcagtgatacgtctcacgaccggtgctcgatttagtgtagtgtgaagggggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccgggcccctgtggtggtcgtctatgataacagtgaccggccctcgtcgatccctgagcgcttctctggctccaactctgggaacacggccaccctgaccatcagcaggccgaagccgggatgagccgactatactgccaggtgtgggctggtgataatgatcatggcgggggtgttcgggcgggagggaccaagcgtgaccgtctaggtcagcccgaaggctcgccccctcggtccactcctcgttccccnccctcctcacg

SEQ ID NO: 291876 - DNA, 523 bp, Homo sapiens
  misc_feature: GYAE6OF01DJWX2.9.20.B09.1.454.CMB.1.raw
  modified_base (517)..(517): a, c, t, g, unknown or other
  misc_feature (517)..(517): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccgggcccctgtggtggtcgtctatgataacagtgaccggccctcgtcgatccctgagcgcttctctggctccaactctgggaacacggccaccctgaccatcagcagggccgaagccgggatggagccgactattactgccaggtgtggcatattatcaccccgtgtcggcgggggaccaagcgtgaccgtctaggtcagcccaaggcctcgccccgtcggtcactcctcgttccccaccctcctcagacgtntctacg

SEQ ID NO: 291877 - DNA, 533 bp, Homo sapiens
  misc_feature: GYAE6OF01CY8XF.9.20.B09.1.454.CMB.1.raw
  modified_base (526)..(526): a, c, t, g, unknown or other
  misc_feature (526)..(526): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccgggcccctgtggtggtcgtctatgataacagtgaccggccctcgtcgatccctgagcgcttctctggctcaactctgggaacacggccaccctgacccatcagcagggccgaagccgggatgaggcgactatactgccaggtgtggcatattactcaccccgtgttcgggcgggggaccaaggctgaccgtcctaggtcacgcccaaggcctcgcccccgtcggtccactcctcgttccccacccttccctacacgacgtntcgtacg

SEQ ID NO: 291878 - DNA, 539 bp, Homo sapiens
  misc_feature: GYAE6OF01B9XX0.9.20.B09.1.454.CMB.1.raw
  modified_base (401)..(401): a, c, t, g, unknown or other
  misc_feature (401)..(401): n is a, c, g, or t
  modified_base (533)..(533): a, c, t, g, unknown or other
  misc_feature (533)..(533): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccgggccctgtggtggtcgtctatgataacagtgaccggccctcgtcgatccctgagcgcttctctggctccaactctgggaacacggccacctgaccatcagcagggccgaaggccgggatgaggccgactattacngccgaggtgtggcatattactcctaccccgtgttccgggcgggggaacccaggccgtgaccgtccgtacggtcacgcccaaggcctcgcccccgtcggtcacctcctcgttccccaccctcctccagacctntctacg

SEQ ID NO: 291879 - DNA, 537 bp, Homo sapiens
  misc_feature: GYAE6OF01ET5N0.9.20.B09.1.454.CMB.1.raw
  modified_base (350)..(350): a, c, t, g, unknown or other
  misc_feature (350)..(350): n is a, c, g, or t
  modified_base (531)..(531): a, c, t, g, unknown or other
  misc_feature (531)..(531): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccgggcccctgtggtggtcgtctatgataacagtgaccggccctcgtcgatccctgacgcgcttctctggctccaactctgggaacncggccaccctgaccatcagcagggccgaaggccgggatggaggccgactattactgccaggtgtggcatattactcacccccgtgttcggcgggggaccaggctcgaccgtccgtacggtcacgcccgaaggcctcgcccccgtcggtcactcctcgttccccgcccctcctcacgccgtntctacg

SEQ ID NO: 291880 - DNA, 520 bp, Homo sapiens
  misc_feature: GYAE6OF01D27LS.9.20.B09.1.454.CMB.1.raw
  modified_base (397)..(397): a, c, t, g, unknown or other
  misc_feature (397)..(397): n is a, c, g, or t
  modified_base (512)..(512): a, c, t, g, unknown or other
  misc_feature (512)..(512): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccgggcccctgtggtggtcgtctatgataacagtgaccggccctcgtcgatccctgagcgcttctctggctccaactctgggaacacggccaccctgaccatcagcagggccgagcgggatgagcgactattcngtcagctgtgggattctcatgagtggtaggtggggaatcgttcggcgggagggaccaggctgaccgtcctaagtcgacgcccaaggcctcgccccctcggtcactctcgttcccnccctcccg

SEQ ID NO: 291881 - DNA, 595 bp, Homo sapiens
  misc_feature: GYAE6OF01BOCDG.9.20.B09.1.454.CMB.1.raw
  modified_base (294)..(294): a, c, t, g, unknown or other
  misc_feature (294)..(294): n is a, c, g, or t
  modified_base (350)..(350): a, c, t, g, unknown or other
  misc_feature (350)..(350): n is a, c, g, or t
  modified_base (413)..(413): a, c, t, g, unknown or other
  misc_feature (413)..(413): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccgggccctgtggtggtcgtctatgataacngtcgaccggccctcgtcgatccctgagcgcttctctggctccaactcgtgggaacncggcccaccctgacccatcagccgagggcccgaaggcccggggatggaggccgactattacgngccgagggtgtggctatacttactccctaccccggttgttccggggcgggggaccaaggccgtacggacccgttccgtaggtccgacgtcccgaacgggtcctcccggcccccgtcgggtccaccgttccgttccgttacccccgccccttccctcgaacgtacccgttagtccgtaaccgg

SEQ ID NO: 291882 - DNA, 651 bp, Homo sapiens
  misc_feature: GYAE6OF01DOWOZ.9.20.B09.1.454.CMB.1.raw
tcagtgatacgtctcacgaccggtgctcgatttagtgtagtgtgaaggggcgtgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggcccgggccctggtggtggtcgtctatgataacagtgaccggccctcgtcgatccctgacgcgcttctctggcctccaactcgtacgggaacaccgggcccaccctgaacccatacacgcgacggggacccgagggccggggagtggacggccgaacttagttacgtcgaccgtagggtgtcggacattaactttactcccgacccccggtttgggttccggggaccgggggggaacctaacggccgttcggaacccgttccgttaacggtccgacggtaccccgaacgggcccgttccggccccccgtcggttacccgtacccttcccgttacccgtttcccccaaccccgtttcccctacccgtagtacccggtattcccgtaacg

SEQ ID NO: 291883 - DNA, 532 bp, Homo sapiens
  misc_feature: GYAE6OF01DXFRQ.9.20.B09.1.454.CMB.1.raw
  modified_base (524)..(524): a, c, t, g, unknown or other
  misc_feature (524)..(524): n is a, c, g, or t
  modified_base (526)..(526): a, c, t, g, unknown or other
  misc_feature (526)..(526): n is a, c, g, or t
tcagtgatacgtctcacgaccggtgctcgatttagtgtagtgtgaagggggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccgggcccctgtggtggtcgtctatgataacagtcgaccggccctcgtcgatccctgacgcgcttctctggctccaactctgggaacacggccacctgaccatcagcagggccgaaaggccgggatgacggccgaactattactgccaggtgtggcattacttactcgaccccgttggttccgggcgggggacaagcgtcgaccgtcgtaggtcacgcccaaggcctcgcccctggtccactctcgtcccaccctcacacgactncntgacgg

SEQ ID NO: 291884 - DNA, 534 bp, Homo sapiens
  misc_feature: GYAE6OF01BGRHY.9.20.B09.1.454.CMB.1.raw
  modified_base (217)..(217): a, c, t, g, unknown or other
  misc_feature (217)..(217): n is a, c, g, or t
  modified_base (529)..(529): a, c, t, g, unknown or other
  misc_feature (529)..(529): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtggganaagacattgcaaggaagagtgtccactggtaccaacagaggccaggccgggcccctgtggtggtcgtctatgataacagtgaccggccctcgtcgatccctgacgcgtcttctctcggctccaactcgtggggaaccacggcccaccctgacccatcagcagggccgaaggccggggatggaggccgactattactgccaggtgtggcatattatccaccccgtgttcgggcgggggaccaaggcgtgaccgtcgtaggtcacgcccaggctccggcccctggtccacgtctcgtcccgccctctcagcgtntcacg

SEQ ID NO: 291885 - DNA, 615 bp, Homo sapiens
  misc_feature: GYAE6OF01AGKZW.9.20.B09.1.454.CMB.1.raw
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccgggcccctgtggtggtcgtctatgataacagtcgaccggccctcgtcgactccctgacgcgtcttctctcggcctccaactcgtagggaaccacggcccaccctgacccatcagcgacggggccgaaggccggggatcggacggccgacgttacttactggccgtagggtcgtggactatacttactcccgtaccccggttggttccggggccggggggaaccaaggtccgtacggtacccgttccgtacggtccgacggtccccgaaggcccgtccgccccccgtcggtccctaccgttcctccgttcccccaccccgttccctacgtacgtaccgttactccgtaacg

SEQ ID NO: 291886 - DNA, 605 bp, Homo sapiens
  misc_feature: GYAE6OF01DGHRO.9.20.B09.1.454.CMB.1.raw
  modified_base (425)..(425): a, c, t, g, unknown or other
  misc_feature (425)..(425): n is a, c, g, or t
  modified_base (596)..(596): a, c, t, g, unknown or other
  misc_feature (596)..(596): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgacaaggaagagtgtccactggtaaccaacagaggccaggcccgggccctgtggtggtcgtctatgataacagtcgaccggccctcgtcgactccctgagcgcttctcgtggcctccaactcgtagggaaccaccggcccaaccctgacccatcgagcgacgggaccgaaggccggggatcggacggccgaactattacncggccgaggtgtggctaatacttactcccgtacccccgttgggttccggggaccggggggaccaacggccgtcgtacccggttaccgtagggtccgacggacccgaaggtccctccggtcccccgtcggtccaccgttccttccgttccccacccctcctacagtaccgtntcgtaaccg

SEQ ID NO: 291887 - DNA, 626 bp, Homo sapiens
  misc_feature: GYAE6OF01CLTZG.9.20.B09.1.454.CMB.1.raw
tcagtgatacgtctcacgaccggtgctcgatttagtgtagtgtgaagggggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccagggcccgggcccctggtgggtcggtcctccgatcatactaggcgacccggccctcgaggggactcccgtgacgcgattctcacggctccaactctacgggaaaacgccaccctgaccatcagcagggtcgaacgccggggatggaaggccgtatattactgtcgaggtgtgggcgtggtgtataagtgatcagtgggtcggggtagttcggacgggacgggaccgaaggtccgtacggtaccgtccgtaaacggtccgaacggaccccgtaacgggtccgtaccggaccccccccgtttcggggtacccacccgtttcccgttcccgttaccccccctacccttccccgttcctaaccgggttaacccg

SEQ ID NO: 291888 - DNA, 688 bp, Homo sapiens
  misc_feature: GYAE6OF01ECQ1G.9.20.B09.1.454.CMB.1.raw
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagcccaccctcggtgtcagtcggccccgagggagggaccggccaccattacctgtggtgggagaagacattgacgaaggaagagtgtccacgtcggtaaccaacgaggacggcccgacgggccccgggcccctggtcggtcggtcgtctagtgaactaacgaggtcggacccggcccgttcggtccgtactccctagacgcgtcttctcgtcggcctaccaacgtcgagggaaccacggcccacctcgaccactcagcgacgggaccggaaggccggggatcggacgggaccgtaacttacgttaacgtggtaccggtagggttgggtcgggtcgttgggtagtaagttaagtgaactcgaggttcggggtacggggggttggttacggggacgggaacgggaacctaggtccgtacggtacccgttacccgtaaaggtcccgaaccggtaccccgaacgggtccctcccgtaccccccgtcggtaccctaccgttcccgtttcccgttccccccggtcccttccccg

SEQ ID NO: 291889 - DNA, 623 bp, Homo sapiens
  misc_feature: GYAE6OF01A5GM6.9.20.B09.1.454.CMB.1.raw
  modified_base (290)..(290): a, c, t, g, unknown or other
  misc_feature (290)..(290): n is a, c, g, or t
  modified_base (381)..(381): a, c, t, g, unknown or other
  misc_feature (381)..(381): n is a, c, g, or t
  modified_base (478)..(478): a, c, t, g, unknown or other
  misc_feature (478)..(478): n is a, c, g, or t
  modified_base (513)..(513): a, c, t, g, unknown or other
  misc_feature (513)..(513): n is a, c, g, or t
tcagtgatacgtctcacgaccggtgctcgatttagtgtagtgtgaggaaagggcctgtgaaggcttcactagtcctggacctcctgtgcaagaacatgaaacatctgtggttcattcctcctcctggtggcagctcccagatgggtcctgtcccaggtgcggctgcaggagtcgggcccaggactagtgaagccttcacgagggccctaggtccctcacccttggcacgtgtctctcggtcgaacctccgatcagtcggtcgtcgtttcccatcggacctggatccggcnggtccgccggacaaggggctggagtatagttggaacaagtctagcgccagtcggcccgacacttactaccgaacccgtccctacgaaacgnggtcgaacgcaaggccaagtttgccaaggttccacacgtaccaagaccgaagttcctccgtagtaccagttagagttactaagttcgaaccggtccncaacgacgaccggtcgtacggtatttaccgtggtnacggagagtacggtcgttaagttttacggaccgagtacgtaacgtttaaaacttcgtaacctacggttacgttcggaacgttcggtgggaccgtgggaaccgtaaccggg

SEQ ID NO: 291890 - DNA, 549 bp, Homo sapiens
  misc_feature: GYAE6OF01CPU8W.9.20.B09.1.454.CMB.1.raw
  modified_base (406)..(406): a, c, t, g, unknown or other
  misc_feature (406)..(406): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccgggccctggtggtggtcgtctatgataacagtgaccggccctcgtcgatccctgacgcgcttctctggctccaactctggggaaccacggccaccctgaccatcagcagggccgaagccgggatggaggccgactattacngccaggtgtggcatattactccaccccgtggttcgggccgggggaccaaggcgtcgaccgtccgtaggtcacgcccgaaggcctcgcccccgtcggtccaccgtcctcgttccccaccccgtccctacagaccgtactctacg

SEQ ID NO: 291891 - DNA, 539 bp, Homo sapiens
  misc_feature: GYAE6OF01D4BKH.9.20.B09.1.454.CMB.1.raw
  modified_base (353)..(353): a, c, t, g, unknown or other
  misc_feature (353)..(353): n is a, c, g, or t
  modified_base (528)..(528): a, c, t, g, unknown or other
  misc_feature (528)..(528): n is a, c, g, or t
  modified_base (534)..(534): a, c, t, g, unknown or other
  misc_feature (534)..(534): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccgggcccctgtggtggtcgtctatgataacagtgacccggccctcgtcgatccctgagcgcttctctggcctccaactctggggaaccncggcccaccctgacccatcagcagggccgaaggccggggatggaggccgactattactgccaggtgtggcatattactccaccccgtggttccgggcgggggaccaaggcgtcgaccgtcgtaggtcagcccaaggcctcgcccccgtcggtccactcctcgtccccaccctccncagacntcacg

SEQ ID NO: 291892 - DNA, 601 bp, Homo sapiens
  misc_feature: GYAE6OF01B4GDV.9.20.B09.1.454.CMB.1.raw
  modified_base (424)..(424): a, c, t, g, unknown or other
  misc_feature (424)..(424): n is a, c, g, or t
tcagtgatacgtctcacgaccggtgctcgatttagtgtagtgtgaagggggcctaaggaagcagcactggtggtgcctcagccatggcctggaccgttctcctcctcggcctcctctctcactgcacaggatctatgacctcacatgtgctgactcagccaccctcggtgtcagtggccccagggagggacggccaccattacctgtgtgggagaagacattgcaaaggaagagtgtccactggtaaccaacagaggccagggcccgggcccctggtggtggtcgtctatgataacagtcggacccggccctcgtcgactccctgacgcgtcttctctggcctccaactcgtagggaaccacggccaccctgaccatcagcagggccgaaggccgggatggacggccgatattactgcaggtgnggctatattactcccgaccccggttggttccggggacgggggaccaaggcctacggacccgttccgtaggtcacgcccgaaggcctccgcccccgtcgggtcctaccgttcccgttccgttcccccaccccgtttcccctacgtaccggtaccgttactcccgacgttcggaccggg

SEQ ID NO: 291893 - DNA, 542 bp, Homo sapiens
  misc_feature: GYAE6OF01EL6I9.9.20.B09.1.454.CMB.1.raw
  modified_base (533)..(533): a, c, t, g, unknown or other
  misc_feature (533)..(533): n is a, c, g, or t
  modified_base (537)..(537): a, c, t, g, unknown or other
  misc_feature (537)..(537): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggagagtgtccactggtaccaacagaggccaggccgggccctgtggtggtcgtctatgataacagtgaccggccctcgtcgactccctgacgcgcttctctggcctccaactcgtagggaacacggccaccctgaccatcagcagggccgaaggccggggatcggaggccgactattactgccgaggtgtggcatattactccgacccccgttggttccgggaccgggggaccaaggcgtcgaccgttctacggcacgcccgaaggcctcgccccgtcggtcactctcgtcccaccctctacanactntcacg

SEQ ID NO: 291894 - DNA, 637 bp, Homo sapiens
  misc_feature: GYAE6OF01E0MK2.9.20.B09.1.454.CMB.1.raw
  modified_base (419)..(419): a, c, t, g, unknown or other
  misc_feature (419)..(419): n is a, c, g, or t
  modified_base (465)..(465): a, c, t, g, unknown or other
  misc_feature (465)..(465): n is a, c, g, or t
  modified_base (490)..(490): a, c, t, g, unknown or other
  misc_feature (490)..(490): n is a, c, g, or t
  modified_base (630)..(630): a, c, t, g, unknown or other
  misc_feature (630)..(630): n is a, c, g, or t
tcagtgatacgtctcacgaccggtgctcgatttagtgtagtgtgaagggggctgggcctaaggaagcagcactggtggtgcctcagccatggcctggaccgttctcctcctcggcctcctctctcactgcacaggatctatgacctcacatgtgctgactcagcccaccctcggtgtcaggtcggccccgagggacggggaccggccaccattacctggtggtgggagaagactattgacgaaggaagagtcgtccacgtacggtacccaacgagacgggccacgggcccgggcccctggtggtggtccgtctagtgataacgaggtcggacccggcccttcggtcgactcccgtgacgtcgtcttctcgtggcctaccaacgtcgtacggggaaccaccggcccaccctcgacctacncgacgcgacgggcctaagggccgggatcggacgcgtactagttacncgcgtaggtgtcgctatacgttacnccgtacccgttgggtccgggcggggaaccacggcgtacggaccgttcgtacggccacggacccgtacggccctcccggtcccccgtcggtcccaccgttcccgtacccgttcccctaccccgtcctacgaccgtcgttcnccgtacg

SEQ ID NO: 291895 - DNA, 593 bp, Homo sapiens
  misc_feature: GYAE6OF01AU4D1.9.20.B09.1.454.CMB.1.raw
  modified_base (291)..(291): a, c, t, g, unknown or other
  misc_feature (291)..(291): n is a, c, g, or t
  modified_base (347)..(347): a, c, t, g, unknown or other
  misc_feature (347)..(347): n is a, c, g, or t
tcagtgatacgtctcacgaccggtgctcgatttagtgtagtgtgaagggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgacaaggaagagtgtccatggtaccaacagaggccaggccggccctgtggtgtcgtctatgataacngtgaccggcctcgtcgactccctgagcgcttctctcggcctcaactctgggaaccncggccacctgaccagtcacgcgagggccgaaggccgggatcggacggccgtaacgtattacgcgtccgaggtgtcggcagttattactcccgtaccccgtgggttcgggccgggggacaacggcgtcggacccgttcgtacgtacgacggccgaacggccgtaccgcccccgtcggtccgaccgttccgttcccggttcccccgcccttcccgtaccgtaacggtacccgttacgtccgtaaccgg

SEQ ID NO: 291896 - DNA, 596 bp, Homo sapiens
  misc_feature: GYAE6OF01AKVYI.9.20.B09.1.454.CMB.1.raw
  modified_base (415)..(415): a, c, t, g, unknown or other
  misc_feature (415)..(415): n is a, c, g, or t
tcagtgatacgtctcacgaccggtgctcgatttagtgtagtgtgaaggggcgtgggcctaaggaagcagcactggtggtgcctcagccatggcctggaccgttctcctcctcggcctcctctctcactgcacaggatctatgacctcacatgtgctgactcagccaccctcggtgtcagtggccccagggagggacggccaccattacctgtgtgggagaagacattgcaaggagagtgtccactggtaccaacagaggccaggccggtcccctgtggtggtcgtctatgataacagtgaccggcctcgtcgatccctgacgcgtcttctctggcctccaactcgtgggaaccacggccaccctgaccatcacgcgacgggccgaaggccgggatggacggccgtaactattacncgaccgtaggtcgtggacattactactccgaccccggttggttccgggcgggggaccaaggccgtacggaccgtccgtaggtacacggtacccgagggtccctccggccccccgttcgggtaccaccgttccgttccgttcccccgtcccctccgtaccacggtaccgtcgtcgtaaccgg

SEQ ID NO: 291897 - DNA, 542 bp, Homo sapiens
  misc_feature: GYAE6OF01DRJIG.9.20.B09.1.454.CMB.1.raw
  modified_base (534)..(534): a, c, t, g, unknown or other
  misc_feature (534)..(534): n is a, c, g, or t
tcagtgatacgtctcacgaccggtgctcgatttagtgtagtgtgaagggggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccgggcccctgtggtggtcgtctatgataacagtgaccggccctcgtcgatccctgagcgcttctctggctccaactctgggaacacggccaccctgaccatcagcagggccgaagccggggatggaggccgactattactgccaggtgtggcattattactccacccccggttgttccgggcgggggaccaaggctcggaccgtccgtaggtcacgcccaaggcctcgccccctcggtcacttcctcgttccccgccctcctcacgacgtatcncgtgacgg

SEQ ID NO: 291898 - DNA, 687 bp, Homo sapiens
  misc_feature: GYAE6OF01CC6S4.9.20.B09.1.454.CMB.1.raw
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagcccaccctcggtgtcagtggcccaggagggacggccaccattacctgtgtgggagaagacattgacaaggaagagtgtccactggtaccaacagaggccagggccgggcccctgtggtggtcgtctatgataacagtcgaccggccctcggtcgactccctgacgcgtcttctcgtggcctaccaactcgtacggggaaccaccggcccctacccgtcgacccactcaacggccgaacggggacccgaacgggcccgggggaatggggaacggacccggtaacttaagttaccgtcggacccgtagggtcgtgggacctaagttactttacgtccccgaaccccggttgggttcccggggaccgggggaaccacggccgttacggacccgttccgtaacggtccgaccggaccccgaagggtccctaccgggccccccccgttcgggtaccctacccgttcccgttacccggtttccccccaccccgttccctaccgtaaccgtaaccgttactcccgtaaccgg

SEQ ID NO: 291899 - DNA, 739 bp, Homo sapiens
  misc_feature: GYAE6OF01BU96V.9.20.B09.1.454.CMB.1.raw
  modified_base (315)..(315): a, c, t, g, unknown or other
  misc_feature (315)..(315): n is a, c, g, or t
tcagtgatacgtctcacgaccggtgctcgatttagtgtagtgtgaagggggcctaaggaagcagcactggtggtgcctcagccatggcctggaccgttctcctcctcggcctcctctctcactgcacaggatctatgacctcacatgtgctgactcacgccaccctcggtgtcagtcggccccgagggacgggaccggccacctattacctggtgtgggagaagacattgacaaggaagagtcgtccacgtcggtaaccaacaggacggccgacgggcccgggcccttggtgggtcggtcgtctatagataacgngtcggacccggcctcgtcgactccctggacgccgtcttcgtcgtcggcctaccgaacgtcgtacgggaaccaccggcccacccgtcgaacccagtccgacgccgacggggacccgaagggccggggaagtcggacggaccgtaacgttacgttacgtcggaccgtagggttcgtacgggtactagttaacgttaccgtaccccggtacccccgggtttgggttacccgggggaccgggggtaaccaacgggtccgtaccggacccggttaccgtacggtaccgaccggacccgaacggtcccgtacccggttccccccgtacggtacccgtacccgtttcccgttaccccggttccccccgtcccccttacccgtaccgttaacccggttacgttacccgtaccacgggttcgggtacccgggg

SEQ ID NO: 291900 - DNA, 851 bp, Homo sapiens
  misc_feature: GYAE6OF01CDCPI.9.20.B09.1.454.CMB.1.raw
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcacgcccacccgtcggtgtcgaggtcggccccgagggacgggaccggccaccattacctggtggtagggagaagacagttgacgaaaggaagtaaggtcgtaccacgtacggtaaccaaacgaggacggccgaacgggtcccgggaccccgttgggttcgggtaggggtccgttaccgttaagttacggtaacgttaaaaccgacgggttccggaacccccgggtccccgttaccgggttaccggtaacccttccccggtaggtaccggtcccggttcccttttaccgtcccgtcgggttcccctaaccccgtaaacgttccgggtaacggggaaacccgacccggggtacccctaacccgtcggaaccctaacgtaccgaacggccgggaaaccgggggaaccgaacggggaccgggggacgtacgggtaaccgggaccgtaacgttaacgttacggtcgaacccggtagggtcgggtacggtactaacgttacgttaaccgtccccgtacccgggttcgggttaccgggggacccggggaacctacggccgttaccggacccgttaccggtaggtcccgaccggaccgtaccggtccgtcccggtaccccccgtggtaccctaccgttcccgttcccggttcccccctccccgttcccgtactaacccggtccgttacgtccgtaccggg

SEQ ID NO: 291901 - DNA, 599 bp, Homo sapiens
  misc_feature: GYAE6OF01DL3DQ.9.20.B09.1.454.CMB.1.raw
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccggcccctgtgtggtcgtctatgatacagtgaccggccctcgtcgactccctgagcgcttctctggcctccaactcgtagggaacacggccaacccctgaccatcagcgagggcccgaaggcccggggagtcggaacgggcccgaacttacttacgtcgccagggtgtggcatagttactcccgacccccgttgggttccgggaccggggggtaccaacggtccgtggacccgtccgtacgggtcacggtacccaaggcctccgcccccgtccggtccgtacctccgttccgttcccccaccccgttcctaccgtacggaccgtcttccgtaacg

SEQ ID NO: 291902 - DNA, 684 bp, Homo sapiens
  misc_feature: GYAE6OF01DFQ9V.9.20.B09.1.454.CMB.1.raw
  modified_base (374)..(374): a, c, t, g, unknown or other
  misc_feature (374)..(374): n is a, c, g, or t
  modified_base (438)..(438): a, c, t, g, unknown or other
  misc_feature (438)..(438): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagcccaccctcggtgtcagtggccccagggagggacggccaccattacctgtggtgggagaagacattgacaaaggaagagtcgtccacgtggtaaccaacaggaggccaacggcccgggccctggtggtcggtcgtctagtgaactaacagtcgaccggccctacgtcgactccctgacgcgtcttctcgtgcctccaacgtctagggaaccncggcccacctgaccatcgagcgacgggccgaaggccgggatcggacggccgtaactagttacgngaccgagggtcgtggaccgtatacgtttacctcccgtacccccggtttgggtttaccggggacccggggggtaaccaaacggtccgttacgggtaaccccgttccgttaacgggtacccaacggtaccccgaagggtccccttacccgggcccccccgttacgggtcccctaaccgtttcccgttacccggttcccccctaacccccttcccgtaccgaccgtaaccgttacgttcccgaaaccgg

SEQ ID NO: 291903 - DNA, 689 bp, Homo sapiens
  misc_feature: GYAE6OF01CDH3K.9.20.B09.1.454.CMB.1.raw
  modified_base (308)..(308): a, c, t, g, unknown or other
  misc_feature (308)..(308): n is a, c, g, or t
  modified_base (370)..(370): a, c, t, g, unknown or other
  misc_feature (370)..(370): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccacccgtcggtgtcagtcggccccagggacgggacggccaccgattacctgtggtgggagaagacattgacaaggaagagtgtccacgtggtaaccaacagaggcccgacgggcccgggccctgtggtggtcgtctatgataacngtcgaccggcctcgcgactcccgtgacgcgtcttctctacggctccaactcgtagggaaccncggcccacccgtgacccatccaggccgagggccgaagggccggggatcgggaacggccgtaacttaacgtaccgtcgaccgtagggtcggtcggactaattacgtttaccgtcccgtacccccgggttgggttcccggggaccggggggtaacccaacggccgttaccggaacccggttcccgtacgggtacccgtaaccggaccccggaacggcccgttacccggtcccccccgttcgggttcccaaccgtttccccggttacccggttccccccgccccttcccgtaccgaacgttacccgttactccggtaaccgg

SEQ ID NO: 291904 - DNA, 629 bp, Homo sapiens
  misc_feature: GYAE6OF01D78KY.9.20.B09.1.454.CMB.1.raw
  modified_base (357)..(357): a, c, t, g, unknown or other
  misc_feature (357)..(357): n is a, c, g, or t
  modified_base (428)..(428): a, c, t, g, unknown or other
  misc_feature (428)..(428): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggcccgggcccctggtggtggtcgtctatgatacaggtcgaccggcctcgtcgactccctgagcgcttctctggcctccaacgtcgtagggaaccnccggcccaccctgaacccatcaggcgacggggccgaaggccggggaatggacggtccgaacgttattacgngccgaggtcgtaggctatacttactccgtacccccggtgggttaccggggacgggggtacccaacggtccgtacggacccggttccgtaacgggtcccaacggccccgaaacggcccgtaccggtccccccgtcggtaccctaccgttcccttccgttccccccaccccgttccctaccaacggtacctcgtccgtaccgg

SEQ ID NO: 291905 - DNA, 654 bp, Homo sapiens
  misc_feature: GYAE6OF01E5C6R.9.20.B09.1.454.CMB.1.raw
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagcccaccctcggtgtcagtcggccccgagggacggggaccggccaccattacctggtggtgggagaagacattgacaaggagagtgtaccacgtggtaccaacaggacggccgaggcccgggccctggtggtcggtcgtctagtgaataacgagtcggacccggccctcggtcgactcccgtgacgcgtcttctcgtcggcctccaactcgtagggaaccacggcccacatcgaccatcgagcgagggacccgaaggccggggatcgggacggcccgtaacttacgttacgtggacccgtagggtggtcggactaattactttacgtccccgtaccccgggttgggttcccgggggacgggggaccacggtccgtcgacccgttacgtacggtacgacccggtaccgacgggcctcccggtcccccgttcggcccttaccgtcccgtttacccgtcccccctaccccttccaccgtaccggtacgtctacccg

SEQ ID NO: 291906 - DNA, 561 bp, Homo sapiens
  misc_feature: GYAE6OF01CIUWN.9.20.B09.1.454.CMB.1.raw
  modified_base (437)..(437): a, c, t, g, unknown or other
  misc_feature (437)..(437): n is a, c, g, or t
  modified_base (447)..(447): a, c, t, g, unknown or other
  misc_feature (447)..(447): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagcccaccctcggtgtcagtcggccccaggagggacggccaccattacctgtgtgggagaagacattgcaaggaagagtgccactggtaccaaacgaggaggcccgagggcccgggcccctggtggtggtcgtctatgataacagtcgaccggccctcgtcgactcccgtgacgtccgtctttccgtctggcctcccaactccgtaggggaaccacgggcccacccgtgaccatcgacgcgacgggccgaaggccggggatggacgcgactattacngccgaggtgngcatatctcgtaccccggtggtcgggcggggacacgcgtgaccgtcgagtcgacgccagcctcgccccgtcgtacacctctccgtcccaccctcctacacgtacgtctcgtacg

SEQ ID NO: 291907 - DNA, 566 bp, Homo sapiens
  misc_feature: GYAE6OF01B5VD6.9.20.B09.1.454.CMB.1.raw
  modified_base (220)..(220): a, c, t, g, unknown or other
  misc_feature (220)..(220): n is a, c, g, or t
  modified_base (291)..(291): a, c, t, g, unknown or other
  misc_feature (291)..(291): n is a, c, g, or t
  modified_base (357)..(357): a, c, t, g, unknown or other
  misc_feature (357)..(357): n is a, c, g, or t
  modified_base (410)..(410): a, c, t, g, unknown or other
  misc_feature (410)..(410): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagcccaccctcggtgtcagtcggccccaggacgggacggccaccattacctgtgtggganaagacattgcaaggagagtgtccactggtaccaacagaggccaggcccgggccctggtggtggtcgtctangataacagtgaccggccctcgtcgatccctgacgcgtcttctctggcctccaactcgtgggaaccncggccacctgaccatcagcagggccaaggcgggatcgacggccgactattacngcaggtgtggctagtattactccaccccgtggttcggcggggaccagccgtacggaccgtcgtacggtccacgcccgaggtccctcggcccccgtcggtcctaccgtccgttccgttccccaccccttcctaccacgtaccgtacgtccgtaaccg

SEQ ID NO: 291908 - DNA, 847 bp, Homo sapiens
  misc_feature: GYAE6OF01CXTFL.9.20.B09.1.454.CMB.1.raw
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatcgacctcacatgtgctgactcacgcccacccgtggtcgtcgacggtcggccccgagggacgggaccggccacctattaccgtggtggtagggaagaagacagttgacgaagggaagtagtcgtaccacgtacggtaaccaacgaggacggaccgacgggcccggccctggtcggtggtccgtctagtacgaacgtaacgacggtacgacccggtcccgttcggtaccgtaccgtccccgtagaccggtccggttcctttccgtccgtcggtacccttacccgtaaccgttccgggtaccggggaaaccctacccgggacccccgtaacccgttacggaaccctacgtaccggaacggacccggaaaccgggggcccggaaacgggggccgggtaacggtacgggaaccgggaccgttaaccgtacgtttaccgcggtaccgtagggttcgtacggtactaagttaccgtttacccgtaccccgggttaccccgggttacggggttacccgggggtacccgggggtaaccctacgggtacccggttacccggtaccccgggttaccggttaaccggtaccggtaaccccggtaccgtaaacccgggtccctaccccgggtcccccgttcccgggtaccttacccgtcccgtttcccggttacccccctacccgtccgttacccgaagtacccgttacgccgtaccggg

SEQ ID NO: 291909 - DNA, 693 bp, Homo sapiens
  misc_feature: GYAE6OF01BW6U8.9.20.B09.1.454.CMB.1.raw
  modified_base (318)..(318): a, c, t, g, unknown or other
  misc_feature (318)..(318): n is a, c, g, or t
  modified_base (392)..(392): a, c, t, g, unknown or other
  misc_feature (392)..(392): n is a, c, g, or t
  modified_base (482)..(482): a, c, t, g, unknown or other
  misc_feature (482)..(482): n is a, c, g, or t
tcagtgatacgtctcacgaccggtgctcgatttagtgtagtgtgaaggggctggggcctaaggaagcagcacctggtggtgcctcagccgatggcctggaccgttcgtcctcctcggcctcctctctcactgcacaggatctatgacctcacatgtgctgactcagcccacccgtcggtgtcagtcggccccgagggacgggacgccaccattacctgtgtgggagaagactattgacaaggaagagtgtccagtcggtaaccaacgaggacggccgacgggcccggcccctggtggtggtacgtctatggataacgngtcgacccggcctcgtcgactcccgtgacgcgtccgtttctccgtaggcctaccaaccgtcgtacgggaaaccncggacccctaccctgacccataccgagccgacgggaccggtaagggcccggggatacggacggacccgtaacgttacttacgtcgaccgngggttcgtaggcctagtttacttacgtccccgtacccccggttgggttacccggggaccgggggaaccacggtccgtacgggtaccccgttccgaacggtcccgaccgtacccgaaggtcccgtacccggcccccggttccgtacctacccgttcccggtcccttacccccggtcccctcccgttaccgaggtacccttagtcccgtacgg

SEQ ID NO: 291910 - DNA, 518 bp, Homo sapiens
  misc_feature: GYAE6OF01ERFP0.9.20.B09.1.454.CMB.1.raw
  modified_base (493)..(493): a, c, t, g, unknown or other
  misc_feature (493)..(493): n is a, c, g, or t
  modified_base (499)..(499): a, c, t, g, unknown or other
  misc_feature (499)..(499): n is a, c, g, or t
  modified_base (509)..(509): a, c, t, g, unknown or other
  misc_feature (509)..(509): n is a, c, g, or t
  modified_base (511)..(511): a, c, t, g, unknown or other
  misc_feature (511)..(511): n is a, c, g, or t
tcagtgatacgtctcacgaccggtgctcgatttagtgtagtgtgaagggggcctaaggaagcagcactggtggtgcctcagccatggcctggaccgttctcctcctcggcctcctctctcactgcacaggatctatgacctcacatgtgctgactcagccaccctcggtgtcagtggccccagggagggacggccaccattacctgtgtgggagaagacattgcaaggaagagtgtccactggtaccaacagaggccaggccgggcccctgtggtggtcgtctatgataacagtgaccggcctcgtcgatccctgagcgcttctctggctccaactctgggaacacggccaccctgaccatcagcagggccgaagccggggatgaggccgactattactgccaggtgtggcatattatcaccccgtgttccggcgggggacaagcgtgaccgtctagtcagcccaaggctcgcccctgtccactctcgtcccncctccnctacgactancngtgacgg

SEQ ID NO: 291911 - DNA, 749 bp, Homo sapiens
  misc_feature: GYAE6OF01D4F2R.9.20.B09.1.454.CMB.1.raw
  modified_base (175)..(175): a, c, t, g, unknown or other
  misc_feature (175)..(175): n is a, c, g, or t
  modified_base (337)..(337): a, c, t, g, unknown or other
  misc_feature (337)..(337): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagcccaccctcggtntcagtcggccccagggagggacggccaccattacctgtgtgggagaagacattgacaaggaagagtgtccactggtaccaacagaggccaggcccgggccctggtggtggtcgtctatgataacagtcgaccggccctcgtcgactccctgacgcgtcttcncgtcgcctccaactcgtagggaaccaccggacccaacccgtcgaacccacgtacgacggccggaacggggacccggaacgggacccggggacgtacgggaaccgggaccccgtaacgttaacgtttaccgtcggaacccggtagggttcggtacggtacctacgttaactttaacgtccccgtacccccgggtttcgggttacccgggggaccggggggtaacccgaacggtccgtaccgggtaacccggttcccggttaacgggtaccaccggtaccccggtaaccggcccgttaccccggccccccgttccgggttaccctaccggtttccccttacccggtttaccccccccgtaaccccgtttcccccgttaaccgaccggttaacccgttacgtacccgtaaccggg

SEQ ID NO: 291912 - DNA, 577 bp, Homo sapiens
  misc_feature: GYAE6OF01E5AW9.9.20.B09.1.454.CMB.1.raw
  modified_base (300)..(300): a, c, t, g, unknown or other
  misc_feature (300)..(300): n is a, c, g, or t
  modified_base (334)..(334): a, c, t, g, unknown or other
  misc_feature (334)..(334): n is a, c, g, or t
  modified_base (418)..(418): a, c, t, g, unknown or other
  misc_feature (418)..(418): n is a, c, g, or t
  modified_base (570)..(570): a, c, t, g, unknown or other
  misc_feature (570)..(570): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagcccaccctcggtgtcagtggccccaggagggacggccaccattacctgtgtgggagaagacattgcaaaggaagagtgtccactggtaaccaacagaggccagggcccgggcccctgtggtggtcgtctatgataacngtgaccggccctcgtcgactccctgagcgcttcnctggcctccaactctagggaacacggcccacccgtgaccatcagcgacgggccgaaggccggggatggacggccgactattacngcctaggtgtgctatacttatccacccccgtggttcggggcgggggaaccgaggcgtacggacccgtccgtacggtacgacgccgaacggccgtcccgcccccgtcggtcctaccgtccgtccgttcccccgcccttccctcgacgacgttnccgtacg

SEQ ID NO: 291913 - DNA, 627 bp, Homo sapiens
  misc_feature: GYAE6OF01AJ25N.9.20.B09.1.454.CMB.1.raw
  modified_base (300)..(300): a, c, t, g, unknown or other
  misc_feature (300)..(300): n is a, c, g, or t
  modified_base (444)..(444): a, c, t, g, unknown or other
  misc_feature (444)..(444): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtcggccccagggacgggacggccaccattacctgtgtgggagaagacattgcaaggagagtgtccacgtggtaccaacagaggccagggcccggccctggtggtcggtcgtctatgataacngtcgaccgcctcgtcgactccctgacgcgtcttctcgtcggctcccaactcgtacgggaaaaccggcccaccgtcacctatccgagtcgacgggtacgacgggccggggatggacggccgtagtacttacgtgtcgaggttggngggtctggtgaatagtgatctagtcgggtcgggggttgtccggggacgggaacggaccgaacggcgtaccggacccgttaccgtaacgtccgaccggcccgaagggtcccgtacccggtcccccccgtaggtcccctaccgttccccgttacccgtttccccccaccccggtttccctaccgg

SEQ ID NO: 291914 - DNA, 801 bp, Homo sapiens
  misc_feature: GYAE6OF01A8GI7.9.20.B09.1.454.CMB.1.raw
  modified_base (625)..(625): a, c, t, g, unknown or other
  misc_feature (625)..(625): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcacgcccacccgtcggtcgtcacggtcggccccgagggacgggaccggccaccgtatttaccgtggtggtagggagaagacagttcgacgaagggaagtagtcgtaccacgttacggtaacccaacggaaggacggacccgaacggggcccccgggtaccccgttggttcggggttacggttccggttacttacggtaggtaaaccttaaacggacggtacccggaaccccggtccccttacgggtaccgtaaccgttccccgtaggaaccgtccgtttccgtttccgtccgttcggacccttaacccgtaaacgtttcggggtaaccggggaacccacccggggtaacccctaaaccgttcggaaacccctacgtaccgaacggacccgggaacggggaaccccgggtagggacccgggtagtacgggaacgtaccgtacttaacgtccgtacgcggtaggtcgnggtacagtttactcgttcccgacccggttcgggttcggggaccgggtaacctaggtaccggtaccgtaccgtccgtaggaccaccggtccgaacgttcccgacccgtccccggtcgtacctcccgttacttccccgtccctaccctacccgtacgaaggttacctcgccgtaccgg

SEQ ID NO: 291915 - DNA, 733 bp, Homo sapiens
  misc_feature: GYAE6OF01CCAB5.9.20.B09.1.454.CMB.1.raw
  modified_base (260)..(260): a, c, t, g, unknown or other
  misc_feature (260)..(260): n is a, c, g, or t
  modified_base (688)..(688): a, c, t, g, unknown or other
  misc_feature (688)..(688): n is a, c, g, or t
tcagtgatacgtctcacgaccggtgctcgatttagtgtagtgtgaaggggctgggcctaaggaagcagcactggtggtgcctcagcccatggcctggaccgttctcctcctcggcctcctctctcactgccacaggatctatgacctcacatgtgctgactcagccaccctcggtgtcagtcggccccagggacgggcgccacctattaccctgtgtgggagaagacattgctaaggagagtcgccacgtggtaccaacncgacggccacgggcccggccctggtaggtggtcgtctatgaactacagtcgacccggtcctcgtcgactccctgacgtcctcttcctcgtcggccttccaacgttcgtagggaaccctaccgggcccctaacccgcgaccacgtccaggccgacgggaccgacgggccgggtagtacggacggtcccgacgttacgttaccgtacgtacccgtagggtcggtacggtacgtaacttacgttaccctaccccggttaacccccgggttcgggtttacccgggggacccgggggggtaaccctaacgggtcccgtaaccggtacccgggtttacccgttacgggtacccgtaccggaccccgtaacgggtcccgtaccccggtcccccggttccggtccctacccgttcccgttccccggttaccccccnccccgttccctacccgtaaccgtaccgttaccgtacccgtaccgg

SEQ ID NO: 291916 - DNA, 703 bp, Homo sapiens
  misc_feature: GYAE6OF01DGGRY.9.20.B09.1.454.CMB.1.raw
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtcggccccagggagggacggccaccgattacctgtggtgggagaagactattgacgaagggaagagtcgtccacgtaggtaaccaacgaagacggccagggcccggggccccttggtcggtgtcggtctagtgaataacgagtcgacccggccctcgcgatcccctgacgcgtccttcgtctcggcctccaacgtcgtacgggaactaccggacccacccgtgacccatcgaacggcgacgggtacccggaacgggtccggggaatcgggaacgggaccgaaacgttacttacgcggtaccgtagggttcgtacgggactagttaacttactacccgtacccccggttggtttccggggaccggggggtacctaacgggtccgtacggacccggttaccgttaacgggtccgacggaccccgaacggtcccgtaccggtccccccgtacggtacccctacgtcccgttacccggtttaccccccacccgttcccgaaccgtaccgtaacggtacctccgtaacgg

SEQ ID NO: 291917 - DNA, 813 bp, Homo sapiens
  misc_feature: GYAE6OF01C9QYF.9.20.B09.1.454.CMB.1.raw
  modified_base (328)..(328): a, c, t, g, unknown or other
  misc_feature (328)..(328): n is a, c, g, or t
tcagtgatacgtctcacgaccggtgctcgatttagtgtagtgtgaagggggcctaaggaagcagcactggtggtgcctcagccatggcctggaccgttctcctcctcggcctcctctctcactgcacaggatctatgacctcacatgtgctgactcagcccaccctcggtgtcagtcggcccgagggacgggaccggccaaccattacctggtggtgggaagaaagactagttagacaaagggaagagtcgtaccacgtaggtaaccaaacaggacggaccgagggcccgggccccgtgtgggtcggtcgtactaatggaataaacgnggtacgacccggtccctcgtaccgtacgtcccctggacgccgtcttcgtcgtcggacctaccaaacgtcggtacgggaaacccaccggaccccaaccgtacgaacccaatccgaacggcccggtaaacgggggaccccggaaaaggggtaccccggggggtattaacggggaaccggtacccggtaactttaacgttaacgtacggacccgtaagggtcggttaggaactaagtttaacgttaacgttaccccgtaccccccgggttgggtttacccgggggaccgggggggaaaccctaacgggtacccgtaccgggaaccccggttaccgttaaccgggtaccgaaccggtaccccggtaaagggtccccgtaccccggttcccccccgttacggtaccccgttaaccgttcccgttcccggttaccccccgtcccccttacccgtaccgtaacggaaccttacgactaccggtcggaacggg

SEQ ID NO: 291918 - DNA, 822 bp, Homo sapiens
  misc_feature: GYAE6OF01CY4F5.9.20.B09.1.454.CMB.1.raw
  modified_base (330)..(330): a, c, t, g, unknown or other
  misc_feature (330)..(330): n is a, c, g, or t
  modified_base (420)..(420): a, c, t, g, unknown or other
  misc_feature (420)..(420): n is a, c, g, or t
  modified_base (803)..(803): a, c, t, g, unknown or other
  misc_feature (803)..(803): n is a, c, g, or t
tcagtgatacgtctcacgaccggtgctcgatttagtgtagtgtgaagggggcctaaggaagcagcactggtggtgcctcagccatggcctggaccgttctcctcctcggcctcctctctcactgcacaggatctatgacctcacatgtgctgactcacgcccacccgtcggtgtcagtcggccccgagggacgggaccggccacctattacctgtggtagggaagaagacattgacgaaagggaagacgtcgtcctaacgtcggtaaccaaacgaggacggccgacgggcccgggtcccgtggtcggtcggtcgtatagtgaactaacgnggtcgacccggtcctcgtcgactcccgtgagccgtcttactcgtcggtcctaccaacgtcggtacgggaaaccgtccggaccctaacccncgaccactacgacgaccggacgggaccgaaacggggtcccggggaagtcggaacgggtccctaacgttaacgtttaccgtccggaccgtaagggttcggtacggtacctaagtttaaccgttaacccttccccggtaaccccccgggggtttgggtttaccccgggggggaaccgggggttaaacccgaaacgggtccccgttaccgggtaaaccccggtttacccggtaaccgggtacccgtaacccggtaaccccgggaacggggttccctacccccgggttccccccgttaccggtcccgtaaccccgtttccggtaccccggttttccccccgacccccgtttcccgtaacccgtaacccgttaccgttacctcccggngggttacccgggcccgggg

SEQ ID NO: 291919 - DNA, 731 bp, Homo sapiens
  misc_feature: GYAE6OF01B49DI.9.20.B09.1.454.CMB.1.raw
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagcccaccctcggtgtcaggtcggccccgaggacgggaccggccacctattaccgtgtggtagggagaagacattgacaaggaagagtgtccacgtggtaaccaacgaggacggccgaggcccgggccctggtcggtggtcgtctatgaataacgaggtcgacccggtccctcggtacgactcccgtgacgtccgtcttctcgtcggcctaccaactcgtacggggaaccaccggcccacccgtcgaacccagtcgacggacgaacggggacccgaaggggcccgggatacgggacggccgtaacttacgttacgtcgtacacggtcgttgggtcggtactttctacgtagttagggtacgttaggggtaagggttacgggggtaactttccgggttacggggacgggtaacgggaccggtacggtaccgtaccggtacccgtaaccgtaaacgggttccgaaccggtaccccggtaaacgggtccccgttacccggtcccccccggtttacgggttaccctaacccgttttcccgttaccccgggtttccccccgtccccgttaccccgg

SEQ ID NO: 291920 - DNA, 628 bp, Homo sapiens
  misc_feature: GYAE6OF01APY0G.9.20.B09.1.454.CMB.1.raw
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccagggagggacggccaccattacctgtgtgggagaagacattgacaaggagagtgtccactggtaaccaacaggacggccgacgggcccgggcccctggtgggtggtcgtctatgataacgagtcgaccggcctcgtcgactcctgacgcgtcttctcgtggcctcacgtcgtagggaaccgaccggcccaccctcgacccatccgagcgacggggccgaacgggccgggagtcgacggaccgactactacgtcgccgtaggtgtggtactataacgttcgtcccgtaccccgggttggttcccggggacgggggaacctaggccgtacggacccgtccggtacggtccgacggtcccgaaggtccctccggcccccgttcgcccgtaccgttccgttcccggttccccgtccccgtacctccgtacgaccgttacgccgtacg

SEQ ID NO: 291921 - DNA, 800 bp, Homo sapiens
  misc_feature: GYAE6OF01BOZCL.9.20.B09.1.454.CMB.1.raw
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtcggccccagggacgggaccggccaccattacctggtgtgggagaagacattgacaagggaagagtgtaccaacgttcggtaaccaacgaggacggcccgacgggtcccgggcccctggtcggggttcggttccgtccgttagtacggtaataaccgaggttacggaccccggtccccgttcggtaccggtaccttccccgtaggacggtccgtccgtttccgtcgtcggtccttaccgaaaccttcgtacggggaaacctacccgggccccaaccccgttacgaacccacgtccaacggaccgacggggacccggaaacggggcccggggaagtcgggaaccgggtacccgtaacgttaacgttaccgtcgtaccgagggttggtcgggtaactacgttaacttaccgtacccgtacccccggttgggttacccggggaccgggggtaccgtaaacgggccgttaccggtacccggttacccgttacgggtacccgtaccggaaccccgtacggtcccgtacccggtcccccccgtcggtacccgtacccgttcccgttacccgttccccccaacccgtttccccaaccgtaaccgtaccgttaccgtccgtaaacccggg

SEQ ID NO: 291922 - DNA, 711 bp, Homo sapiens
  misc_feature: GYAE6OF01C470A.9.20.B09.1.454.CMB.1.raw
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagcccaccctcggtgtcagtcggccccgaggagggacggccaccattacctgtgtgggagaagacattgacgaaggaagagtgtccactggtaccaacagaggccgacggccgggcccctggtcggtggtcgtctatgataacagtcggaccggcccgtcgtccgactcccgtgacgcgtcttctctcggccttcccaacgttccgtacggggaaccgacccgggtacccaccccgtacggaacccacgtaccgacggacccggaacgggggacccgggaacggggacccggggagtacgggaacgggccccggtaacgttacgtttacgtcggtccgtagggttgtcggtactagttaacgtttacctcccgtaacccccgggttcgggttaccgggggaccgggggacccgtaacggtccgtacggacccgttcccggtacggttcgaccggaccccgtaacggtccgtaccgccccccgtcgggtcccttacccggtccttcccgtcccccgtccccgttccgtcctaccgacgtaccgtcgtaaccg

SEQ ID NO: 291923 - DNA, 820 bp, Homo sapiens
  misc_feature: GYAE6OF01EBLZ1.9.20.B09.1.454.CMB.1.raw
  modified_base (806)..(806): a, c, t, g, unknown or other
  misc_feature (806)..(806): n is a, c, g, or t
tcagtgatacgtctcacgaccggtgctcgatttagtgtagtgtgaagggctgggcctaaggaagcagcactggtggtgcctcagccatggcctggaccgttctcctcctcggcctcctctctcactgcacaggatctatcgacctcacatgtgctgactcacgcccacccgtcggtgtcgacggtccggaccccgagggacgggaccggcccaacctatttaccgtggtggtagggaagaacgactagttagacgaaaggaagtaggttcgtacctacgttacggtaaaccaaacgaggaccggacccggaccgggcccccgggtcccgttgggtcgggtttccgtaccctaccacgttaccgtaattaccgtacggaccccggaacccccggtcccgtacggacgggtacccttcccgtaggacgtccgttaacgtttcccgacggtaccgtccttaaccccgaacgttacccggggtaaaacgggaaaaccccgccctaccccggtacgaacccgtagtacccgacggaccggacggggtaacggaacggggaccggggagttacgggaccggtaccgtaacttacgtttacggtcggtaggtacgggttgggttacgggtacgttagggtaagtattaggtacgtacgttacggcggttcgggggtcgggggttccggtaggggaccggggtaacggacaaccggtccgttacggtaccggtaccgtacgccgaaccggcccgtaccggcccgtccccgtcccccgtggttaaccctcccgtttcccgaccccgttacccccnccgttccgacccgg

SEQ ID NO: 291924 - DNA, 848 bp, Homo sapiens
  misc_feature: GYAE6OF01DQCE5.9.20.B09.1.454.CMB.1.raw
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatcgacctcacatgtgctgactcacgcccacccgtcggtgtcacggtcggcccgagggacgggaccgaccaacctacttaccgtggtggtagggaagaacgactagttacggaacgaaaggaagtacggtcgtaccgaacgttacggtaaaccaaacggacggaacggcccggaacggggccccggtcccgttgggtcgggtcgttccgtacgtaagtcgaagtaacgacggttccgacccggtcctaccggtacgtaccgtaccgaggcgtccgtccgtttcgaccgttcggacccttacccgtaactcgggtaaccggaacccggtacccggaccctaacccggacgaaaccccgtagtaacccggacggtaccgggaacggggacccgggtaacggggaccggggacgttaacggggaccggtacccgttaaacgttaacggttaccgtaccggacggttacgggttacgtacggttaactaaacgttttacgtttaacccgtcccccggtaaccggggtttccggggtaaccgggggaaccgggtaaccgttaacggaccggttacccggtacccgttacggttaccgtaccggaacccggtaccgtaccgtcccggtacccgtcccccgtaagtccccgtccgttcccgttcccggtcccccctttacccgtaccgcccgttaacggcctttacgccgtaacggg

SEQ ID NO: 291925 - DNA, 865 bp, Homo sapiens
  misc_feature: GYAE6OF01C1YZL.9.20.B09.1.454.CMB.1.raw
  modified_base (176)..(176): a, c, t, g, unknown or other
  misc_feature (176)..(176): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatcgacctcacatgtgctgactcacgcccaccctggtntcgagtcggccccgagggacgggaccgccacctattaccgtggtggtagggaagaaacgactagttagacgaaagggaagtagtacgtaccacgtaggtaaacccaacgaaggacggaccgtaacgggccccgggtcccctgggtcgggtcggtcgtactagtagaacttaacaggtccggacccggtcctcggtcgactcccgtgacgtcgtccttctcgtcggtcctactaacgtcgtaacggggaacctacccggaccctacccgtgaaccctagtaccgaacggacgaccggggacccgtaacggggaccggggtaactcggggaaccggtacccgttaacgttaaaccgtttaccgtacgggacccggtaagggttcgtaccgggaaccttaacgtaacgttttacccgtaccccgggttacccccgggtttcggggtttaccggggggaacccgggggtaaccctaacggtccggttaccggtaacccgggttccgtttaacggtacccgaaccgggtaacccccggtaacgggtccccgttaccccgggtaccccccccggtttcgggttaccccgttacccctttccccgggtttacccccggttttacccccccggaccccttttccccggaaacggtaccccgggttaaaccgttaaccgttccccggttaaaacgggg

SEQ ID NO: 291926 - DNA, 690 bp, Homo sapiens
  misc_feature: GYAE6OF01EV0N4.9.20.B09.1.454.CMB.1.raw
  modified_base (220)..(220): a, c, t, g, unknown or other
  misc_feature (220)..(220): n is a, c, g, or t
  modified_base (309)..(309): a, c, t, g, unknown or other
  misc_feature (309)..(309): n is a, c, g, or t
  modified_base (373)..(373): a, c, t, g, unknown or other
  misc_feature (373)..(373): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagcccaccctcggtgtcagtcggccccgaggagggacggccaccattacctgtgtggganaagacattgacaaggagagtgtccacgtggtaaccaacgagacggccgacgggcccgggccctggtggtcggtcgtctagtgataacgngtcgacccggcctcgtcgactcccgtgacgcgtcttctcgtcggctcctaactcgacggaaccncgcccacctgaccatcacgcgacgggaccgaacgggcgggatcggacggcccgtaactagttacgcgaccgtagggtcgtacggactagttacttaccgtcccgtacccccggttgggttacccgggggccgggggtaaccaacggccgttaccgggtaccccggttaccgtaccgggaccgtaaccggacccgtaacgggtccccgttaccccggtaccccccggttcggttacccttacccgttcccgttacccccgtttaccccccaacccccgttcccgtaccgaaccggtaccgttaacgtcccgtaacggg

SEQ ID NO: 291927 - DNA, 778 bp, Homo sapiens
  misc_feature: GYAE6OF01DJQQL.9.20.B09.1.454.CMB.1.raw
  modified_base (209)..(209): a, c, t, g, unknown or other
  misc_feature (209)..(209): n is a, c, g, or t
tcagtgatacgtctcacgaccggtgctcgatttagtgtagtgtgaggggaaagggcctgtgaaggcttcactagtcctggacctcctgtgcaaagaacatgaaacatctgtggttcatccctcctcctgggtggcagctcccagatgggtcctgtccccaggtgcggctgcaggagtccgggcccaggactaggtgaagcccttcaacncggccctgtcccctcacctgaccactcgtctcgtggtcgtacctccatacgaaggtagggttcggttccgtttaccctacgtcgggtacctgggaaccgtcccggcgaacggttccccggaccgggtacggaaacgggggtaccttagggggaacgttaagtttaacggttacgggaacgtaaacttcgtaacgtcggaacccgtaagggtccgggaaccccgcctaattacccgtaaccaaccccgttcctacgaaacggtacgtacgtacgtacgacgtcctaagtcggtacctaggtacccaacgtacccgtacccgaacgtaaccctacggttccctacccgtacgaacgtacgtaggtaatttagtacgtacgaaccccggcgtaccgaagtacccgtacggtccgtagttacttaacggtgtacgacggtaagtacggaccggttacgttttaaggttaaccggacctagtaaccgtttaaacgttaaacccttccgttaaacgtcgttacggtaacggtcggttacgggacgggggtaccgaacggggtacccgtaaccggg

SEQ ID NO: 291928 - DNA, 935 bp, Homo sapiens
  misc_feature: GYAE6OF01DNBPF.9.20.B09.1.454.CMB.1.raw
  modified_base (145)..(145): a, c, t, g, unknown or other
  misc_feature (145)..(145): n is a, c, g, or t
  modified_base (173)..(173): a, c, t, g, unknown or other
  misc_feature (173)..(173): n is a, c, g, or t
  modified_base (216)..(216): a, c, t, g, unknown or other
  misc_feature (216)..(216): n is a, c, g, or t
tcagtgatacgtctcacgaccggtgctcgatttagtgtagtgtgaagggctgggcctaaggaagcagcactggtggtgcctcagccatggcctggaccgttctcctcctcggcctcctctctcactgcacaggatctatgacctnacatgtgctgactcagcccacctcggtntcgagtcggccccagggacgggacggccaaccgatttacccgnggttggtaggggaacgaaagtacctagttgacgaaagggaagtagtcgtaccagtacggttaacccaacgtaggaccggccgacggggccccgggtccccttggtcgggttcggttccggttacctagttagaacttaaaccgagggttcgaaccccggcccttacggtccgacttcccctggacgtccgtaccttcgtcgtcggcctacccgaaactcggtacgggaaccacccgggccctaaccccgtcgaaccccgagttacccgacgtaccggggaaccggggaccccgggtaacggggccccggggggtaactaccggggtaaacccgggggtaccccgtaaaccgtttaacggtttaaccccggaccgggtaacccggtaacgggggtttccggtaaccgggtaccgttaaacgttacgttttaaccccgtaccccgggttaacccccccggggtttcgggggtttacccgggggggaaccccggggggttaaccctaacccgggtccgtttaaccccgggtaccccggtttaacccggttacgggtttaccccgaacccgggttaacccccgtaaacggggtcccccgttaaccccggcccccccggtttacgggttacccccttaacccggtttcccgttaccccggtttaccccccacccccgtttacccaaccgttaccggttaaccgttacgttacccgttaacccgg

SEQ ID NO: 291929 - DNA, 714 bp, Homo sapiens
  misc_feature: GYAE6OF01BQ99Q.9.20.B09.1.454.CMB.1.raw
  modified_base (305)..(305): a, c, t, g, unknown or other
  misc_feature (305)..(305): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtcggccccgaggacgggacggccaccattacctgtggtgggagaagacattgacaaggagagtgtccactggtaccaacagacggccacggcccgggcccctggtggtcggtcgtctatgataacgngtcgaccggccctgcgactccctgacgcgtcttctctcggcctcccaactcgtacgggaaccaccggcccaccctcgaccctatacgaacggtacgggacccggaagggccgggggtagtacggaccgggaccgtaacttaacgtttaccgtcggccgtaaggggttcgtacgggacctaagtttaactttaccgtcccctaacccccgggttgggtttaccccggggggaccgggggtaaaccctacgggtcccgtaccgggtaccccgttaccggttacggtaccgacggaccccgaacgggtcccgtacccggccccccgttcgggtccttaacccgttccgttacccggttcccccgtccccgttacccgtcgtaaccgtaaccgttctccgtaacggtaccggg

SEQ ID NO: 291930 - DNA, 761 bp, Homo sapiens
  misc_feature: GYAE6OF01E2HIF.9.20.B09.1.454.CMB.1.raw
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcacgcccacccgtcggtcgtcagtcggccccgagggacggggaccggccaccgattacctggtggtgggagaagactagttgacgaaaggaagagtcgtaccacgtacggtaaccaacgaggacggacccgaacgggcccccggggacccccgtgggttgggtcgggttccggtccgttattaggaagtaaacgaggtcggacccggtccccgttccggtaccgacttccccgtggacgccgtcctttcgtcgtcgcctaccaacgttcgtacgggaaccaccggccctaaccctcgaccactccgaggccggacgggaccggaacggggccgggagtcggacgggaccgtaacttacgttaccgtcggaccggtagggttcgtacgggtactaagtttacttaccgtcccggtacccccggtttcgggtaccgggggacccgggggaaccgaccggtccggtaccgtacccggtaccgttacggtaccgaccggacccgacgggtccctccccggtccccggtcggtaccctaccgttcccgttccccggttccccctccccgttcccgtaccgtaacggtacccttacgtccgtaccggg

SEQ ID NO: 291931 - DNA, 796 bp, Homo sapiens
  misc_feature: GYAE6OF01CY8EN.9.20.B09.1.454.CMB.1.raw
tcagtgatacgtctcacgaccggtgctcgatttagtgtagtgtgaagggggcctaaggaagcagcactggtggtgcctcagccatggcctggaccgttctcctcctcggcctcctctctcactgcacaggatctatcgacctcacatgtgctgactcacgcccacccgtcggtgtcaggtcggcccgagggacgggaccggccaacctattaccgtggtggtagggaagaagtactagttagacgaaaggaagagtcgtaccacgtacggtaaccaacgaggacggaccgacgggcccgggtcccgtggttcgggtcggttcgtactagtagtaataacggacggtaccggacccggtccctacacgtccgaccttcccgtagacgtccgtcctttcgtcgtcggtcctaccgtaccgttacgtacggggaaccacccggaccctaacccgtaccgaacctacgtaccgaacggaccggaacggggacccggtaacggggccggggtacgtacgggaacgggaccttaacgttacgtaccgttcgaaccggtggtttcggacgtcttaaacttacgtttacccgtaccccggttacccccgggttagggttacccgggggaccgggggtaacctacgggcccggttacggtaccccgttaccgtacggtaccgaccgaccgtaccggtccctccccggtaccccgtacggtccctacccgttcccgtttccccgttcccccccgtaccttaccccgttacggaaacgttaccgttaacgtcccgtcgggtacgggg

SEQ ID NO: 291932 - DNA, 670 bp, Homo sapiens
  misc_feature: GYAE6OF01ECVRR.9.20.B09.1.454.CMB.1.raw
  modified_base (314)..(314): a, c, t, g, unknown or other
  misc_feature (314)..(314): n is a, c, g, or t
  modified_base (356)..(356): a, c, t, g, unknown or other
  misc_feature (356)..(356): n is a, c, g, or t
  modified_base (380)..(380): a, c, t, g, unknown or other
  misc_feature (380)..(380): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtcggccccagggagggacggccaccattacctggtggtgggagaagacattgacaaaggagagtgtccactaggtaaccaaacgaggacggccgacgggcccgggcccttggtggtcggtcgtctatgaataacgnggtcgacccggtcctcgtcgactccctgacgcgtcttcgtcnggcctaccaactcgtagggaaccncggccaccctgaccatcaggcgacgggaccgaagggcgggagtcggacggaccgtacttaacgttacgcggaccgtagggttggtcgactagttacttaccgttcccgtacccccggttgggttaccggggaccgggggtacccaacggtccgtacggtacccgtacgttacgggaccgtaccggcccgtaaccggtccgtcccggtcccccgttcggtaccctaccgttcccgttccccggttccccctaccccgtcccgtacccgtacggtaccgttctcgtaaccgg

SEQ ID NO: 291933 - DNA, 566 bp, Homo sapiens
  misc_feature: GYAE6OF01ETY68.9.20.B09.1.454.CMB.1.raw
  modified_base (301)..(301): a, c, t, g, unknown or other
  misc_feature (301)..(301): n is a, c, g, or t
  modified_base (363)..(363): a, c, t, g, unknown or other
  misc_feature (363)..(363): n is a, c, g, or t
  modified_base (377)..(377): a, c, t, g, unknown or other
  misc_feature (377)..(377): n is a, c, g, or t
  modified_base (412)..(412): a, c, t, g, unknown or other
  misc_feature (412)..(412): n is a, c, g, or t
  modified_base (422)..(422): a, c, t, g, unknown or other
  misc_feature (422)..(422): n is a, c, g, or t
  modified_base (428)..(428): a, c, t, g, unknown or other
  misc_feature (428)..(428): n is a, c, g, or t
tcagtgatacgtctcacgaccggtgctcgatttagtgtagtgtgaagggggcctaaggaagcagcactggtggtgcctcagccatgggcctggaccgttctcctcctcggcctcctctctcactgcacaggatctatgacctcacatgtgctgactcagccaccctggtgtcagtggcccagggagggacggccaccgattacctgtgtgggagaagacattgacaaggaagagtcgtccacgtggtaccaacgagacggccagggcccgggcccctggtcggtggtcgtctatgataacngtcggacccggtccctcgtcgactcccgtgacgcgcttctctcggctccactcgtcggaacncggccacctgaccntcagcgaggcgaaggcgggatgacggccatatacngccgaggtgngctatntactccgacccggttgtccgggcggggaccaggccgtacgaccgttccgtacggtcacgcccgaaggcctccgccccgtcggtcaccttccgtccgttccccgccctcgtaccgtacgactatccgacgtcggacggg

SEQ ID NO: 291934 - DNA, 808 bp, Homo sapiens
  misc_feature: GYAE6OF01AEJH5.9.20.B09.1.454.CMB.1.raw
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatcgacctcacatgtcgctcgactcacgcccacccgtcggtcgtcgaggtccggacccgagggacgggaccggccacctacttaccgtggtggtagggaagaacgactagttaggacgaaagggacgagtcgtaccacgttacggaaccaacgacggacggcccgacgggcccggtcccgtggtcggtcggtcgtacgtatacgtaagtaacgtacggtccggaccccggtcccgtcggtaccgtactccccgtaggaccgtcgttccttcgtccgtcggtcctacgtacgtcggtaacggaaccgtccggaccctaccgtacgaccacgtccgaacggaccgggacgggaccggaacggggtccgggtaagtccgggtaaccggaccgttaaccgttacggtaccgtaccgggtcggtaacgggttggtacgtacgttaaactttcgtacccgtacccccggttaccgggttcgggtaccgggggacggtaaccctacggtccgttacccgggacccgttcggaaccgtaccggaccgtacccgtacgggtccccgtaccccggtccccggtttacggcccctttacccggtacccgttttaccccccgtacccctaaccccgggttaccttaccggtaaaccgggttcccttacgtcccggtaacggg

SEQ ID NO: 291935 - DNA, 621 bp, Homo sapiens
  misc_feature: GYAE6OF01CUFBI.9.20.B09.1.454.CMB.1.raw
  modified_base (216)..(216): a, c, t, g, unknown or other
  misc_feature (216)..(216): n is a, c, g, or t
  modified_base (286)..(286): a, c, t, g, unknown or other
  misc_feature (286)..(286): n is a, c, g, or t
  modified_base (355)..(355): a, c, t, g, unknown or other
  misc_feature (355)..(355): n is a, c, g, or t
  modified_base (391)..(391): a, c, t, g, unknown or other
  misc_feature (391)..(391): n is a, c, g, or t
  modified_base (407)..(407): a, c, t, g, unknown or other
  misc_feature (407)..(407): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctggtgtcagtggccccaggagggacggccaccattacctgtgtggganaagacattgcaaggaagagtgtccactggtaccaacagaggccaggccgggccctgtggtggtcgtctangataacagtcgaccggccctcggtcgatccctgacgcgtcttctctcggcctccaactccgtgggaacncggcccacctgaccatcagcagggccgagccgggangacgcgactattacgngccaggtgtggctatacttacgtcccgtaccccgtgggttccgggaccggggggaacctaacgggtccgtacgggtacccgttacccgttaacgggtccaaccggaccccggtaacgggcccgttccggacccccccgttcgggtccctaccgttcccgttcccgtttccccccaccccgttccctacgaccgtacccgttatccgtaacccgg

SEQ ID NO: 291936 - DNA, 768 bp, Homo sapiens
  misc_feature: GYAE6OF01CVHHG.9.20.B09.1.454.CMB.1.raw
tcagtgatacgtctcacgaccggtgctcgatttagtgtagtgtgaagggggcctaaaggaagcagcactggtggtgcctcagccatggcctggaccgttctcctcctcggcctcctctctcactgcacaggatctatgacctcacatgtgctgactcagccaccctcggtgtcagtggccccaggagggacggccacatacctgtgtgggagaagacattgacaaggaagagtgtccactggtaccaaacagacggccacgggccgggcccctgtgggtggtcgtctatgataacagtcgaccggccctcgtccgatccctgacgcgcttctcgtcggctccactcgtcgggaacacggcctacccgtgaccatccagcgaacgggtccgaacgggccggggatacggacggaccgtaacgttaacgttacgttcggacccgtagggttcggtcggtactagttaacgtttaacgttccccgtaacccccccgggtttcgggtttacccgggggtaacccggggggggtaacccgtaaaaccgggtccggttaaccgggtaccccggtttacccgttacggggtttacccgaaccgggtacccccgtaaagggtccccgttacccggtaccccccccggttcgggtaccccgttaacccgttcccgtttaccccggtttcccccccttaaccccccgtttccccgttaccccgtacgggtaaacccccggttacgttaaccccgtacccggttcgggaaccccggggg

SEQ ID NO: 291937 - DNA, 533 bp, Homo sapiens
  misc_feature: GYAE6OF01A2EDD.9.20.B09.1.454.CMB.1.raw
  modified_base (351)..(351): a, c, t, g, unknown or other
  misc_feature (351)..(351): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccgggcccctgtggtggtcgtctatgataacgagtgaccggccctcgtcgatccctgagcgcttctctggcctcaactctgggaaccncggcccaccctgaccatcagcagggccgaagccggggatggaggccgactatactgccaggtgtgcatatctccaccccgtgtcgggcggggaccacggctcgaccgtctacggcacgccaaggcctacggcccctggtccactcgtccgttccccaccctccctcacgtactcgtcaccgg

SEQ ID NO: 291938 - DNA, 773 bp, Homo sapiens
  misc_feature: GYAE6OF01DJ02F.9.20.B09.1.454.CMB.1.raw
  modified_base (158)..(158): a, c, t, g, unknown or other
  misc_feature (158)..(158): n is a, c, g, or t
  modified_base (191)..(191): a, c, t, g, unknown or other
  misc_feature (191)..(191): n is a, c, g, or t
  modified_base (341)..(341): a, c, t, g, unknown or other
  misc_feature (341)..(341): n is a, c, g, or t
  modified_base (730)..(730): a, c, t, g, unknown or other
  misc_feature (730)..(730): n is a, c, g, or t
  modified_base (753)..(753): a, c, t, g, unknown or other
  misc_feature (753)..(753): n is a, c, g, or t
  modified_base (765)..(765): a, c, t, g, unknown or other
  misc_feature (765)..(765): n is a, c, g, or t
tcagtgatacgtctcacgaccggtgctcgatttagtgtagtgtgaaggggctgggcctaaggaagcagcactggtggtcgcctcagccatcggcctggaccgttctcctcctcggccctcctcctctcactgcacgaggattctatcgacctcaactntggtcgctcgactccacgcccctacccgtggtntcgagggtccggacccggagggcggggacccgccaacctacgtttaccgtggtaggtaggggaacgaagattagtagacggaagggtagtacggtactccaaggtacgtaaccaacgacggacggtccggaccggggcccggttacccgnggttcgggtcggtcgttacgtatacggtaactaaccggtacggtaccgtaccccggtccgtccggtaccggtacctcccggaggtaccttccgttccttaccgtccgtacggtacccctaccgacgttacgggaccggaccgacccgtacccgacgtaccgactacgtaacgccggtacggacccggggtacggacccgggaggtacggcggaaccggtaccggtacgttacgtacggtccgtaccgggtaggttcgggcgtacttaacggttaccgtaccgttccccgggttacggtccgggggttaccggaaccggggtacaccggtaccgtccgtacgttaccgcgtacggacctccggtacgcccgtaccgtcccgtccggtacnccgtccctccctccccacctccncgactacccgtnacggtcgg

SEQ ID NO: 291939 - DNA, 730 bp, Homo sapiens
  misc_feature: GYAE6OF01AW98K.9.20.B09.1.454.CMB.1.raw
  modified_base (176)..(176): a, c, t, g, unknown or other
  misc_feature (176)..(176): n is a, c, g, or t
  modified_base (327)..(327): a, c, t, g, unknown or other
  misc_feature (327)..(327): n is a, c, g, or t
  modified_base (353)..(353): a, c, t, g, unknown or other
  misc_feature (353)..(353): n is a, c, g, or t
  modified_base (367)..(367): a, c, t, g, unknown or other
  misc_feature (367)..(367): n is a, c, g, or t
  modified_base (446)..(446): a, c, t, g, unknown or other
  misc_feature (446)..(446): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagcccacccgtcggtntccgagtcggcccccgagggacggggaccggccaccagtttaccctgtggtgggagaacgacagttgacaagggaagagtcgtccacgtcggtaaccaacaggacggccgacgggcccgggcccctggtggtggtcgtctatgactaacgngtcgacccggcctcgtacgactcccngcgcgtcttctcgnggcctacactcgtagggaacctaccggcccaccctgacctacgtacgacgaccgacgggacccggaacgggccgggganacggaccgggaccgtacttacttaaccgtcggaccgtagggtggtacggactacgtattaccgtaccccgtaccccgggttcgggtttaaccgggggccggggggaaccctaacgggcccttaccgggtaccccgttacccggttacggtacccgaaccggtacccggaaccgggtccccgttacccggccccccggttaccggtaccctacccttccgttcccccgttacccccctaccccttaccccgtacgaaccggtaccgttaccctacgtaacccggg

SEQ ID NO: 291940 - DNA, 637 bp, Homo sapiens
  misc_feature: GYAE6OF01A72VR.9.20.B09.1.454.CMB.1.raw
  modified_base (300)..(300): a, c, t, g, unknown or other
  misc_feature (300)..(300): n is a, c, g, or t
  modified_base (322)..(322): a, c, t, g, unknown or other
  misc_feature (322)..(322): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccacattaccgtgtgtgggagagacatgcaaggagagtgtaccacgtggtaccaacgagaggccaggcccgggccctggtcggtggtcgtctagtgactaacgngtcgaccgccctgcgactcccngacgcgtcttcgtctggcctaccaacgtcgtcgggaaccacggcccacccgtgaaccctagtccaacggcgacggggtcccgaaggcccggggtatcgggacggccgacttagttaccgtcggtccgtagggtcgtggctaatagtttacgtacccgaccccggttgggttacccgggaccggggggaccctaggtcccgtacggtacccggttaccgtacggtccgaaccggtcccgaacggtccgtcccgcccccgttcggtccaccgttccctccgtccccctacccgtcctaccgacgtactcgtcgaccg

SEQ ID NO: 291941 - DNA, 788 bp, Homo sapiens
  misc_feature: GYAE6OF01BVOGN.9.20.B09.1.454.CMB.1.raw
  modified_base (776)..(776): a, c, t, g, unknown or other
  misc_feature (776)..(776): n is a, c, g, or t
tcagtgatacgtctcacgaccggtgctcgatttagtgtagtgtgaaggggctgggcctaaggaagcagcactgggtggtgcctcagccatggcctggaccgttctcctcctcggcctcctctctcactgcacaggatccctatcgacctcacatgtgctgactcacgcccaccgtcggtgtcacggtcggcccgagggacgggaccggccacctacttaccgtggtggtagggaacgaagactagttcgacgaagggaagagtcgtaccgacgttacggaaccaacgaggacgggccgacgggccccgggtccctgggtgggtcggtcgtactagtgaacgtaacgaggtccggacccggtccctcggtaccgtacctcccgtaggacgtccgttactttccgtccgttcggccttaccctaacgtcggtaacgggaaccgacccggccccaacccgtacgaccctacgtccgacggaccggaacggggacccggaaacgggggccggggtaagtcgggtaaccgggaccgtaacgttaaccgttacgtcggaccgtaggggttcggtacgtacttaacgttacttacccgccccgttaccccgggttgggtcccggggaccggggaacctacggacggtacccggtacccgtccggtaacggtcccgaaccgggtcccgtacgggccctaccccgggccccgttccgggtacccttcccggttacccgttccccggttcccccgtccccttaccgtacgaaccggttaccgttcncccggtaacggg

SEQ ID NO: 291942 - DNA, 865 bp, Homo sapiens
  misc_feature: GYAE6OF01ENUMD.9.20.B09.1.454.CMB.1.raw
  modified_base (236)..(236): a, c, t, g, unknown or other
  misc_feature (236)..(236): n is a, c, g, or t
  modified_base (381)..(381): a, c, t, g, unknown or other
  misc_feature (381)..(381): n is a, c, g, or t
tcagtgatacgtctcacgaccggtgctcgatttagtgtagtgtgaagggctgggcctaaggaagcagcactggtggtgcctcagccatggcctggaccgttctcctctcggcctcctctctcactgcacgaggatctatgacctcacatgtgctgactcacgccctcccgtggtcgtcaggtcggccccgagggacgggccggacccacctacgttaccgtggttggtaggggaanaacgacgtattcggaacgaaagggacgtagttacgtacctacgttccggtaaaccgaacgaggaccggacccggacgggtccccggggtccccttagggttcggggttacggttccggttacctagtttaggaacttaaaccggnggttacccgggaccccggtccccgtttacgttcggaacccttcccgtaggacctccgttcccgtttcgacgtttccggccttaacccgaacgtttccgggacggaaacccgacccgggtacccctaccccgtagaaccgacgttacccggaacggaccgggtaaccggggaccggaaacgggggtccgggtaacgtcgggtaacccggggtaaccttaacgttaccgttaccggtaccggtacccggtaggttcgtacgggtacttaattacccgtttaccgtcccccggttacccgggtcgggggttacggggacccccgggggaatacccgggttacgtacccggttaccggttaccgtaccgggtacgacccggtaccgcgggtcccgtaccccggttccccgtacgttacccctcgtttacccggtccctttaccccccgacccttaccacggtaacccgttctaacggtcccgtaacgg

SEQ ID NO: 291943 - DNA, 818 bp, Homo sapiens
  misc_feature: GYAE6OF01ECEV2.9.20.B09.1.454.CMB.1.raw
  modified_base (352)..(352): a, c, t, g, unknown or other
  misc_feature (352)..(352): n is a, c, g, or t
  modified_base (461)..(461): a, c, t, g, unknown or other
  misc_feature (461)..(461): n is a, c, g, or t
tcagtgatacgtctcacgaccggtgctcgatttagtgtagtgtgaagggggcctaagggaagcagcactggtggtgcctcagccatggcctggaccgttctcctcctcggcctcctctctcactgcacaggatctatgacctcactatgtgctgactcacgcccacccgtggtgtcagtcggcccgagggacgggaccggccaccagtttaccgtggtcggtgggaagaagacctagttggacgaaagggaagagttcgtacccacgttcggtaacccaaacgaggacggcccgacggggccccgggtccccgtggttcgggttcggtccgttctaagtggaacttaaacgngggtacggaccccgggtcccgttaccggtacggtaaccttccccgtagggacggtccgtacctttccgtcgtcggccctacccgtaaaccgttcggaacggggaaaccnccgggacccctaccgtcgaaccctagtccgaacggccggtaacgggggaccgaaacggggccgggggaatcgggaaccgggtacccgtaagtttacttacgtcggaccgtaagggttcggtacgtacttaagttaacgtttaccgtccccggtaccccggttgggttacccgggggaccgggggtaaccaacgggtccgtaccgggtacccggttacgttacggaccgaaccggtacccggaacggttcccggtacccggtcccccgttacggttcccgtaaccgttccgttccccggttacccccgtcccgttccgtaaccggtacgtacccgtagttcccgtcgtcgggaccggg

SEQ ID NO: 291944 - DNA, 769 bp, Homo sapiens
  misc_feature: GYAE6OF01EYV2U.9.20.B09.1.454.CMB.1.raw
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagcccaccctcggtgtcagtcggccccgagggacgggacggccacctattaccgtgtggtggggagaagactagttgacgaaaggaagaggtcgtaccacgttacggtaaccaacgaggaacggcccgacggggccccggggtccccgtggttcgggtcggtcgtcttagtagaactaacgtaggtacggaccccggtcccgttccggtaccgaccttccccgtgacggtccgtctttcctcgtcggccttaccaaccttcggtacggggaaacccacccgggcccctaaccccgtacggaaccctacgtccggaacggccggtaccgggggaccggaaaccggggccggggaagtacgggacgggaccgttaaccgttaacgttacgccggtaccggtaggggtcgtacgggtaccttaagtttaacctttaccgtaccccgtaaccccccgggtttggggtttcccggggggacccggggggaaccctaacgggtaccgtacccggtaccggttaccgtacggtacgaccgaccgtacggccgtcccgccccgtcgtccaccgttcctcccgtccccacccgttccctactacgtactctcgtacgg

SEQ ID NO: 291945 - DNA, 716 bp, Homo sapiens
  misc_feature: GYAE6OF01C5LD2.9.20.B09.1.454.CMB.1.raw
  modified_base (255)..(255): a, c, t, g, unknown or other
  misc_feature (255)..(255): n is a, c, g, or t
tcagtgatacgtctcacgaccggtgctcgatttagtgtagtgtgaagggctgggcctaaggaagcagcactggtggtgcctcagccatggcctggaccgttctcctcctcgcctcctctctcactgcacaggctctgtcgacctcctatgtgtctgactcagcccaccgtcggtgtcgagtcggccccgaggagagaccggccaggattaacgttgtagaaacgaaacatactagttggaggttgttagtgtacncgtcggtacagcgaagacgcgacgccgacgcccgtgtgctcggtcctcgtatactactactacgccgacccgccgtcgacggtacctcccgtagacgcttactcgacgcggtaccctccgtaactccgtaacggggaaacccgtcccgaaccctacgacctaacgaccaggtaccggagggttaccggaacgggacccgggagtacgggaccggtccgtaaacgtttagttaccgtacgtacggtgggttacggtcgggtacgttagggtagtaaagttagttacggtacgtacgtggttacggggtacggggtttcgtacggggtcgggtaacgggacgtaacggtccgtacgtaccccggtaccgttaacggaccgtaccggacccggtaacgtccccgtacccgttcccccggtacggttacctaccgttttacccgcccggtttaccccctccccgg

SEQ ID NO: 291946 - DNA, 852 bp, Homo sapiens
  misc_feature: GYAE6OF01CRYIP.9.20.B09.1.454.CMB.1.raw
tcagtgatacgtctcacgaccggtgctcgatttagtgtagtgtgaagggggcctaaggaagcagcactggtggtgcctcagccatggcctggaccgttctcctcctcggcctcctctctcactgcacaggatctatgacctcacatgtgctgactcacgcccaccctcgggtgtcaggtcggccccgagggacgggaccggccacctattaccgtggtggtagggagaagactagttagacgaaagggaagtagtcgtaccaacgtcggtaaccaaagaaggacggacccgacggggcccgggccccgtaggttcgggtacggttcgtactagtgaacgtaacgaggtacggacccggtccctcggtaccgacttccccgaggtacgtccgtctttccgtctcgggtacctaccgtaactcgtacgggaaccacccggcccaccgtcgaaccacgtaccgacggtacgaacggggaccgaaacgggacccggggtagtacgggacgggacccgtaacgttaacgttacggtcgtacggtagggttggtacgggactaacggttaacttaccggtaccccgttaccccggggttcggggttacccggggaaccggggggtaaccgtaaacgggtccggttaaccggtaccccgggttaccggttaacgggttacccgacccgggtaacccgtaccgggtcccgttccccggtacccccgtttaccgggtaccccttaacccggttcccgtttaccccggtttacccccccgtaacccccgtttcccgtttacccggtaacccgttaaacccggtttaccttacccggtaacggttcccggggaacccgggggg

SEQ ID NO: 291947 - DNA, 759 bp, Homo sapiens
  misc_feature: GYAE6OF01CG29B.9.20.B09.1.454.CMB.1.raw
  modified_base (237)..(237): a, c, t, g, unknown or other
  misc_feature (237)..(237): n is a, c, g, or t
  modified_base (442)..(442): a, c, t, g, unknown or other
  misc_feature (442)..(442): n is a, c, g, or t
  modified_base (463)..(463): a, c, t, g, unknown or other
  misc_feature (463)..(463): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacagtctttgtagactctgtcgaccttccatgtgctgactcagcccacccgtcggtgtcagtccggcccctaggaaacgccggccagcaactaacctggtagaggganaacaactaattaaaaacaaataatgtagactagttcggtaaccagacgaagaacgccgaggcccacggccccctgtacccgtgggttcctttcgttagtctgtaatacggtccggacccggtaccctacggaacggggtaccttcccgtaggacgtacgtaactttccgtaccgtcggtcctaccgtaacgtcgtacgggaaccnccggacccaccgtcgaacccngtacggacgggtccgggtacgaacgggccgggtagtacgggacgtaccggtacttacgtttcgtcgtcgtaggccggttggttacgggtactttaccgtacgtaggttacggtaaggggttacgggtaagggggttacggggtaaccgtttccggggttacggggacgggtaacccggggtaaccgtacgggtacccttacgggtacccgttaccgttaggacccgtaccgggacccgtaacgggttccctaccccggtacccccgtacggtacccttccgtcccgttacccccgg

SEQ ID NO: 291948 - DNA, 848 bp, Homo sapiens
  misc_feature: GYAE6OF01DDA1G.9.20.B09.1.454.CMB.1.raw
tcagtgatacgtctcacgaccggtgctcgatttagtgtagtgtgaaggggcctaaggaagcagcactggtggtgcctcagccatggcctggaccgttctcctccgtcggcctcctctctcactgcacgaggatctatcgacctcacagtgtgctgactcgacgcccacccgttcggtgtacgaggtccggccccgaagggacgggacccggacccaacctacgttaccgtggtggtagggaagaacgactagttacgacgaaaggaacgtagtcgtacctacgtacggtaacccaaagacggacggtacccgaccgggcccggtaccccgtggtcggttcggtcgtctagtacgaacgtaacgtacggtaccggacccggtcccgttcggtaccgtacctcccggtaggcggtccgttccgttcgtcgtaccggtacccttacccgtaaacgttccggttaaccgggaaacccgaccccgggtaccccctaaccggttaccgaacccgacgtaccggaccggaccgggaacgggtacccgggaaaccggggccggggtagtaccggaaccgggtacccgtaacgtttacgtacccgtcggtaccgggtagggtccggtacgtacgttaacgttaccgttacccgtccccgggttacccccgggttaggggttaccccgggggacgggttaacccgaacggtcccggttaccccggtaccgttccggacggttacccgaccggacccgtaccggtcccgtaccccgtccccgttgtcccgtaccgttcccgttacccgtccccctacccgtaccgtacgtacccgttactcgtaacgcgtaggtccggg

SEQ ID NO: 291949 - DNA, 896 bp, Homo sapiens
  misc_feature: GYAE6OF01A3P9C.9.20.B09.1.454.CMB.1.raw
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatcgacctcacattgtgctgacctcgacgccctacccgtcgggtgtcaggtcggaccccgagggacgggaccgccaacctattaccgtggtgtggggaacaaggactagttcgacgaaggaagacgtcgtaccacgttacggaaccaacgaggacggcccgacggggtccccggcccttggggtcggtagggttccgttctaagtacggaactaacggtacggtccggaaccccgggtcccgttacggtccgaccgttcccgtggaacgtccggtactttcgccgtcgggtccttaaccctaacgttccggtaaggggaaccctacccggacccctaacccgtgaaccctaagtcgaacggaccggtaccggggacccggtaacggggtcccggggtaagtaccgggacgggtaccccgtaaactttaccggttaaccgtccgggaccggttagggtagggttacggtaacctttaacgtttaccgtttaccgacccccgggtttacccccgggtttggggttaacccggggggaccgggggaaaccctacgggttcccggttaaccgggtacccggttaacccggagggtacccggaaacccggtccccggtaaacggggttccccttacccccgggttaccccccgggtaggtttaccccccgacgtttcccccggtttaccccggtacccccccgtacccctttacccggttaacccggtaaccggggttaacttcccggttccgaaccccgggg

SEQ ID NO: 291950 - DNA, 791 bp, Homo sapiens
  misc_feature: GYAE6OF01DKYCB.9.20.B09.1.454.CMB.1.raw
  modified_base (401)..(401): a, c, t, g, unknown or other
  misc_feature (401)..(401): n is a, c, g, or t
  modified_base (422)..(422): a, c, t, g, unknown or other
  misc_feature (422)..(422): n is a, c, g, or t
tcagtgatacgtctcacgaccggtgctcgatttagtgtagtgtgaagggggctgggcctaaggaagcagcactggtggtgcctcagccatggcctggaccgttctcctcctcggcctcctctctcactgcacaggatctatgacctcacatgtgctgactcagcccaccgtggtgtcaggtccggacccgagggacgggaccggaccaccgtattaccgtggtggtaggggaagaaagactagttacgacgaaagggaagtacggtcgtccacgtacggtaaaccaacgaggacgggccgtaacgggccccgggtcccgttgggtcgggttcggtacgttactagtacgaataaccaggtccggacccggtcctcggtacgtactccgtgacggtctctcncgtcgctccatcgacggaccnccggacctaccgagacctagtaccgacggaccggacggggaccgggaaggggaccggggtacgtacgggaccgggtacgtaaacttacgttacggacggtacggtacgggttcgtacggtacttaacgtactttacccgtaccccggtaccccgggttcggggtaccgggggaaccggggaaccctaacgggtccgttaccgggtaccggttcccggttaacgggtacccgaccgggtaaccccgtaacgggtccccgttaccccggtacccccggttacgggtaccctaccggtttccccgttaccccgttacccccgttacccccttaccgaccggtaaccggttacccttacgtccggtaaccggg

SEQ ID NO: 291951 - DNA, 1122 bp, Homo sapiens
  misc_feature: GYAE6OF01CY5U9.9.20.B09.1.454.CMB.1.raw
  modified_base (249)..(249): a, c, t, g, unknown or other
  misc_feature (249)..(249): n is a, c, g, or t
tcagtgatacgtctcacgaccggtgctcgatttagtgtagtgtgaaggggctgggcctaaggaagcagcactggtggtgcctcagccagtggcctggaccgttctcctcctcggcctcctctctcactgcacaggatctatcgaacctcactatggtgctagacctcacgcccacccgtcggtgtacgaggtcgggaccccaagggaagggaccggtaccaaccactttaaccgtggtggtaggggaanaaaggaactaagttacggacgaaaagggaagtaacggttcgtaccaacgttacggttaaacccaaacgaaggaacgggaacccgaacggggtacccccgggggtaccccccgttaggggttacggggtacgggtttacccggttaacgttaaacgtcgggaaaacgtttaaaaccgtaaaggtacccggtaaccccggggtaccccccgtttaaccggtcccggtaaaccggttaccccccgttaacgggaacggtaccccggtacccgttttacccgttaccggttacgggtacccttacccccgttaaaaccggtttacccgggttaaaccggggggaaacccgtaacccccggggaaccccgttaaaccccccggtttacggaaaacccccacgttttaacccaacgggttaaacccggtaaaccggggggaaacccgggtaaaccgggggaaccccgggggtttaacgacggggtaaacccgggggtaacccgaaaacgggtttaaacccgttttaaccgaaccgggtaccccggtaaaggggtttacggttacggggtaaccttaaaggtttaacctttaacccggttacccccgtaaccccccggggttttagggggttttacccccggggggaaaccgggggggtaacccctaaacgggtacccggtaaccggttaacccccgggttaaccggtttaaccgggtaccgaacccggaaccccggtaaaaccgggccccgtttaacccggccccccccgggttaacggttaacccctaacccgtttccggttaccccggtttaccccccgccccgttttaccccccgtaaacgtccggtaaaacccgttcccgttacggtaaaccccg

SEQ ID NO: 291952 - DNA, 535 bp, Homo sapiens
  misc_feature: GYAE6OF02IG0PI.9.20.B09.1.454.CMB.1.raw
tcagtgatacgtctcacgaccggtgctcgatttagtgtagtgtgaaggggcgtggggcctaaggaagcagcactggtggtgcctcagccatggcctggaccgttcctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccgggcccctgtggtggtcgtctatgataacagtgaccggccctcgtcgatccctgagcgcttctctggctccaactctgggaacacggccaccctgaccatcagcagggccgaagccggggatgaggccgactattactgccaggtgtggcagtattatcaccccgtgttcggcgggggaccaagctgaccgtcctacggtcacgccaaggctcgcccccgtcggtccactcctcgttccccaccctcctccacgacgtactctaccg

SEQ ID NO: 291953 - DNA, 564 bp, Homo sapiens
  misc_feature: GYAE6OF02G2G3K.9.20.B09.1.454.CMB.1.raw
  modified_base (349)..(349): a, c, t, g, unknown or other
  misc_feature (349)..(349): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccgggccctgtggtggtcgtctatgataacagtgaccggccctcgtcgactccctgagcgcttctctggctccaactctgggaacncggccaccctgaccatcagcgacggggccgaaggccggggatcggacggccgactattacgtgccgaggtgtggcattattactccaccccgtggttccgggcgggggaccaaggccgtcggaccgttccgtaggtccacgcccgaaggccgtcgtcccccgtcggtccacctcgtccgttcccgcccttccctccgacgtaccgtactcctacg

SEQ ID NO: 291954 - DNA, 527 bp, Homo sapiens
  misc_feature: GYAE6OF02H0UX7.9.20.B09.1.454.CMB.1.raw
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccatggtaccaacagaggccaggccgggcccctgtggtggtcgtctatgataacagtgaccggcctcgtcgatccctgagcgcttctctggctccaactctgggaacacggccacctgaccatcagcagggccgaagccgggatgaggcgactattactgccaggtgtggcatattatcacccgtgtcggcgggggaccacgctcgaccgtccgtaggtcacgcccaaggctcgccccgtcggtccacgtcctcgttccccgccctccctccacgacgtactctaccg

SEQ ID NO: 291955 - DNA, 575 bp, Homo sapiens
  misc_feature: GYAE6OF02JW2RW.9.20.B09.1.454.CMB.1.raw
  modified_base (348)..(348): a, c, t, g, unknown or other
  misc_feature (348)..(348): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccgggcccctgtggtggtcgtctatgataacagtgaccggccctgtcgatccctgagcgcttctctggctccaactctgggaacncggccacctgaccatcagcagggccgaagccggggatgagccgactattactgccaggtgtggcagtattactccgtacccccgtggttccggggccggggggaccaacggtccgtcggacccggtccgtacgggtccaacggcccgaacggccgtacgcccccgtcggtccaccgttcccgtacgttccccgccccttccgtccgtacgtaccgtactccgtaacg

SEQ ID NO: 291956 - DNA, 531 bp, Homo sapiens
  misc_feature: GYAE6OF02IM0AH.9.20.B09.1.454.CMB.1.raw
  modified_base (328)..(328): a, c, t, g, unknown or other
  misc_feature (328)..(328): n is a, c, g, or t
  modified_base (525)..(525): a, c, t, g, unknown or other
  misc_feature (525)..(525): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccgggcccctgtggtggtcgtctatgataacagtgaccggccctcgtcgatccctgagcgcttcnctggctccaactctgggaacacggccaccctgaccatcagcagggccgaagccggggatggaggccgactattactgccaggtgtggcatattatcaccccgtgttcggcgggggaccaaggctgaccgtcctacggtcagcccaaggctcgcccctcggtccactcctcgttcccgccctcctccacgaccgtacnctaccg

SEQ ID NO: 291957 - DNA, 539 bp, Homo sapiens
  misc_feature: GYAE6OF02FMZ11.9.20.B09.1.454.CMB.1.raw
  modified_base (494)..(494): a, c, t, g, unknown or other
  misc_feature (494)..(494): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccgggcccctgtggtggtcgtctatgataacagtgaccggccctcgtcgatccctgagcgcttctctggctccaactctgggaacacggccaccctgaccatcagcagggccaagccggggatggaggccgactattactgccaggtgtggcatattatccaccccgtggttcggcgggggaccagctgaccgtccgtaggtcacgcccacggctcgcccccgtcggtccnccgtccgtcgttccccacccttcctccacgtaccgtactcctacg

SEQ ID NO: 291958 - DNA, 510 bp, Homo sapiens
  misc_feature: GYAE6OF02H1F4V.9.20.B09.1.454.CMB.1.raw
  modified_base (444)..(444): a, c, t, g, unknown or other
  misc_feature (444)..(444): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaaggagagtgtccactggtaccaacagaggccaggccggcccctgtggtggtcgtctatgataacagtgaccggcctcgtcgatccctgagcgcttctctggctccaactctgggaacacggccacctgaccatcagcagggccgaagccgggatggaggccgactattactgccaggtgtggcatattatcacccgtgttcgggcggggacagcngccgtctagtcacgccagctcgccccgtcgtcactctcgtcccaccctcctccacgactatctacg

SEQ ID NO: 291959 - DNA, 651 bp, Homo sapiens
  misc_feature: GYAE6OF02HJ47N.9.20.B09.1.454.CMB.1.raw
  modified_base (251)..(251): a, c, t, g, unknown or other
  misc_feature (251)..(251): n is a, c, g, or t
  modified_base (351)..(351): a, c, t, g, unknown or other
  misc_feature (351)..(351): n is a, c, g, or t
tcagtgatacgtctcacgaccggtgctcgatttagtgtagtgtgaagggggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaaggaagagtgtccactggtaccaacngaggccaggccgggcccctgtggtggtcgtctatgataacagtgaccggccctcgtcgactcccctgacgcgcttcgtctggcctcaactcgtgggaacncggccacctgaccatcagcgagggccgaagccggggatcggacggccgaactagttacgcgccgtaggtcgtggacattacgttaactcccgtaaccccggttggtttccggggaccgggggtaaccaaggtccgttacggtacccgttacggttaacgggtccaacgggaccccgtaaagggccttacccgggcccccgttcgggttaccctaaccggtttccgttccggtttaccccccgcccgttacccgttaccgtaacggtaccggttaacctccgtacggttcggtaacccggg

SEQ ID NO: 291960 - DNA, 617 bp, Homo sapiens
  misc_feature: GYAE6OF02JNB5O.9.20.B09.1.454.CMB.1.raw
  modified_base (236)..(236): a, c, t, g, unknown or other
  misc_feature (236)..(236): n is a, c, g, or t
  modified_base (306)..(306): a, c, t, g, unknown or other
  misc_feature (306)..(306): n is a, c, g, or t
  modified_base (365)..(365): a, c, t, g, unknown or other
  misc_feature (365)..(365): n is a, c, g, or t
  modified_base (381)..(381): a, c, t, g, unknown or other
  misc_feature (381)..(381): n is a, c, g, or t
tcagtgatacgtctcacgaccggtgctcgatttagtgtagtgtgaagggcgtgggcctaaggaagcagcactggtggtgcctcagccatggcctggaccgttctcctcctcggcctcctctctcactgcacaggatctatgacctcacatgtgctgactcagccaccctcggtgtcagtggccccaggacgggacggccaccattaccctgtgtgggagaagacattgcaaggaanagtgtccactggtaccaacagacggccagggccgggtcccccgtgtcggtggtacgtctagtgataaacngtgaccggcctcgtcgactccctgacgcgcttctacgtggctccaacgtctcgggaacncggcaaccctgacccntcagcgagggccaaggccgggaatcggaacggccgacgtacgttactcgccgtaaggtcgtcggacgtacgtagttaactccgtaaccccgtcgggttaccgggtccggggggaacctaacggccgtacggtacccgttccgtacggtccgtaacggccaacggcctacggtcccccgtcggtaccacgtcctcgttacccgcccttccgtccgtacgtaccggtatccgtaaccg

SEQ ID NO: 291961 - DNA, 631 bp, Homo sapiens
  misc_feature: GYAE6OF02H6GU5.9.20.B09.1.454.CMB.1.raw
  modified_base (273)..(273): a, c, t, g, unknown or other
  misc_feature (273)..(273): n is a, c, g, or t
tcagtgatacgtctcacgaccggtgctcgatttagtgtagtgtgaaggggcgtgggcctaaggaagcagcactggtggtgcctcagccatggcctggaccgttctcctcctcggcctcctctctcactgcacaggatctatgacctcacatgtgctgactcagccaccctcggtgtcagtggccccaggacgggacggccaccattacctgtgtgggagaagactattgcaaggagagtgtccatggaaccaacagaggcaggccggccctgnggtgtcgctatcgataacagtgaccgcctcgccgatccctgacgcgcttctcgtggactcccaactcgtacgggaacacccgggccacccgtgaccaatccaagccgaagggccgaaagtccggggatcggacggccgactacgttactaggtccagggtcgtaggacgattaacgtacttaccgtaaccccgtcgggttccgggaccggggggaccaaacggccgtacggacccgttaccgtacgggtcgaaccgacccgaaacggtccgtccgtcccccgtccggtcctaaccgttccgttccgttaccccgtaccccttacccgtccgtaaccggtaaccgtcgtacctaaccgg

SEQ ID NO: 291962 - DNA, 536 bp, Homo sapiens
  misc_feature: GYAE6OF02HJEXY.9.20.B09.1.454.CMB.1.raw
  modified_base (531)..(531): a, c, t, g, unknown or other
  misc_feature (531)..(531): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccgggcccctgtggtggtcgtctatgataacagtgaccggccctcgtcgatccctgagcgcttctctggctccaactctgggaaccacggcccaccctgaccatcagcagggccgaagccggggatggaggccgactattactgccgaggtgtggctatattatccaccccgtggttcgggcgggggaccagctgaccgtccgtaggtcacgccgaaggcctcgccccgtcgtccactcctcgttcccaccctcctccacgacgtacnctacg

SEQ ID NO: 291963 - DNA, 602 bp, Homo sapiens
  misc_feature: GYAE6OF02JWC5E.9.20.B09.1.454.CMB.1.raw
  modified_base (343)..(343): a, c, t, g, unknown or other
  misc_feature (343)..(343): n is a, c, g, or t
tcagtgatacgtctcacgaccggtgctcgatttagtgtagtgtgaagggggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccgggccctgtggtggtcgtctatgataacagtgaccggcctcgtcgatccctgagcgcttctctggctccaactctgggaacncggccacctgaccatcagcagggccgaaggccggggagtcggacggccgactacttacgtgccgagggtgtggactagttattactccgaccccgtggttccgggacgggggaccaacggtcgtacggaccgttaccgtacggtaccgacgacccgtaacggcctccggtcccccgtcggtacctaccgttccgttccgttccccctacccgttcccgtaccgtaccggtaaccgttactacccgtacgtcgtaccggg

SEQ ID NO: 291964 - DNA, 523 bp, Homo sapiens
  misc_feature: GYAE6OF02HC0RE.9.20.B09.1.454.CMB.1.raw
  modified_base (518)..(518): a, c, t, g, unknown or other
  misc_feature (518)..(518): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccgggcccctgtggtggtcgtctatgataacagtgaccggccctcgtcgactccctgagcgcttctctggctccaactctgggaacacggccaccctgaccatcagcagggccgaagccggggatggaggccgactattactgccaggtgtggcatattatcaccccgtgttcgggcgggggaccagctgccgtctaggtcagcccaggctcgccccgtcggtccactctcgttccccgccctcctcacgacgtnctacg

SEQ ID NO: 291965 - DNA, 572 bp, Homo sapiens
  misc_feature: GYAE6OF02I8ZSS.9.20.B09.1.454.CMB.1.raw
  modified_base (349)..(349): a, c, t, g, unknown or other
  misc_feature (349)..(349): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccggccctgtggtggtcgtctatgataacagtgaccggccctcgtcgatccctgacgcgcttctctggcctccaactctgggaacncggccacctgaccatcagcagggccgagccgggatcgaggccgactattacgtgccgaggtgtggctattattactcccgtaccccgtggttccgggccggggggaccaacggccgtggacccgttccgtacgggtccacgcccgaacggtccctcggcccccgtcggtccaccgttccgtccgttccccaccccttcctccacggaccgttacgtcctaccg

SEQ ID NO: 291966 - DNA, 532 bp, Homo sapiens
  misc_feature: GYAE6OF02I5XYW.9.20.B09.1.454.CMB.1.raw
  modified_base (408)..(408): a, c, t, g, unknown or other
  misc_feature (408)..(408): n is a, c, g, or t
  modified_base (429)..(429): a, c, t, g, unknown or other
  misc_feature (429)..(429): n is a, c, g, or t
  modified_base (508)..(508): a, c, t, g, unknown or other
  misc_feature (508)..(508): n is a, c, g, or t
  modified_base (527)..(527): a, c, t, g, unknown or other
  misc_feature (527)..(527): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaaggccgggcccctggtggtggtcgtctagtggaataacgagtgaccggccctacgtcgatccctgacgcgcttctctggctccaactctgggaacacggccacctgaccatcagcagggcgaagccgggatgaggccgatagttacncgtcaggtgtggcatattacncacccgtgtcgggcggggactagctgaccgtctaggtcacgcccaaggctcgaccccgtcggtccacgtcctcgtcccncctccgtcacgtacgtacnctacg

SEQ ID NO: 291967 - DNA, 652 bp, Homo sapiens
  misc_feature: GYAE6OF02IG6EP.9.20.B09.1.454.CMB.1.raw
tcagtgatacgtctcacgaccggtgctcgatttagtgtagtgtgaagggctgggcctaaggaagcagcactggtggtgcctcagccatggcctggaccgttctcctcctcggcctcctctctcactgcacaggatctatgacctcacatgtgctgactcagccaccctcggtgtcagtcgcccaggagggacggccaccattacctgtgtgggagaagacattgacaaggaagagtgtccactggtaaccaacagaggccaggcccgggccctggtcggtgtcgtctagtgataacgagtcgaccgccctcgtcgactccctgacgcgcttctcgtggcctccaacgtcgtacggggaaaccaccgggcccaacccgtgacccaatccaaggccgaacggggcccgaaaggccggggtagtcggaagggacccgaacttacgttactcggaccgaaggtgtggctaagttaacgttaactccgtaaccccggttgggttccggggaccggggggtaaccaaggccgtacggacccgttacgtacgggtacaaccgtcccgaacggtcctaccggtcccccgtcggtaccctaccgtccgttccgttccccggccccttcccgacccgtaggtacccgttactaccgtaacgg

SEQ ID NO: 291968 - DNA, 531 bp, Homo sapiens
  misc_feature: GYAE6OF02F9RZ6.9.20.B09.1.454.CMB.1.raw
  modified_base (406)..(406): a, c, t, g, unknown or other
  misc_feature (406)..(406): n is a, c, g, or t
  modified_base (526)..(526): a, c, t, g, unknown or other
  misc_feature (526)..(526): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccagggccgggcccctggtggtggtcgtctatgataacaggtgaccggccctgtcgatccctgagcgcttctctggctccaactcgtgggaacacggccacctgaccatcagcagggccgaagccgggatggaggccgactattacgngccaggtgtggcatattctccgacccgtgttcgggcggggacagctgaccgtcgtagcacgcccgagcctcgccccgtcggcctacgtcctcgttcccgcccttccgtcgacgacgtacnctacg

SEQ ID NO: 291969 - DNA, 628 bp, Homo sapiens
  misc_feature: GYAE6OF02IUSAH.9.20.B09.1.454.CMB.1.raw
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacgccacattacctgtgtgggagaagacattgcaaggaagagtgtccactggtaccaacagaggccaggccgggcccctgtggtggtcgtctatcgataacagtcgaccggcctcgtcgactccctgacgcgcttcgtctggctccaactcgtggaactcggccacctgaccagtcacgcacgggccgaaggccggggatcgacggccgactacttacgtcgccgaggtgtcggactagtacttactccgtaaccccggtcggttaccgggacggggggaaccctaacggccgtacggtacccgttccgtaaccgggttacaccggacccgaaccggtccgtccgtacccccggtcggttaccgtaccttccgttcccggtttccccggtccccttacccttcccgaacggttaacccgttacgtacccgtaccgg

SEQ ID NO: 291970 - DNA, 541 bp, Homo sapiens
  misc_feature: GYAE6OF02IDOZI.9.20.B09.1.454.CMB.1.raw
  modified_base (407)..(407): a, c, t, g, unknown or other
  misc_feature (407)..(407): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccatggtaccaacagaggccagggccgggcccctggtggtggtcgtctatgataacagtgaccggccctcgtcgatccctgagcgcttctctggcctccaactctcgggaacacggccaccctgaccatcagcagggccgaaggccggggatggaggccgactatacngccaggtgtggctatattactcaccccgtggttcgggccgggggaccaggctcggaccgttcctaggtcacgaccgaggcctcgccccgtcggtccacctcctcgtcccaccctcctaccacgactactctacg

SEQ ID NO: 291971 - DNA, 534 bp, Homo sapiens
  misc_feature: GYAE6OF02FLV9V.9.20.B09.1.454.CMB.1.raw
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccgggcccctgtggtggtcgtctatgataacagtgaccggccctcgtcgatccctgagcgcttctctggctccaactctgggaacacggccaccctgaccatcagcagggccgaagccggggatggaggccgactattactgccaggtgtggcatattatcaccccgtgttcgggcgggggaccagctcgaccgtcctaggtcacgcccaaggcctcgcccccgtcggtccactcctcgttccccgccctccctccagaccgtatcctacg

SEQ ID NO: 291972 - DNA, 785 bp, Homo sapiens
  misc_feature: GYAE6OF02H2ZTS.9.20.B09.1.454.CMB.1.raw
  modified_base (306)..(306): a, c, t, g, unknown or other
  misc_feature (306)..(306): n is a, c, g, or t
tcagtgatacgtctcacgaccggtgctcgatttagtgtagtgtgaagggtaaggggtccgggtgtgaaggcttcactagtcctggaccgtcctgtcgccaagaacatggaaacatctgtggttcatcctcctcctggtgcagctcccagagtgggtcctggtcccctaggtgccggtctgcaggacgtcgggccccaggactagtggaacgccttcacaggccctgtccctcacctgccactgtctcgtagtagactccatcgaggaggttggttcgttcctacgtggacctggaactcccggganaacggtccccgacggactaagggtactagggaaggtataagttacggaccgtaacttcgttatacggcctaggttcgggacctccgtactcctaaacgtacccccgtccgtacaaaggacgtccgaacgtcaagcctagtgtaccgaggtccgaaccgtaccgtcccgaacggtaaaccgtaacggtttccctacccgttacgttaaccgtaggttacgtaacgtttaacgttaacgtacggtaaccccggcggtaaccgtaacgggaacccgtaccgggtacccgttaggttaacggtttaaccgttacggggtacggtaaccgggtaacggacgggtaacgggttacccgtttaacgtttacgggacccgtaggtacccgttaaacggttaaaacccgttcccgttaacccgttaccgggtccgttacgggtaaccgttccggtaccggggtaccccgtacggggaaccctaacggg

SEQ ID NO: 291973 - DNA, 540 bp, Homo sapiens
  misc_feature: GYAE6OF02GWN67.9.20.B09.1.454.CMB.1.raw
  modified_base (325)..(325): a, c, t, g, unknown or other
  misc_feature (325)..(325): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccggccctgtggtggtcgtctatgataacagtgaccggcctcgtcgatccctgagcgcttcnctggctccatctgggaacacggccacctgaccatcagcagggccgaggccggggatggacggccgactatactgccgaggtgtggcatattatccaccccgtgttcgggcggggggaccaaggcgtcggaccgtccgtacggtcacggcccaaggctcgtccccgtcggtccaccgtcctcgttccccaccctcctccacgaccgtactcctacg

SEQ ID NO: 291974 - DNA, 599 bp, Homo sapiens
  misc_feature: GYAE6OF02H4B0S.9.20.B09.1.454.CMB.1.raw
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagcccaccctcgggtgtcagtggccccaggagggacggccaccattacctgtgtgggagaagacattgcaaggagagtgtccatggtaccaacagaggccaggccgggcccctggtggtggtcgtctatgataacagtgaccggccctcggtcgactccctgacgcgtcttctctggcctccaactcgtcggaacacggcccacctgaccatcacgcacgggccgaaggccggggatcggacggaccgactattacgtcgccgagggtgtcggctatattactaccgacccccgttggttccgggccggggggaccaacggccgtacggacccggttccgtacgggtcaaccgcccgaaggcctccggtcccccgtcggtaccaccgtccttaccgttacccctaccctcccgtccgaaccgtacgttactcctaacgg

SEQ ID NO: 291975 - DNA, 532 bp, Homo sapiens
  misc_feature: GYAE6OF02GY3E0.9.20.B09.1.454.CMB.1.raw
  modified_base (401)..(401): a, c, t, g, unknown or other
  misc_feature (401)..(401): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccgggcccctgtggtggtcgtctatgataacagtgaccggccctcgtcgatccctgagcgcttctctggctccaactctgggaacacggccaccctgaccatcagcagggcgaagccgggatgaggccgactattacngccaggtgtggcatatatcaccccgtgtcggcgggggacacgctcgaccgtctaggtcgacgccgaagccgtcgccccgtcggtcctcgtcctcgttccccgcccttccctccgacgtacgtactctacgg

SEQ ID NO: 291976 - DNA, 525 bp, Homo sapiens
  misc_feature: GYAE6OF02FKXYS.9.20.B09.1.454.CMB.1.raw
  modified_base (476)..(476): a, c, t, g, unknown or other
  misc_feature (476)..(476): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccagggagggacggccaccattaccctgtgtgggagaagacattgcaaggaagagtgtccactggtaccaacagaggccaggccgggcccctgtggtggtcgtctatgataacagtgaccggccctcgtcgatccctgagcgcttctctggctccaactctgggacacggccaccctgaccatcagcagggccgaagccggggatggaggccgactatactgccaggtgtggcatattatcaccccgtgttcggcgggggacagctcgaccgtccgtaggtcagcccaaggcncgccccgtcggtccactcctcgtcccgccctcctccagacgtatctacg

SEQ ID NO: 291977 - DNA, 767 bp, Homo sapiens
  misc_feature: GYAE6OF02FGN85.9.20.B09.1.454.CMB.1.raw
tcagtgatacgtctcacgaccggtgctcgatttagtgtagtgtgaaggggcgtggggcctaaaggaagcagcactggtaggtgccctcgagccatggcctggaccgttctcctcctcggcctcctctctcacctgtcacaggatctatgacctcacatgtgctgactcagccaccctcggtgtcgagtggccccgaggagggacggccaccgattaccgtgtggtgggacgaagacagttgcgaaggaagagtcgtccacgtcggtaaccaacagtaggccgtagggccgggcccccgtggtcggtcggtcggtctagtcggtataacgagtggaccggaccctcgtcgactcccgtgacgcgccttccgtactcggcctccaactccgtgggaaccacggccacccgtgacccactccacggaccaacgggaccgaaacggccggggaagtacggacgggacccggtaaccgttaacgttaaccgtacgtaccgaacgggtcggttacgggactaacgtttaagttaaccgtcccgtaacccccggtttcggtttacccggggacccggggggtaaccctaacggtccgttacgggaacccggtttaccggtaacggttaccgtaaccggtaccccgtaaagggtccctacccggtccccccgtttaccgggtacccctaacccgtttcccgtttaccggtttacccccgtaccccgttccccgtacccgtaaccgggtaccccggttacgttacccgtaacccgg

SEQ ID NO: 291978 - DNA, 587 bp, Homo sapiens
  misc_feature: GYAE6OF02H9YCC.9.20.B09.1.454.CMB.1.raw
  modified_base (292)..(292): a, c, t, g, unknown or other
  misc_feature (292)..(292): n is a, c, g, or t
  modified_base (326)..(326): a, c, t, g, unknown or other
  misc_feature (326)..(326): n is a, c, g, or t
  modified_base (336)..(336): a, c, t, g, unknown or other
  misc_feature (336)..(336): n is a, c, g, or t
tcagtgatacgtctcacgaccggtgctcgatttagtgtagtgtgaagggggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtggagaagacattgcaaggaagagtgtccactcggtaccaacgagaggccaggccgggcccctgtggtggtcgtctatgataacngtgaccggccctcgtcgatccctgagctctctcngcctccatcnggacacggccacctgacatcagcgagggccaaggccgggatcggaggccgaatacttacgtgccgaggtcgtggctattaattactccgaccccgttggttccgggacgggggacaacggtacctcggaccgttccgtaggttccgacgtacccggaaaggccctaccggccccccgtcggtacccgtaccttcctccggtttaccccaccccttcccgtacgacgtaccgttactccacgtggtaccggg

SEQ ID NO: 291979 - DNA, 583 bp, Homo sapiens
  misc_feature: GYAE6OF02H5UI3.9.20.B09.1.454.CMB.1.raw
  modified_base (296)..(296): a, c, t, g, unknown or other
  misc_feature (296)..(296): n is a, c, g, or t
  modified_base (353)..(353): a, c, t, g, unknown or other
  misc_feature (353)..(353): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccacctcggtgtcagtggccccaggagggacggccaccattacctgtgtgggagaagacattgacaaggaagagtgtccactggtaccaacagaggccagggccggcccctgtggtggtcgtctagtgataacngtgaccggccctgtcgactccctgacgcgcttctctggctccaactcgtgggaaccncggcccacccgtgaccatcagcacggggccgaaggccggggatggacggccgacgtacgttacgtcgcgaggtgtggactatattacttccgaccccgtggtccgggcgggggaccagcgtcggaccgtccgtaggtcacgcccgaaggccgtccggtccccgtcggtcctaccgttccgttaccgttccccgtccccttccgtccgtacggtaccgttactacgtacgg

SEQ ID NO: 291980 - DNA, 615 bp, Homo sapiens
  misc_feature: GYAE6OF02IBQ34.9.20.B09.1.454.CMB.1.raw
  modified_base (356)..(356): a, c, t, g, unknown or other
  misc_feature (356)..(356): n is a, c, g, or t
tcagtgatacgtctcacgaccggtgctcgatttagtgtagtgtgaagggggcctaaggaagcagcactggtggtgcctcagccatggcctggaccgttctcctcctcggcctcctctctcactgcacaggatctatgacctcacatgtgctgactcagcccaccctcggtgtcagtcggccccagggagggacggccaccattacctgtgtgggagaagacattgcaaggagagtgtccatggtacaacagacggcaggccggcccgtggtcggtgtcgtctagtgataacagtcgaccggccctcgtcgatccctgacgcgtcttcctcgtggtcctccaactcgtaggggaacnccgggctaccctgaccatcaagcgagggacccgaaggccggggatcggacggccgacgtactactgccgaggtggtcgtctatacttacgtcaccccggttgttccggggccggggtaccgaacggcgtacggacccgtccgtacggtaccacggtaccaacggtcctcggtcccccgtcgggttcccacgttacccgttccgttcccccgtacccctcccgttaccgacgtaccgttactaccgtaccgtgtaccggg

SEQ ID NO: 291981 - DNA, 577 bp, Homo sapiens
  misc_feature: GYAE6OF02F63NV.9.20.B09.1.454.CMB.1.raw
  modified_base (174)..(174): a, c, t, g, unknown or other
  misc_feature (174)..(174): n is a, c, g, or t
  modified_base (336)..(336): a, c, t, g, unknown or other
  misc_feature (336)..(336): n is a, c, g, or t
  modified_base (409)..(409): a, c, t, g, unknown or other
  misc_feature (409)..(409): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtntcagtggccccagggagggacggccaccattacctgtgtgggagaagacattgcaaggaagagtgtccactggtaccaacacgaggccaggcccgggcccctggtggtggtcgtctatgataacagtcgaccggccctcgtcgactcccctgacgcgcttcnctggctccaactcgtagggacacggccacctgaccatcagcgaggcgagcggatggagcgactatactcgcgngtgtggacattatactccgtacccgtggttcgggaccgggggacagaccgtcggacccgttcgtacggtcacggtacccaacggtccctccggcccccgttcggtacccaccttacccttccggttcccccaccccgttcctacccgacgtaccggtactccgtaccg

SEQ ID NO: 291982 - DNA, 785 bp, Homo sapiens
  misc_feature: GYAE6OF02I6MCQ.9.20.B09.1.454.CMB.1.raw
tcagtgatacgtctcacgaccggtgctcgatttagtgtagtgtgaagggctgggcctaaggaagcagcactggtggtgcctcagccatggcctggaccgttctcctcctcggcctcctctctcactgcacaggactctatcgacctcacatgtgctgacctcacgcccacccgtcggttcgtcaggtcggccccgtagggagggaccggccaaccgtacgtttacccgtggtcggtagggaagaagactagttcgacgaaaggaagtaggttacgtccctacgtacggtaaacccaaacgaaggtaaccggcccgtaaccggggcccccgggtacccgttaggtcgggttacggtaccgttactaacgtacggtaattaacgtacggttcggaccccggtcccgttcggtaccgtacctcccgttagaccgtccgttctttcgtccggtcgcccttacccaacgtccgtacgggaaccgaccggccctaccgtacgacctagtccgaaggtccggaacgggacccgaagggccgggaacgtcgggaacgtaccggtacttacgttctacggtcacgtcgtggttagtcttacgcgtagttcgtagttacgggtaggttacgggtaactcggtacgggtacggacggtaactacggtacgttaccgtaccgtaccgttaacggtacccgtaacgggtacccgtaacgggtcccccgtaccggttccccccggtaaggttccctacccggttcccgtttacccggttacccccggacccgtttcccg

SEQ ID NO: 291983 - DNA, 638 bp, Homo sapiens
  misc_feature: GYAE6OF02GN8R9.9.20.B09.1.454.CMB.1.raw
  modified_base (360)..(360): a, c, t, g, unknown or other
  misc_feature (360)..(360): n is a, c, g, or t
tcagtgatacgtctcacgaccggtgctcgatttagtgtagtgtgaagggggcctaaggaagcagcactggtggtgcctcagccatggcctggaccgttctcctcctcggcctcctctctcactgcacaggatctatgacctcacatgtgctgactcagccaccctcggtgtcagtcggccccaggagggacggccaccattacctgtgtgggagaagacattgcaagggaagagtgtccacgtggtaccaacagaggccaggccgggcccctgtggtggtcgtctatgataacaggtggacccggtccctcgtccgactcccctgagccgcttctcgtggcctccaactcgtagggaacnccggcccaccctgaccatacagcgacgggccgaaggcccggggatcgggacggcccgtactacttacgtcgaccgagggtgtcggctattattacgtccctacccccggttggttccgggaccggggggtaccaacggtccgtacggtacccgttccgttacggtccgacggacccgaaggtcccgtaccgcccccgttacggtccgtacccgttccgttcccgttacccctaccctcccgtaccgtacgtaaccgtctaccgtacgtaggtaccggg

SEQ ID NO: 291984 - DNA, 611 bp, Homo sapiens
  misc_feature: GYAE6OF02FPE26.9.20.B09.1.454.CMB.1.raw
  modified_base (354)..(354): a, c, t, g, unknown or other
  misc_feature (354)..(354): n is a, c, g, or t
tcagtgatacgtctcacgaccggtgctcgatttagtgtagtgtgaagggggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccagggccgggcccctgtcggtggtcgtctatgataacagtgaccggccctcgtcgactccctgagccgctttctcgtggcctccaactcgtagggaacncggccaccctgacctatcagcacgggccgaacggccgggatggacggccgactattacgtcgccgtagggtgtggcattactactccgaccccgttgttccgggccgggggaccaacggcgtacgacccgttacgtacggtcgaccgacccgaaggtccgtaccggccccccgtcggtaccgtaccttccgttcccgttacccccgtaccccgttccctccgtacggtaccggttactaccgtaccgtggtaccggg

SEQ ID NO: 291985 - DNA, 601 bp, Homo sapiens
  misc_feature: GYAE6OF02IJXIQ.9.20.B09.1.454.CMB.1.raw
  modified_base (369)..(369): a, c, t, g, unknown or other
  misc_feature (369)..(369): n is a, c, g, or t
  modified_base (554)..(554): a, c, t, g, unknown or other
  misc_feature (554)..(554): n is a, c, g, or t
tcagtgatacgtctcacgaccggtgctcgatttagtgtagtgtgaaggggctgggcctaaggaagcagcactggtggtgcctcagccatggcctggaccgttctcctcctcggccctcctctctcactgcacaggatctatgacctcacatgtgctgactcagcccaccctcggtgtcagtggccccaggagggaccggccaccattacctgtgtgggagaagacattggacgaagggaagagtgtccacgtggtaaccaacagaggccagggccgggccccctggtcggtggtcgtctatgataacagtcgaccggccctcgtcgactccctgacgcgtcttctcgtggcctcaactcgtcgggaacncggccacctgaccatcagcagggccgaagccggggatcggacggccgactattaccgtggacccgtaggtcgtggctatatttacgtcccgaccccggttggttccgggaccgggggtaccaggccgtacggacccgttccgtaggtccacgacccgaaggccgtaccgcccccgtcggtacccncgttccgttccgttccctacccgtcctcctaacgtccgtatcctacg

SEQ ID NO: 291986 - DNA, 541 bp, Homo sapiens
  misc_feature: GYAE6OF02F4V4Y.9.20.B09.1.454.CMB.1.raw
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccgggccctggtggtgtcgtctatgataacagtgaccggccctcgtcgatccctgagcgcttctctggctccaactcgtagggacacggccacctgaccatcagcagggccgaaggccgggatggaggccgactattactgccaggtgtggcatattactccgaccccgtggttcgggcgggggacaagcgtgaccgtctacggtcgacgccgaagcctcgccccgtcggtcgaccgtcctcgttccccaccctcctaccgacgacgttactcgtacg

SEQ ID NO: 291987 - DNA, 673 bp, Homo sapiens
  misc_feature: GYAE6OF02HY150.9.20.B09.1.454.CMB.1.raw
  modified_base (298)..(298): a, c, t, g, unknown or other
  misc_feature (298)..(298): n is a, c, g, or t
  modified_base (328)..(328): a, c, t, g, unknown or other
  misc_feature (328)..(328): n is a, c, g, or t
  modified_base (458)..(458): a, c, t, g, unknown or other
  misc_feature (458)..(458): n is a, c, g, or t
tcagtgatacgtctcacgaccggtgctcgatttagtgtagtgtgaagggggcctaaggaagcagcactggtggtgcctcagccatggcctggaccgttctcctcctcggcctcctctctcactgcacaggatctatgacctcacatgtgctgactcagcccaccctcggtttcagtggccccaggagggacggccaccattacctgtgtgggagaagacattgacaaggaagagtgtccacgtggtaaccaacagaggccagggcccgggcccctggtggtggtcgtctatgataacngtcgaccggccctcgtcgatccctgacgcncttctctggcctccaactcgtacggaaccaccggcccacccgtcgaaccatccgacgcgaaggggcccgaaaggccgggggaatcggacgggcccgtaacttaacgttacgtcggaccgtagggttcggngggactaagttaattaacgtaccccgtaaccccggttcggttaccgggggaccggggggaacccaaggtccgtacggtacccgttccgtacggtccacggtacccgaaaggtcccgtccgccccccgttcggtccctaccgtccgtttcccggttccccgtccccttcccgtaccgacggtaccgttacctaccgacgttacggacggtcccggg

SEQ ID NO: 291988 - DNA, 659 bp, Homo sapiens
  misc_feature: GYAE6OF02GUDHU.9.20.B09.1.454.CMB.1.raw
  modified_base (337)..(337): a, c, t, g, unknown or other
  misc_feature (337)..(337): n is a, c, g, or t
  modified_base (446)..(446): a, c, t, g, unknown or other
  misc_feature (446)..(446): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgacaaggaagagtgtccactggtaaccaacagaggccaggcccggcccctggtggtggtcgtctatgaataacgagtcgaccggtccctcgtcgatcccgtgacgctcttcncgtcggctaccaactcgtagggaccaccggcccacccgtagaaccatcacgcgacgggaccgaagggccgggatggacggcccgtactaacgttcgcgaccgtagggtncgggactattacgttacacccgtaccccggttgggttaccgggggaccggggggaaccctaagggtccgttaccgggtaacccgttaccgtaacgggtaccaaccggtaccccgaacgggtcccgtcccggtccccccgtcgggtaccctaccgttcccgtcccgttcccccgccccttcccgtaccgtaccgtaccgtactaccgtaaccgg

SEQ ID NO: 291989 - DNA, 630 bp, Homo sapiens
  misc_feature: GYAE6OF02I4RHT.9.20.B09.1.454.CMB.1.raw
  modified_base (380)..(380): a, c, t, g, unknown or other
  misc_feature (380)..(380): n is a, c, g, or t
  modified_base (384)..(384): a, c, t, g, unknown or other
  misc_feature (384)..(384): n is a, c, g, or t
  modified_base (390)..(390): a, c, t, g, unknown or other
  misc_feature (390)..(390): n is a, c, g, or t
  modified_base (397)..(397): a, c, t, g, unknown or other
  misc_feature (397)..(397): n is a, c, g, or t
  modified_base (511)..(511): a, c, t, g, unknown or other
  misc_feature (511)..(511): n is a, c, g, or t
  modified_base (612)..(612): a, c, t, g, unknown or other
  misc_feature (612)..(612): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcacgcccacccgtcggtcgtcgagtcggcccccgagggacggggaccggccaccattacctgtgtgggagaagacagttgcgaaaggaagagtcgtccactcggtaaccaacaggaggccgacgggcccgggcccctggtcgggtggtccgtctatgaataacgcggtggacccggccctcgtcgactcccgtgacgcggtcctgcgaggcctcaactcgngacncgcacngactacncgagcgacggccgaaggccggagtagacggactacgttatcgagtaccggagtcgtggtactagttacgtaccgttacccgaccccgtttgggtacccggggacggggaacccnggtaccttacggaacccgccgttacgtaccaacgtacccgacggtcgtacccgttcccgcgttacccgacttccggtccttaccccacccttccgtaaccnggtaacttccgtgtacgg

SEQ ID NO: 291990 - DNA, 750 bp, Homo sapiens
  misc_feature: GYAE6OF02IBW6B.9.20.B09.1.454.CMB.1.raw
  modified_base (487)..(487): a, c, t, g, unknown or other
  misc_feature (487)..(487): n is a, c, g, or t
tcagtgatacgtctcacgaccggtgctcgatttagtgtagtgtgaagggggcctaaggaagcagcactggtggtgcctcagccatggcctggaccgttctcctcctcggcctcctctctcactgcacaggatctatcgacctcacatgtgctgactcacgcccacccgtcggtgtcgaggtcggcccagggacgggaccggcccaccattaccgtggtggtggggagaagactagttgacaaaggagaggtcgtccagtcggtaaccaacgaggacggccgacgggcccgggcccgttggtcggttggtcgtcgtagtaggataacggagtcggacccggccctggcgactccgtagcgcgtcgttctcgtcggctaccgtaacgcggtacggaaccgaccggtaccaccgtcgaccacgtccaagccggacgggaccgaacgggcccgggtagtacgggacgggaccgtaacgtttagttaccggngtaccggaggtcggtcggactagttacgttaaccgtcccgtaaccccgggttgggttaccgggggaccgggggtaacctaacgggtcctacggggtacccgttaacgtaccgggtacctaccgggaaccgaaccgggtcccttaccccgggcccccgtttacggtacccgtacccgtttacccggttccccgttacccccgtacccctttccggtaccgtaaccgggtaccttaacgtcccgttacggtacgggtacccgggg

SEQ ID NO: 291991 - DNA, 689 bp, Homo sapiens
  misc_feature: GYAE6OF02H9S4H.9.20.B09.1.454.CMB.1.raw
  modified_base (216)..(216): a, c, t, g, unknown or other
  misc_feature (216)..(216): n is a, c, g, or t
  modified_base (350)..(350): a, c, t, g, unknown or other
  misc_feature (350)..(350): n is a, c, g, or t
  modified_base (357)..(357): a, c, t, g, unknown or other
  misc_feature (357)..(357): n is a, c, g, or t
tcagtgatacgtctcacgaccggtgctcgatttagtgtagtgtgaagggctgggcctaaggaagcagcactggtggtgcctcagccatggcctggaccgttctcctcctcggcctcctctctcactgcacaggatctatgacctcacatgtgctgactcagccaccctcggtgtcagtcggcccaggacgggacggccacattacctgtgtggganaagacattgacaaaggagtagtgtccacgtggtaccaacgaggacggaccagggcccgggcccctggtcggtggtcgtactagtggaactaacgagtcgaaccggccctcggtcacgtccctgacgcgtcttcncgtcgcnccgaactcgtacggacaccggcccaccgtacggtaccagtccacgcgtagggcccgaacgcgggatcggacgccgactagttacgtgaccgaggtgtcggacgtatagttaccgtaccgtaccccggtacgggtttccgggaccggggggtaacccacgggtaccgttaccggtacccggtacccgttacgggtaccgaaccggacccgtaaaccgggtcccgttacccgggtccccccgtccgggtaaccgtcccgttcccggtcccgtttcccccgtccccgttacccgccgttaacccgggtaaccgttaccggtacccttaacccggg

SEQ ID NO: 291992 - DNA, 781 bp, Homo sapiens
  misc_feature: GYAE6OF02FZBZG.9.20.B09.1.454.CMB.1.raw
tcagtgatacgtctcacgaccggtgctcgatttagtgtagtgtgaaggggggcctaaggaagcagcactggtggtgcctcagccatggcctggaccgttctcctcctcggcctcctctctcactgcacaggatctatgacctcacatgtgctgactcagcccaccctcggtgtcagtcggccccagggagggacggccaccattacctgtgtggagaagacattgcaaggaagagtgtccacgtcggtaccaacaggaggccaggcccgggcccctggtggtcggtcgtctatgataacagtcgaccggtccctcgtcgactcccgtagacgcgtcttcgtctcggtcctaccaacgtccgtacgggaaccgaccgggcccacccgtgaaccctatacctaaggccgaacggggacccggaaacgggcccggggggtaatacgggaacgggcccggtaaacgttaacgtttaaccgtcggacccggtaagggttcggtgggaccctaagttaacgtttacctaccccgtacccccggggtttgggttacccggggaaccgggggggtaaccctaaacgggtccgttcggtaaccccggggttaccgtaaccgggttaccgaaccggaccccgtaaacgggtcccgttacccgggtccccccgttaccgggtaccctaacccgttaccggtttaccccggtttacccccctaaccccgtttaccccgtacccgtaaccggtaaaccgtttaccgttaccccgtaacgttcgggtaacccggg

SEQ ID NO: 291993 - DNA, 587 bp, Homo sapiens
  misc_feature: GYAE6OF02IFQQU.9.20.B09.1.454.CMB.1.raw
  modified_base (236)..(236): a, c, t, g, unknown or other
  misc_feature (236)..(236): n is a, c, g, or t
  modified_base (299)..(299): a, c, t, g, unknown or other
  misc_feature (299)..(299): n is a, c, g, or t
  modified_base (353)..(353): a, c, t, g, unknown or other
  misc_feature (353)..(353): n is a, c, g, or t
  modified_base (362)..(362): a, c, t, g, unknown or other
  misc_feature (362)..(362): n is a, c, g, or t
  modified_base (420)..(420): a, c, t, g, unknown or other
  misc_feature (420)..(420): n is a, c, g, or t
  modified_base (430)..(430): a, c, t, g, unknown or other
  misc_feature (430)..(430): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtcggccccaggacgggacggccaccattacctgtgtgggagaagcattgacaaggaanagtgtccactggtaccaacagaggccaggccgggcccctggtggtggtcgtctagtgataacnggtcgaccggccctcggtcgactccctgacgcgtcttctcgtggctaccaactntcgggaacnccggccacctgaccatcagcagggccgaaggccgggatacggagccgaactagttacncgccaggtgnggtctattacttactccgtaccccggttaggttccgggacgggggaacctacgcgtacgtaccgtcgtacggtcaccgccgacgtccgtccgtaccccgtcggtccaccgttcctcgtcccccgtccgttcctaccgacgtacgttactcgtaccgg

SEQ ID NO: 291994 - DNA, 822 bp, Homo sapiens
  misc_feature: GYAE6OF02GMJSE.9.20.B09.1.454.CMB.1.raw
  modified_base (200)..(200): a, c, t, g, unknown or other
  misc_feature (200)..(200): n is a, c, g, or t
tcagtgatacgtctcacgaccggtgctcgatttagtgtagtgtgaagggggcctaaggaagcagcactggtggtgcctcagccatggcctggaccgttctcctcctcggcctcctctctcactgcacaggatctatgacctcacatgtgctgactcagccacctcggtgtcagtcgccccaggaggacgccacattaccngtgtggagaagacattgacaaggagtagtcgtaccacgtggtaaccaacgaggacggccgagggcccgggaccctggtcggtcggtcgtctaatggaataacgagtcggacccggcctcgtcgactcccgtgacgcgtcttctcgtcggacctaccgaaaccgttcgtacggggaaccaccggcccaacccgtgaaccctagtccgaacggccgtaacggggacccgaacgggacccggggagttacgggacgggtacccgaacgttaacgttaacgtcggtacgtaggggttcggtcggggtcgttacgggtagtaagttaaacgtcggtaacgttacggtaaggtttccggggggtaaccggggggtttcggggttacccggggaaccgggggtaaccggggtaaacccgtaaaccggggttaccgttaaaccgggtaaccccggtttaacccggttaacggttaccccggtaacccggaacccccgggtttaaacggggtccccgttaccccgggtaccccccccgggtttagggttaaacccccttcccggtttacccgtttaccccggtttacccccccgtaccccccggtttaccgttaacccggttaaacccggg

SEQ ID NO: 291995 - DNA, 801 bp, Homo sapiens
  misc_feature: GYAE6OF02INACF.9.20.B09.1.454.CMB.1.raw
tcagtgatacgtctcacgaccggtgctcgatttagtgtagtgtgaaggggctgggcctaaggaagcagcactggtggtgcctcagccatggcctggaccgttctcctcctcggccctcctctctcactgcacaggatctatgacctcacatgtgctgactcagcccacccgtcggtgtcaggtcggccccgagggacggggaccggccaacctactttacctggtggtaggggaagaagactagttgacgaaggaagagtcgtaccacgtcggtaaccaagacggacggaccgacgggccccggggcccctggtacgggtcggtcgttactagtgaactaacgaggtcggacccggccctgccgtactcccgtaggacggccgttccttcgtcgtggcctacaaacgtcgtacgggaaccaccgggccctacccgtacgaaccctaacgtacgacggaccggaaccggggtaccggaaacggggcccggggtataccgggaacggaacccgttaacgtttaacgttaccgacggtaccggtaggttcgggtacggtaacttaacgtttaccgtttaacccgtacccccggttaccccgggtttaggggttaccccgggggaccgggggaaacccgttacgggaccgttacccgggtaccggttacccggacggtaaccgaacccggtaccgtacggtcccggtacccgtcccccggtttacggtaaccctcgtttcccggttccccgttaccccccgttacgttaccggttaccgaacggttaccgtactaccggtaccgg

SEQ ID NO: 291996 - DNA, 550 bp, Homo sapiens
  misc_feature: GYAE6OF02FUS1U.9.20.B09.1.454.CMB.1.raw
  modified_base (396)..(396): a, c, t, g, unknown or other
  misc_feature (396)..(396): n is a, c, g, or t
  modified_base (413)..(413): a, c, t, g, unknown or other
  misc_feature (413)..(413): n is a, c, g, or t
  modified_base (434)..(434): a, c, t, g, unknown or other
  misc_feature (434)..(434): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggaggacggccacattacctgtgtgggagaagacattgcaaggaagagtgtccactggtaaccaacagaggccaggcccggccctgtggtggtcgtctatgataacgagtgaccggtccctcgtcgattcccctgacgcgcttctctggcctccaactcgtagggaacctacggcccaccgtgaccatcagcagggccgaaggccgggancggaggccgactatacngccgaggtgtggcatattacnccacccgtgttcgggcggggaccaggcctgaccgtcgtaggccacgaccgagtccgtcgccccgttcggcctacgtcctcgttccccaccctcctaccgacgtacctagtcctacg

SEQ ID NO: 291997 - DNA, 638 bp, Homo sapiens
  misc_feature: GYAE6OF02GBCYN.9.20.B09.1.454.CMB.1.raw
  modified_base (292)..(292): a, c, t, g, unknown or other
  misc_feature (292)..(292): n is a, c, g, or t
  modified_base (329)..(329): a, c, t, g, unknown or other
  misc_feature (329)..(329): n is a, c, g, or t
  modified_base (579)..(579): a, c, t, g, unknown or other
  misc_feature (579)..(579): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggaggacggccaccattacctgtggtgggagaagacattgcaaggaagagtcgtccacgtcggtaccaacgagaggccagggcccgggcccctggtggtggtcgtntatgataacgagtcgaccggccctcggtcgactcccngacgccgtcttctctggcctccaactcgtacgggaaccaccggcccaccgtcgaccatcgagcgacgggccgaacggccggggagtcggacgggccgtaacgttagtaccgtcgccggaggtggtggcctattacgttactcccgtaccccggttcgggttccggggaccggggggacccaacggtcgtccggaccggttccgtacggtacgaccgacccgtaggtccctccgtcccccggtcggtaccnccgttaccgttcccgttaccccgacccttcccgtaccgacgtaccggtacctccgtacg

SEQ ID NO: 291998 - DNA, 623 bp, Homo sapiens
  misc_feature: GYAE6OF02HFBAO.9.20.B09.1.454.CMB.1.raw
  modified_base (334)..(334): a, c, t, g, unknown or other
  misc_feature (334)..(334): n is a, c, g, or t
  modified_base (359)..(359): a, c, t, g, unknown or other
  misc_feature (359)..(359): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacgccaccattacctgtgtgggagaagacagttgcaaggaagagtgtccactggtaccaacagaggccgaggccgggcccctggtggtggtcgtctatgataacagtcgaccggcccgtcgtcgactcccgtgagcgcttcncgtggcctccaactcgtgggaaccncggcccacccgtgaccactcagccgacgggccgaacggccgggagtggacgggccgaacgttacttaccgtcgccgtaggtggtcggactattacgttacgtcccgtaaccccggttcgggtttaccggggccggggggtaaccacggccgtacggtacccggttccgtaacgggtcaaccggacccgaaggcccgtccggcccccgtcggtcctaccgtccgtccgttccccgtcccctcctacgacgtaccgtactctaccg

SEQ ID NO: 291999 - DNA, 703 bp, Homo sapiens
  misc_feature: GYAE6OF02IRWIU.9.20.B09.1.454.CMB.1.raw
  modified_base (695)..(695): a, c, t, g, unknown or other
  misc_feature (695)..(695): n is a, c, g, or t
tcagtgatacgtctcacgaccggtgctcgatttagtgtagtgtgaagggctgggcctaaggaagcagcactggtggtgcctcagccatggcctggaccgttctcctcctcggcctcctctctcactgcacaggatctatgacctcacatgtgctgactcagccaccctcggtcgtcagtcggccccaggagggacggccaccgattacctgtgtgggacgaagacattgcaaggaagagtagtccaactggtaacaacagagccgaaggccggaccctggtggtcggtcgtctagtgactaacagtagaccggacctcgtcgacgtcccctggacgcgtaccttcgtacgtcggtcctaccaaccgttacgtacggggtaaaccaccgggtacccctaaacccggtcggtaaaccctaacgtaccgaacgtaccggacggggaacccgaacggggaccggggaacgtacggaaccgggccggtaacgttaacgtacgttacgaccgtaacgggtcggacggtaccgaagttaagttaactacccgtaacccgttgggttaccggggacgggggtaacccgaacggtacgttaccgacgttacccgtaaggtccgaaccggaccgtaacgccgtaccgtccccgtacgggtcccaacgttccgtacgttcccgtccccgtacctcaacgtcgttancccgtacg

SEQ ID NO: 292000 - DNA, 713 bp, Homo sapiens
  misc_feature: GYAE6OF02IR5HU.9.20.B09.1.454.CMB.1.raw
tcagtgatacgtctcacgaccggtgctcgatttagtgtagtgtgaagggggcctaaggaagcagcactggtggtgcctcagccatggcctggaccgttctcctcctcggcctcctctctcactgcacaggatctatgacctcacatgtgctgactcacgccacccgtcggtgtcagtcggccccgagggagggaccggccacctattaccgtggtggtgggagaagacattgcgagggaagagtgtccacgtggtaaccaacgaggtacggccgaacgggcccgggccccgttggtcggtcgggtaccgtctacgtaggaactaacgaggtcgacccggccctcggtacgactcccgtcggacgccgtcgttcgtccgtcggccctcctaaacgtccgtacgggaaaccgtccggacctaacccggtcaaccgtactcgaacgaccgacggggtacccgaagggaccggacgtacggacggtaccgtaacgttacgtacgtacgcgtaggtacgtacggactagttacgttacgtacccgtacccggttaggttccgggaccgggggacctaacggtccgtacggtaccgtccgtacggtacgccgtaccgaacggccgtaccgccccgtcgtaccgtaccgtcccgttaccgtccccgtacccgttccgtacgtacggtacccgttaacgtaccgtacggtacggtaccggg

SEQ ID NO: 292001 - DNA, 932 bp, Homo sapiens
  misc_feature: GYAE6OF02JGKIQ.9.20.B09.1.454.CMB.1.raw
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcacgccaccctcggtgtcacggtcggccccgagggacggggaccggccaaccactttaccctggttaggtaggggacgaaggactattcgacgaaagggaagtaggtcgttaccacgtacggtaaccaaacgaggacggccggaacggggccccgggccccgttgggtcgggttacgggttccggtacgtttaacgttaggtaaaccgttaaacggtaacggttaccgggaacccccgggttcccccgtttacgggtaccccggtaaccgtttaccccggttgggtaacccgggcccggtttaccgttttcccgttcccgttcgggtacccctttacccgtaaaaccgttcccggttaaacggggaaccccgtacccgggtaccccgtaaccccgttacggaacccgtaccttacccgagggacccggaaacgggggtacccgggaaaccggggacccggggggaacgttaccggggaaaccgggaccccgtaacgttaacgtttaccggaccggtaccggtacgggttcggtacgggtaaccttaacgtttacgttaaccgttaccccgtaccccgggttacgggttacccgggggaccggggggtaacctacgggtccgtacccgggtaacccggttacccgttacgggacccgaaccggtcccggtaaccggacccgttcccgtacccccggtacgttcccgtaccgttcccgttcccgttaccccggtccctcccggttccctaacggtaccgttaccgtaccgtccgg

SEQ ID NO: 292002 - DNA, 691 bp, Homo sapiens
  misc_feature: GYAE6OF02G0B2K.9.20.B09.1.454.CMB.1.raw
  modified_base (256)..(256): a, c, t, g, unknown or other
  misc_feature (256)..(256): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtcggcccaggagggacggccaccattacctgtggtgggagaagacattgacaaggaagagtgtccactggtaaccaanagaggccagggccggcccctggtggtcggtcgtctagtgaataacgaggtcgacccggcctcggtcagttccctagacgcgtcttctcgtcggctcccaatccgtaggggaacctacgggccctacccgtgacctatccgaggaccgacgggaccgaacgggccgggagtcggaacgggacccgtaagttaacgttaccgttcggaccgtaggggtgtcgggtaacctaagtttaacttacgtccccgtaccccggttggtttaccgggggaccggggggtaaaccacggtaccgttccggaaccccgttcgtaacggtccaaccggacccggtaacgccgttcccggtcccccgttacgggtacctaacccgttccgtaccgtttccccccgaccgttcccgttaccgacgtaacccgttctacccgtaaccgg

SEQ ID NO: 292003 - DNA, 820 bp, Homo sapiens
  misc_feature: GYAE6OF02IUPK2.9.20.B09.1.454.CMB.1.raw
  modified_base (192)..(192): a, c, t, g, unknown or other
  misc_feature (192)..(192): n is a, c, g, or t
tcagtgatacgtctcacgaccggtgctcgatttagtgtagtgtgaagggtaaaggggccgtggtgaacggcttcacgtagtccctggaccttcctgtgcaagaacatgaaacatactgtggttcatcctcctcctggtggcgagctcccgagtagttcgggtcctgtcccgaggttcgcggtactgcaaggnggtcgggacccaggactaggtggaagccctttacgacggtacgggccccttgggtaccccctcgaccggttcgaccgtacgttcgttcccttagtgggtacgacctccgataccgaggtaggttcggttccgttacctagtcggaccgttaggacgttccgggcgtaccggtcccggaccggcgaaacggggtacgtaggggtacgttagtacgttgggaacgtaaattccgtaaagtcgaccgtagggtccgggaccgacctaagttacccgaaaccgtaaccccggttccctaaagaaacggtacgggttaccgaaagttccgaacggtacctaagtccggtaacgaggtaccaaaccgtacccgtaaccgaacgtaaaccgtacgttaccgtacccgtacgtaacgaggtacgtaacgttaagtacgttaaccggaccgtaccgaccgaacgtaccgtaccggtacgttacgtaacgttacgtagtacggacggtaggtaacggtaccggttacgtttaacggttacgaccgtacggtacgttaacgttaaaccgttcgtaaccgttacggttacggttacggtacggtccggtacgggtaccgggtacggtacggttaaccggg

SEQ ID NO: 292004 - DNA, 766 bp, Homo sapiens
  misc_feature: GYAE6OF02IHI9T.9.20.B09.1.454.CMB.1.raw
  modified_base (150)..(150): a, c, t, g, unknown or other
  misc_feature (150)..(150): n is a, c, g, or t
  modified_base (425)..(425): a, c, t, g, unknown or other
  misc_feature (425)..(425): n is a, c, g, or t
  modified_base (591)..(591): a, c, t, g, unknown or other
  misc_feature (591)..(591): n is a, c, g, or t
tcagtgatacgtctcacgaccggtgctcgatttagtgtagtgtgaagggcgtgggcctaaggaagcagcactggtggtgcctcagccatggcctggaccgttctcctcctcggcctcctctctcactgcacaggatctatcgacctcacntgtgctgactcacgcccacccgtcggtgtcaggtcggccccgagggacgggaccggccaccattaccgtgtaggtgggagaacgactagttgacaaggtaagagtgtccacgtacggtaaccaaacgaggacggaccgagggccccgggtcccctggttcgggtcggtccggtactagtagaactaaaccgagtccggaacccggtcccttcggtacgaactccccgtaggacgtccgtcgttcctcgcggtactaccaacgttcgacgggaacncccggtacccaccgtcgaccaagttccgaacgccggaacgggcccggaaagggcccggggagttacgggaaccgtccgtaaacttacgtaccgtcgacgtacgggtgtacggactagttaacttaccgtcccggtacccgttcggggttacggggacccggggtanaaccggtctaaccggtacccgtagttacccgggcgtaaacccgtaccgaaccggtcccgtcccggtccccccgggttacggaccttaacccggttacccgtttccccggttccccccgacccgttttccccgacggtttaaacccgggtaccttacccggtttaccaacccgggg

SEQ ID NO: 292005 - DNA, 691 bp, Homo sapiens
  misc_feature: GYAE6OF02JXCBQ.9.20.B09.1.454.CMB.1.raw
  modified_base (257)..(257): a, c, t, g, unknown or other
  misc_feature (257)..(257): n is a, c, g, or t
  modified_base (361)..(361): a, c, t, g, unknown or other
  misc_feature (361)..(361): n is a, c, g, or t
  modified_base (366)..(366): a, c, t, g, unknown or other
  misc_feature (366)..(366): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccacccgtcggtgtcagtcggccccaggagggacggccaccattacctgtggtgggagaagactattgcgaaggagagtgtccactggtaccaanagaggcctaggccgggccccgtgtacgggtggtacggtctagtgactaacgagtcgacccggcctcgtcgactccctgacgcgtcttctctggcctcaactcgnggacncggccacctgaccatcgacgcgtacgggaccgacggccgggagtcggaggaccggtacgtagttacgtcggaccgtaggtacggtcggcgtaagtattacgtccccgtacccggttccgggttacgggtccgggggggaaccaacggtccgttacggtaccccgttaccggtacggtaccggaaccggaccccgtaacggacccgtaccgggtccccccgttacccgggttccttaaccggttcccggtttaccccggtttcccctaaccccgtttccccgtaccggtaacccggtaacccggttaccgttacccgtaaccccgg

SEQ ID NO: 292006 - DNA, 748 bp, Homo sapiens
  misc_feature: GYAE6OF02JBHQN.9.20.B09.1.454.CMB.1.raw
  modified_base (253)..(253): a, c, t, g, unknown or other
  misc_feature (253)..(253): n is a, c, g, or t
  modified_base (295)..(295): a, c, t, g, unknown or other
  misc_feature (295)..(295): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggcggccaccattacctgtggtggagaagacattgcaaggaagagtgtccacgtggtaccaanagaggccaggccgggcccctgtggtgtcgtctagtgataacngtcgacccggccctcggtcgacttccctgacgccgtcttcctcgtggcctccaactcgtagggaaccacggcccacccgtcgaaccctatcgacgtacgacggggaccgaacggccggggagtacgggacgggacccgaccgttagttaccgtacggtacccgtagggtcggtggtactaagttacgtttaccgtacccgtacccccgggttgggtttacccggggaccgggggggttacccgaaacggtcccgtacggtaccccggttaccgttaacgggtcccaacgggtaccccgaacgggtacccgttacccggtacccccccgggttccgggttaccccgttaacccgttaccccggtttccccgttttaaccccccccgtacccccgtttccccgttaccccggtaaccccggtttaacccggttaacccgttacccggtaacccgg

SEQ ID NO: 292007 - DNA, 747 bp, Homo sapiens
  misc_feature: GYAE6OF02HKGEM.9.20.B09.1.454.CMB.1.raw
  modified_base (299)..(299): a, c, t, g, unknown or other
  misc_feature (299)..(299): n is a, c, g, or t
  modified_base (339)..(339): a, c, t, g, unknown or other
  misc_feature (339)..(339): n is a, c, g, or t
  modified_base (353)..(353): a, c, t, g, unknown or other
  misc_feature (353)..(353): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcacgcccaccctcggtgtcagtcggccccaggagggacggccaccattacctgtgtgggagaagacattgacgaaaggaagagtgccacgtcggtaaccaacgaggacggccgacggcccggccctggtggtcggtcgtntagtgaataacaggtcgaccggtccctcgtcgactcccgngacgtcgtctttcncgtcggtcctccaactcgtacgggaccaccggccaccctcgaaccgtactacgacgaccgacgggacccggtaaggacccggggagtcgggaacgggtccgtaacgtactttacgcggtacccggtaacgggtcggttacggacgttaagttacgtttaacgtccccgtaccccggtttacggggttaccggggacccggggggttaaccctaacggtccgttaccggtaacccggttccggtaaaccggtccgaaccggacccggtaaccggaccgttcccggtaccccccggttcgggttacccttaaccggttcccgttaccccgggttcccccgtaccccgtttaccccgtaccggttacccggtaacgttacccgtacccgttaaccgg

SEQ ID NO: 292008 - DNA, 743 bp, Homo sapiens
  misc_feature: GYAE6OF02GR7VP.9.20.B09.1.454.CMB.1.raw
tcagtgatacgtctcacgaccggtgctcgatttagtgtagtgtgaaggggctgggcctaaggaagcagcactggtggtgcctcagccatggcctggaccgttctcctcctcggcctcctctctcactgcacgaggatctatgacctcacatgtgctgactcacgcccacccgtcggtgtcaggtccggccccgagggacggggaccgccaacctacttaccgtgtggtagggagaagactagttcgacgaaagggaagtaggtcgtaccgtacgtacggtaaccaacgaggacggccgacgggccccgggccccgtaggtgggtcggtccgtctagtacgaataacgagtcggacccggtccctcgtacgactcccgtgacgccgttcttcgtcgtcggcctaccaacgtcgtacgggaaccgaccggcccacccgtcgacctagtaccgacggaccggacggggacccggaacggggacccggggagtacggggaccgggtaccgtaacttaacgttacgtacgtaccggtagggttacggtggtactacgttacgtttaccgtaccccgtaccccgggttgggttccgggggaaccgggggtaacccacggtccgtacggtacccgttaccgtacgggtaccgaacgcccgaaggtcctcccggtccccggtcggtacccgtaccttcccgtacccgtaccccgtacccgtcctaccgtaacggtaccgttctacgtacgg

SEQ ID NO: 292009 - DNA, 779 bp, Homo sapiens
  misc_feature: GYAE6OF02IVPHK.9.20.B09.1.454.CMB.1.raw
  modified_base (217)..(217): a, c, t, g, unknown or other
  misc_feature (217)..(217): n is a, c, g, or t
  modified_base (308)..(308): a, c, t, g, unknown or other
  misc_feature (308)..(308): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtcggccccaggagggacgccaccattacctgtgtggganaagacattgacgaaggaagagtgtaccactacggtaccaacaagaggcccagggccccgggccccttggaggtcggtcgtctatgataacnggtcgaccggccctgcgactcccgtgacgcgtacttctcgtcggccttacccgaacttcggtacgggaaaccacccgggtacccctaaccccgttagaaccctaacgttcccgaaaggcccggaaaggggggtaccccgaaacgggggccccggggaaggttacgggaaccgggtcccggtaaacgttaccggtttaacgtccggtacccggtaagggttcgggtacggtacgtaacgttaacgtttaacctacccggtaacccccggtttcgggtaccgggggtaccgggggtaaccctaacgggtccgtacggtaaccccggttccgtttaaccgggtacgacccggtaacccgaacggttacccgtcccgtcccccgttccgggttacccgttaccgtcccgtttcccggttaccccctaccccgtttccccgaccgttaacccggtaccgttcttaacccgtaccgg

SEQ ID NO: 292010 - DNA, 710 bp, Homo sapiens
  misc_feature: GYAE6OF02I0D6L.9.20.B09.1.454.CMB.1.raw
  modified_base (169)..(169): a, c, t, g, unknown or other
  misc_feature (169)..(169): n is a, c, g, or t
  modified_base (243)..(243): a, c, t, g, unknown or other
  misc_feature (243)..(243): n is a, c, g, or t
  modified_base (517)..(517): a, c, t, g, unknown or other
  misc_feature (517)..(517): n is a, c, g, or t
  modified_base (535)..(535): a, c, t, g, unknown or other
  misc_feature (535)..(535): n is a, c, g, or t
  modified_base (590)..(590): a, c, t, g, unknown or other
  misc_feature (590)..(590): n is a, c, g, or t
tcagtgatacgtctcacgaccggtgctcgatttagtgtagtgtgaagggcgtgggcctaaggaagcagcactggtggtgcctcagccatggcctggaccgttctcctcctcggcctccgtctctcactgcacaggatctaatgacctcacagtgtgcctgacctcgacncccaccgtggtgtcagtcggacccccaggacgggaccgccacctagtttaccgtgttggtgggagaacgacgtnttacgcgaaggtagacgtcgcctacgtacggtaaccaacgagacggtccgacggccccggtaccccgtggtcggtgtaccgtcgttactgtaactacgtacggtacggacccggtccctacggtccggaacctttccccgaggtaaccggccgtccgtttccgtacggttcgccctacctaccgtcggtagggaaccgccggaccctaccgtcgaccacgtcgactccgggtacgggaccgtaaaggggcccgggtagacggtacggaccggtntaacgttccgtcgaccgnggttcggcgatcttaatccgcccgttacccgtttcgggtacggggaccggaccgntccgtacgtcgtaccgttcgacgtaacgacccgttacggaccgtccgtaccccgtgttaccgaccttcccgttacccgcccttacccgttactcccgtaagtacccttaggctaaccggg

SEQ ID NO: 292011 - DNA, 726 bp, Homo sapiens
  misc_feature: GYAE6OF02FMG8C.9.20.B09.1.454.CMB.1.raw
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtcgctgactcagcccaccctggtgtcagtcggcccaggagggaccggccaccacttaccgtgtggtaggggagaagtaccagttgacgaaaggaagagtcgtccacgtcggtaaccaacgacgacggccagggcccgggcccctgtgggtcggtcgtctatgataacgagtcgaccggccctcggtcgactcccgtgacgcgtccttctcgtggcctccgaatcgtacgggaaccaccggcccaccgtcgacctatacacgcgacgggaccgacggccggggaatcggacggacccgtaactacgttaccgtggacccgtagggtcgtacggacgttaagttacgtttactacccgtaccccggtttcggttacgggggtaccgggggacctaaacgggtccgttaccgggtaccgtttaacccggtacggtaccgtaaccgggtaccccgacggggtccttccccggacccccgtttaccgggtacccgtaccctttccggttcccgtttaccccccggttcccttacccggtttaacccgaacccgggttaccttacccggttaccaaccggg

SEQ ID NO: 292012 - DNA, 806 bp, Homo sapiens
  misc_feature: GYAE6OF02I58BK.9.20.B09.1.454.CMB.1.raw
  modified_base (689)..(689): a, c, t, g, unknown or other
  misc_feature (689)..(689): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcacgcccacccgtcggtcgtcaggtcggccccgagggacgggaccggccaacctacgtttaccgtggtggtaggggaagaacgaactagttacggaacgaagggaaggtacggtacgtaccgacgtacggtaaccaaacgaggacggcccgaacggggccccgggccccgttggttacggggttcggttaccgttaccgttagtacggaacttaaaccggcggtttaccggaccccggtccccgttacggtaccggaaccgttcccgtggaacggtccgttaccgtttccgtcgtcggtccctacctaaaccgttcggtaaccgggaaccgaacccgggcccctaacccgtacgaaccctagtaccaacggcggacccgggggacccggaacggggtaccggggagtacgggaccgggacccgtaacgttaaccgttccgtcggtacggtaacgggttggtacggtactaacgtttacgttacctaccccgggtaccccggtttgggtacccggggaccgggggtaaccncggtacgtacggtacccgttcgtacggtaccacgaccgacggtccacccgcccgtcgtccctacgttcccgtacccgtaccctaccgtaccgtacgaccgtacttcgtaccgtacgg

SEQ ID NO: 292013 - DNA, 571 bp, Homo sapiens
  misc_feature: GYAE6OF02FZCJU.9.20.B09.1.454.CMB.1.raw
  modified_base (272)..(272): a, c, t, g, unknown or other
  misc_feature (272)..(272): n is a, c, g, or t
  modified_base (349)..(349): a, c, t, g, unknown or other
  misc_feature (349)..(349): n is a, c, g, or t
  modified_base (382)..(382): a, c, t, g, unknown or other
  misc_feature (382)..(382): n is a, c, g, or t
tcagtgatacgtctcacgaccggtgctcgatttagtgtagtgtgaagggaaatggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtgtcgttccatggacctggatccggnagtccgccggcaagggacctgggatatagttggacgaaatctaatcgccagtgggacctccatctacaacccgtccnaagagtcgagtcagcatgcagtcacacgtccanaaccagttctcctgacagtgagttatactcgtaccgcgcacgacacggccgtagttactactgtgacgaagaggaaggtaccgtttagttttacggaaccgtaggtacgtaacgtttaaaaaccgtccgttaacgttaacggtacgttacgggaccggttacggtacggggacccgtaggggaacccgg

SEQ ID NO: 292014 - DNA, 779 bp, Homo sapiens
  misc_feature: GYAE6OF02HH8I4.9.20.B09.1.454.CMB.1.raw
tcagtgatacgtctcacgaccggtgctcgatttagtgtagtgtgaaggggctgggcctaaggaagcagcactggtggtgcctcagccatggcctggaccgttctcctcctcgcctcctctctcactgcacaggatctatcgacctcacatgtgctagactcacgcccaccctcggtgtcaggtccggcccgagggaggggaccgccacctacttaccgtggtggtagggaagaacgactattggacgaaagggaagacggtcgtaccacgttcggaaaccaaacgacggacggacgacgggtccccgggcccttggtacgggtcggtcgtctaagtagaataaacgaggtacggaccccgtccctcggtaccgaactcccgtagacgtcgtcttcgtccgtggtacctacaaccgttcggacgggaaccaccggtcccaccgtcaaccgtacacggacggaccgaacgggggacccggaacggggaccgggtaacgtacgggaccggtaaccggtacttaacgttaccgtaccggcgaagggttcgtaaggctaagttaacgttaccgtaaccccgtccgggttacggggttcgggggaacccggggtaaacctacggtccggttacccggtaacccggttaccggttaacggtcgaaacccgtaccgaacggtcccgttaccccggtcccccggttaacggtacccgttccgttaacccggttcccgttcccccggaacccgtttccgaagtacccgggtacttacgacccgttcggg

SEQ ID NO: 292015 - DNA, 511 bp, Homo sapiens
  misc_feature: GYAE6OF02ISA2T.9.20.B09.1.454.CMB.1.raw
  modified_base (309)..(309): a, c, t, g, unknown or other
  misc_feature (309)..(309): n is a, c, g, or t
  modified_base (321)..(321): a, c, t, g, unknown or other
  misc_feature (321)..(321): n is a, c, g, or t
  modified_base (362)..(362): a, c, t, g, unknown or other
  misc_feature (362)..(362): n is a, c, g, or t
  modified_base (413)..(413): a, c, t, g, unknown or other
  misc_feature (413)..(413): n is a, c, g, or t
  modified_base (438)..(438): a, c, t, g, unknown or other
  misc_feature (438)..(438): n is a, c, g, or t
  modified_base (459)..(459): a, c, t, g, unknown or other
  misc_feature (459)..(459): n is a, c, g, or t
  modified_base (501)..(501): a, c, t, g, unknown or other
  misc_feature (501)..(501): n is a, c, g, or t
  modified_base (505)..(505): a, c, t, g, unknown or other
  misc_feature (505)..(505): n is a, c, g, or t
tcagtgatacgtctcacgaccggtgctcgatttagtgtagtgtgaaggggctgggcctaaggaagcagcactggtggtgcctcagccatggcctggatcgttctcctcctcggcctcctctctcactgcacaggctctgtgacctcctatgtgctgactcagccaccctcggtgtcagtggccccaggagagacggccaggataacttgtagaaagaaacatacattggaggtgttaatgtacactggtaccagcagaagccaggccaggcccctgtgctggtcctcatcatactagcgaccggccctnagggactcctgngcgattctcaggctaccactcgtagggaaaacgccaccgtnaccatcagcaggggtacgaaggaccgggagtggacggccgacttattacgngtcgaggtgtgggctggtatataangatcagtggtcgggtgtcggnggaggacagactgacgtcgagtcagtccaggctcgccctgcnctcngtcccg

SEQ ID NO: 292016 - DNA, 951 bp, Homo sapiens
  misc_feature: GYAE6OF02IPOND.9.20.B09.1.454.CMB.1.raw
  modified_base (238)..(238): a, c, t, g, unknown or other
  misc_feature (238)..(238): n is a, c, g, or t
tcagtgatacgtctcacgaccggtgctcgattttagtgtagtgtgaaggggctgggcctaaggaagcagcactggtggtgcctcagccatggcctggaccgttctcctcctcggcctcctctctcactgcacgaggactctatcgacctcaacatgtgctgactcacgcccacccgttcggtgtcaggtcggaccccagggcgggaccggcccaacattacctggtaggtacgggaanaagactagttcgacgaagggaagacgtacgtcctactcggtaaccaacgtaggacggaccgtacggggaccccggggtcccgtagggtcgggtcggggttaccgttacttaagttaacggtaacgttaaaccgtacgggttcggaaccccggttccctaccggtccgtaaccgttcccgtaaggccggtccgttactttcgtccgttcggacccgtttacccgaacgttccggtacgggaacctacccggtaccccctaaccgtacggtaaccccacgtcccggaacggtacccgggaccgggggtaacccggaaaccgggggtccgggggttaaccgtacggggtaccgggggtaaccctaaacggttttaccggtttaccgtccgggtaacccggtacggggttacgggacgttaaccttaacgtttaaccgtttaccccgttaccccgggttaacccccgggttttggggttaaccccgggggggtaccgggggaaaccccttacggtacccggtttaccgggttaaccccgggtttacgttaaccgggtacccgacccggtaacccgggtacccgggtaccttacccccgggtttccccccggaagggttccccttaacccggtttacccggttaccccggtttcccccggtaccccgtttcccgtaacccggtaccgggtttaaccccttccgggttaccccaagggg

SEQ ID NO: 292017 - DNA, 540 bp, Homo sapiens
  misc_feature: GYAE6OF02G0JM9.9.20.B09.1.454.CMB.1.raw
  modified_base (170)..(170): a, c, t, g, unknown or other
  misc_feature (170)..(170): n is a, c, g, or t
  modified_base (504)..(504): a, c, t, g, unknown or other
  misc_feature (504)..(504): n is a, c, g, or t
  modified_base (516)..(516): a, c, t, g, unknown or other
  misc_feature (516)..(516): n is a, c, g, or t
  modified_base (523)..(523): a, c, t, g, unknown or other
  misc_feature (523)..(523): n is a, c, g, or t
  modified_base (532)..(532): a, c, t, g, unknown or other
  misc_feature (532)..(532): n is a, c, g, or t
  modified_base (534)..(534): a, c, t, g, unknown or other
  misc_feature (534)..(534): n is a, c, g, or t
tcagtgatacgtctcacgaccggtgctcgatttagtgtagtgtgaagggggcctaaggaagcagcactggtggtgcctcagccatggcctggaccgttctcctcctcggcctcctctctcactgcacaggatctatgacctcacatgtgctgactcagccaccctcggtntcagtggccccaggagggacggccaccattacctgtgtgggagaagacattgcaaggaagagtgtccactggtaccaacagaggccaggcccggcccctgtggtggtcgtctatgataacagtgaccggccctcgtcgactccctgagcgcttctcgtggcctccactctgggaacacggccacctgaccatcagcagggccgaaggccggggatggacggccgtaacttatactgccgagggtgtggctattattactccgtaccccgtggttccgggccggggaccagccgtcggaccctcgtacggcacgcccagcctcgcccctggtccnctctccgtcccncccttcncacgctacncnctgcgg

SEQ ID NO: 292018 - DNA, 795 bp, Homo sapiens
  misc_feature: GYAE6OF02JBUVF.9.20.B09.1.454.CMB.1.raw
  modified_base (316)..(316): a, c, t, g, unknown or other
  misc_feature (316)..(316): n is a, c, g, or t
tcagtgatacgtctcacgaccggtgctcgatttagtgtagtgtgaagggctgggcctaaggaagcagcactggtggtgcctcagccatggcctggaccgttctcctcctcggcctcctctctcactgcacaggatctatgacctcacatgtgctgactcagccacccgtcggtgtcagtcggcccgagggacgggacggccaccacttacctgtggtagggagaagacattgacgaaggaagagtcgtccacgtacggtaccaacgaggacggccgacgggcccgggccctggtggtcggtcgtctatgataacgnggtcgacccggtcctcgtcgacctccgtagacgtccgtcttccgtcgtcggccttaccgaacgttcggtacgggaaccaccgggacccctaccgtacgacctactaccgacgtaccggaacggggacccggaacgggaccggggtacgtaacgggaccgggtacccgtaacgttaacgtttaccgtacggtaccggtacgggttcggtacggtaactaacgttttaacttaacccgttacccgtacccccgggtttagggttcccgggggaaccggggggtaacccgtaacggtcccggttaccggtaacccggtttaccgggttaaaccggtaccgaaacccgggtcccgggtaaaccgggtcccggttacccggtcccccgggttaaccggttccggtacccctttccggtttacccccttaccccgttaccccgttccttaaccgggtaccgtacccgttaccgtaccgtaccggg

SEQ ID NO: 292019 - DNA, 536 bp, Homo sapiens
  misc_feature: GYAE6OF02FI2Z5.9.20.B09.1.454.CMB.1.raw
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaagggaagagtgtccactggtaccaacagaggccaggccgggcccctggtggtggtcgtctatgataacagtgaccggccctcgtcgatccctgagcgcttctctggctccaactctgggaacacggccacctgaccatcagcagggccgaagccgggatgacggccgactattactgccaggtgtggcatattactcaccccgtgttcgggcggggacaagctgaccgtctaggtcacgcccaaggcctcgcccctcggtccaccgtcctcgttccccgcccttcctccgacgaccgttactctaccg

SEQ ID NO: 292020 - DNA, 854 bp, Homo sapiens
  misc_feature: GYAE6OF02HJTNM.9.20.B09.1.454.CMB.1.raw
  modified_base (150)..(150): a, c, t, g, unknown or other
  misc_feature (150)..(150): n is a, c, g, or t
  modified_base (234)..(234): a, c, t, g, unknown or other
  misc_feature (234)..(234): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcactntgtgctagacctcacgcccacccgtcggtgtcaggtccggcccgagggacggggaccgccgaccattacctggtggtagggganaaagctaagttgacgaaagggtaacgaggttacgccgtaacgttacgggtaaccaaacgaggacgggaccgacggggaccccgggtcccccggttgggtcgggggttcggttccggtaccgttagtacggtaacgttaaaacgtcggttaccggaccccggtccccgttccggtaccgaccgttccccgtagacggtcccgtccgttccgttcgtccgggtacctaccgtaaaccgtccggtaagggtaacccgaccgggacccctcccgttaacggacctacgtccgaacggccgtaacggggaccggaaccgggccgggtaacgtcgggacccggtaccgacgtaaccgttctacggccggtaggtcgtacggtgtaaactcgttaccgtaccgtaccccggtacgggttcgggggacccgggggtaacgtaccggtaccgtaacggggtacccgttaccgttaccgggtactaaccggaccccgggttacggacccggtaccggtccccccgggttacgttaccccggtaccgttccccggtttaaccccggtttcccgaacccccgtttccccggtaacctttaaccggaacggtttacccgtaccgttacccggg

SEQ ID NO: 292021 - DNA, 811 bp, Homo sapiens
  misc_feature: GYAE6OF02HOBCA.9.20.B09.1.454.CMB.1.raw
  modified_base (773)..(773): a, c, t, g, unknown or other
  misc_feature (773)..(773): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcacgcccacccgtcggtgtcaggtcggccccgaagggacgggaccggcccaaccgtacttaccgtggtggtagggaagaacgactagtcgacgaaaggaaggtagtcgtccaacgtacggtaaccaacgtaggacggaccgtacgggcccgggtccccgtggtacgggtcggttacgtactagttacggaactaacggtcggtacggaccccggtcccgtcggtaccgtaccgttccccgtggtaaccggtcccgttaccgttccgtccggtaccggtccttaaccccgtaacgttccggaacgggtaaacccgccggtaccccgacccgtacggaaccctagtaccgacggaccggaacggggaccggaaccgggaccggggtcggtaccgggtaacggtcccgtaaacgttacgttaccgtacggtaccggtaggtcggtacgacgttacgttaacgttacccgtcccggttacccggtacggggtccggggaccgggggaacctacgggtccgtaccggtaccggttaaccgtaccgggttccgaaaccgtaccgaccggtccgtaccccggtccccgtacggtcccgttaccgtccgtccccgttacccncccgtaccgtaccggtaccgtaaccttcgaccgtacgg

SEQ ID NO: 292022 - DNA, 913 bp, Homo sapiens
  misc_feature: GYAE6OF02IGYWK.9.20.B09.1.454.CMB.1.raw
  modified_base (167)..(167): a, c, t, g, unknown or other
  misc_feature (167)..(167): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacgaggatctaatcgacctcacatgtgctgacgtcacncccaccgtcggtgtcgaggtcggcccgagggacgggaccggccaaccgtatttaccgtggtacggtaggggaacgtaaacgactagttacgacgaaaagggaagaggttcgtccaacgttcggtaacccaaacgaacggaacggaccgaccggggccccgggtaccccgtcgggttagggttcgggttccggttcttaagttagaacgttaaacgaggttaccggaccccgggtcccgttaccggtccgtaaccgttccccgtggtaaccggccgttacctttccgttcgtccgggccttaccgaaccttcggtacgggaaccgacccggaccctaacccgtacgacctacgtacgaaggtccggacggggtacccggaacggggtccggggaagttaccgggaccgggacccgtaaacgtttaccgtttacgaccggtaccgggtagggttacggtcggtaaacgtacgtttaacttacccgttacccggtaccccgggttacgggttacccggggggtacccgggggtaaaccgtaccgggtcggtttacccggtaacccgggttaccggttacggttaaccggacggtaaccccgggtacggttcccgggaccccggtttacccccggtacgggttacccttacccgggtttccccgtttaccccggttcccccgggtttacccccgtcccggtttaaccccgggaccggttttaaaaccgttcccgtaacccggttaccggg

SEQ ID NO: 292023 - DNA, 841 bp, Homo sapiens
  misc_feature: GYAE6OF02IO9PA.9.20.B09.1.454.CMB.1.raw
  modified_base (173)..(173): a, c, t, g, unknown or other
  misc_feature (173)..(173): n is a, c, g, or t
tcagtgatacgtctcacgaccggtgctcgatttagtgtagtgtgaagggggcctaaggaagcagcactggtggtgcctcagccatggcctggaccgttctcctcctcggcctcctctctcactgcacaggatctatgacctcactatgtgctgactcacgccctaccgtggtntcgaggtccggacccgaagggacgggaccgaccacctacgttacctggtggtagggacgaagactagtcgacgaaaggaagacgtcgtaccgagtacggtaaccaacgagacggacgtaccgggccccgggtcccgtgggtcggtacggtcgttacgtagtacgacgtaacgcggtaccggtacccggcccgttaggtaccgtaacctccggtgacggtcgtctttcgcgttacgcctaccgaacgtcggtaacggaaccgaccggtcctaacccgtagaccctacgtaccgaggaccggacgggtacccggaacggggtccgggtaagtacgggaccggtaaccgtaacgttaacggtaccggtcggtaccggtacggtcggtacggtacgtaacgttacgttaacccgttcccggtacccgggttacggggtaccgggggtaccggggtaaacggtaccggttaaccggtacccggtacccgggttacccggttacggtaccggaacccggtaacggaacccgggttcccgttacccgggtccccgttaacgggttccccgtaaacccggtttcccggttccccgtttacccccggtcccgttaccccggttaaccgtaccgggttaacccgttaccgtcccggttaccgttaccgggtacccggg

SEQ ID NO: 292024 - DNA, 713 bp, Homo sapiens
  misc_feature: GYAE6OF02I01E6.9.20.B09.1.454.CMB.1.raw
  modified_base (272)..(272): a, c, t, g, unknown or other
  misc_feature (272)..(272): n is a, c, g, or t
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcacgcccaccctggtgtcagtcggccccagggacgggacggacccacctaattacctggtggtagggagaaagacattgacaaaggacgagtgtaccacttcggtaacccaanaggacgccgagggcccggtccgtgtcgggtgtcgtctagtgaattaacagtcggaaccgtccctcgtcgtactaccctggacgcgtaccttctcgtcggcctacctaacgttcgtacgggaaccgtaccggacccaccctacgaacctacgtacgaacggcggaacggggaaccggaagggaccgggggtatcggggaaccggtaccgaacgttaacgtttacgcggtaccgacgggttgtacggactaattaacgttacctaccgtccccgtagggttacccggggcggggaacccgaacgtccgaccggttaccgggtaccgtacggtaccgaacgacccgtaagggtcccgtccggtcccccgtacggtacccgtaccgttccgttcccgttcccccgtacccttccgtaccctacggtacccgttagtcccgtaacg

SEQ ID NO: 292025 - DNA, 770 bp, Homo sapiens
  misc_feature: GYAE6OF02G6WGK.9.20.B09.1.454.CMB.1.raw
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcacgcccacccctcggtgtcacggtcggccccgagggacggggaccggccacccacttacctggtggtagggagaacgactattgacgaaggagagtcgtaccacgtacggtaaccgaacgagacggccgacgggcccgggccccgtaggtcgggtggtcgtcgtagtgaactaacgaggtacggacccggtcccgtcgtaccgtactccgtgacgccgtccttctcgtcgcctcctacgtcgtacggaccaccggccctacccgtcgacctacgtcgacgacggaccgggaccgaacggggccgggtagaccgggacgtacccggtaacttacgtttacgccgggtacgtcggggttacgtcggaacttacgtttactttaccgtacccccgttccccgggttacgggttcccgggggaaccggggttaacccgacggtacccggtcggtaccccgttacggttacccggtacgaacccgggtacccgaacggtccccgtaccccggtccccccggttccggttacccgtacccgtttccccgttcccgggtttaccccctaccccgttaccctacccgtaaccggtccggtttacccaccgtaaccggg

SEQ ID NO: 292026 - DNA, 909 bp, Homo sapiens
  misc_feature: GYAE6OF02IDDG2.9.20.B09.1.454.CMB.1.raw
  modified_base (144)..(144): a, c, t, g, unknown or other
  misc_feature (144)..(144): n is a, c, g, or t
  modified_base (184)..(184): a, c, t, g, unknown or other
  misc_feature (184)..(184): n is a, c, g, or t
  modified_base (212)..(212): a, c, t, g, unknown or other
  misc_feature (212)..(212): n is a, c, g, or t
tcagtgatacgtctcacgaccggtgctcgatttagtgtagtgtgagggctgggctaaggagcagcactggtggtgcctcagccatggcctggaccttctcctcctcggcctcctctctcactgcagaggatctatgacctcacntgtgctcgactcagccacctcggtagtcagtcgcccaggnggacggccacattaccgtgtagtggganaaaggctaattgacgaaaggaagcgttaggaccacgttgggaccaaacctaggacggtccaagggcccggaccccgttggtacggtacggtcgttacctagttagacgttaaacacggttacggaaccggaccctttcgggaaccgtaacctttccccggtagaaccgtcccggttaacttacccggttcgttaccgggccttacccgtaaacgtttccggaacgggggtaaacccaacccgggtaccccgaacccctttacggggaaaccccgttaactttaccgtaaccgggtaacccgaaggggggggtaacccccgtttaaaacggggtaccccgggggaaggtttaacgggaacccgggggttacccggtaaaaccgggtttaaacttttaacccgtacgggaaaaccccgggttcgggtttacggggttaagggttacttaaacccggttttaagtttaacccgtaacccgggttaacccccgggttttaaccgggtttccgggggtaacccgggggaacccgttaaccggtacgttaaacccggtccggttttaaccgggaaccgtacggttaaccccgtaccggaaaccggttccgttaacccggaccccgttcggttaaacccttcggtacccttacgtaccccccgttacgtaccctagtacccggtaacttacccggcttaaccgg

SEQ ID NO: 292027 - DNA, 822 bp, Homo sapiens
  misc_feature: GYAE6OF02GIMB6.9.20.B09.1.454.CMB.1.raw
  modified_base (256)..(256): a, c, t, g, unknown or other
  misc_feature (256)..(256): n is a, c, g, or t
tcagtgatacgtctcacgaccggtgctcgatttagtgtagtgtgaagggggcctaaggaagcagcactggtggtgcctcagccatggcctggaccgttctcctcctcggcctcctctctcactgcacaggatctatgacctcacatgtgctgactcagcccacctcggtgtcagtcggcccaggacgggacgccacacttacctgtgtgggagaagactattgacaaggaagagtcgtccaacgtggtaacccaanaggacgggcccaaggggcccccgggtccccttgggttggggtcggttccgttacttagtcggtaaactaaaccaagggttccggaacccccggtcccgttacggtccggtaacttccccgtaggacgccggttcctttcgtcgttccggcctaccctaacgtcgtacggggaaccaccgggccctaacccgtagaccactccgaacggcgtaacgggggccgaaaacgggtcccgggggaagtcggaaccgggtccgtaaactttacgtaacgtcggtaccgtagggttggtcggacttaaagttactttaaccgttaccccggtaaccccggtttcggggttacccggggaccggggggtaacccgtaacgggtaccgttacccgggtaacccggttaccgttaacgggtaccgaaccgggacccgtaacgggtccccgtacccggttccccccggttccggtaacccttcccggttaccgttaccccgggtttcccccgccccgtttacccggtaccgtaacgttacccggttaaccctccggttacgtccgggtaacccgggg

SEQ ID NO: 292028 - DNA, 754 bp, Homo sapiens
  misc_feature: GYAE6OF02JMGCS.9.20.B09.1.454.CMB.1.raw
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcacgcccacccgtcggtgtccagtcggccccgagggacgggaccggcccaaccacttaccgtggtaggtagggaagaacgactagttcgacgaaggaagacgttcgtaccacgtacggtaaccaacgaaggacggaccgaacggggtccccgggaccccgtggttcgggttacgggttccgtacgttaacgtacggtaacgtaaccgtaggtacggacccccggtcccgttaccggtaccgaaccgttcccgtaggacggccgtactttccgtcgtcgtccgtaccgacctcgtacgggaaccgaccggtacccacccgtgaccattaccgagaccggacgggacccggacgggacccgggtagtacggacgggaccgtaacgtacgttacgcgaccgtagggtagtacggctaaagttctaaccgtacccgtaccccggtcgggttccgggaccggggtaccgtaaccgtcgtcggtacccgttacgtacggtacgaaccggaccgtacggcctcccggtcccgtaccgtaccttccgtaccgttccccgtaccctaccccgttccgtaccgtaccgtacgtactacccgtacg

SEQ ID NO: 292029 - DNA, 639 bp, Homo sapiens
  misc_feature: GYAE6OF02JZG92.9.20.B09.1.454.CMB.1.raw
  modified_base (167)..(167): a, c, t, g, unknown or other
  misc_feature (167)..(167): n is a, c, g, or t
  modified_base (187)..(187): a, c, t, g, unknown or other
  misc_feature (187)..(187): n is a, c, g, or t
  modified_base (252)..(252): a, c, t, g, unknown or other
  misc_feature (252)..(252): n is a, c, g, or t
  modified_base (379)..(379): a, c, t, g, unknown or other
  misc_feature (379)..(379): n is a, c, g, or t
  modified_base (462)..(462): a, c, t, g, unknown or other
  misc_feature (462)..(462): n is a, c, g, or t
  modified_base (527)..(527): a, c, t, g, unknown or other
  misc_feature (527)..(527): n is a, c, g, or t
  modified_base (562)..(562): a, c, t, g, unknown or other
  misc_feature (562)..(562): n is a, c, g, or t
  modified_base (606)..(606): a, c, t, g, unknown or other
  misc_feature (606)..(606): n is a, c, g, or t
  modified_base (618)..(618): a, c, t, g, unknown or other
  misc_feature (618)..(618): n is a, c, g, or t
tcagtgatacgtctcacgaccggtgctcgatttagtgtagtgtgaagggtcgttggggacctaaggaagcagcacctgggtggtgcctcagccgatggcctggacccgttcgtcctccgtcggcctcctcgtctcactgcacaggtatcgatcggacctcacagtgngcgtgctcagccaccgtcgngtcagcggcccgagggcggacgccacacttccgtgcggtagggagaacgctagtgagaaggagtntcggacctagtcggaccaacgaggcggcgacgcccgggcctggtcgtggtccgtatagtacggaacacgtacgccggtccgtccgttccggaccgtaactttcccgaggaccgttcggtcctttacncggtcggtccctactacgtcgacgaccgtacgcctaacgcacgatcaacgcgagccgaggtcgtagcgagtccagtataccgnggactcgggagtcgtaactagttacttcccgaccgtccccgggtagggttcggggacccggttanaccggtcgtaacgcccgtttagacgcctacgccgngtacccggtccgtcccgaggtccaccgttcgtcccgttaccccncgtttaacccgntacccggtcgtaccgtgtacg

SEQ ID NO: 292030 - DNA, 717 bp, Homo sapiens
  misc_feature: GYAE6OF02GQSHL.9.20.B09.1.454.CMB.1.raw
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcacgcccacccgtcggtgtcaggtcggacccgagggacgggaccggccacctacttaccgtggtggtagggaagaacgactagttacgacgaaagggaagtaggttcgtaccacgtacggtaaccaacgaggacggccgacgggccccggtcctggtcggtcggtcgtcgtatagaactaacgacggtccggaccccggtccgtcgtccgacctccgtggacgtccgtcttcgtcgtcggtcctacctacgtcggtacgggaaccgccggaccctaccgtacgacctacgtcgacggaccgggtacgggaccggaacggggccgggtagtacgggacggacctaacgttacgttcgcggtaccggtaggtcgtaggtactaatttacgtaccgtcccgtaccccgggttggggtacccgggggacgggaacctcggtacgtaccggtaccgtcgtacggaccgaccgtaccgcggtcccgtcccggtacccgtggtaccctccgttccgtccccgttaccccaccgttccgtaccacggttacgtaccaccggtacgg

SEQ ID NO: 292031 - DNA, 826 bp, Homo sapiens
  misc_feature: GYAE6OF02JK6OP.9.20.B09.1.454.CMB.1.raw
tcagtgatacgtctcacgaccggtgctcgatttagtgtagtgtgaagggctgggcctaaggaagcagcactggtggtgcctcagccatggcctggaccgttctcctcctcggcctcctctctcactgcacaggatctatgacctcacatgtgctgactcagccacccgtcggtgtcagtcggccccgagggacgggacggccaccacttaccgtgtggtgggagaacactattcgacaagggaaagtagtccgtaccacgtacggttaccaaactaggacggccgaacggccgggccccctaggttcggtgggttccgtaccgttagtacgtaacgtaaccgtaggtacgggtaccccggtccccgtacggttacccgacgttaccccggtggtaccgtccggtacctttcccgtaccgttccgggaccctaccgtaaacccgtccgggtttaaacggggaaccccgtaccgggaccccctacccggtaccgaacccaacgtaccgacggaccggacggggtaccggacggggacccgggtagtccgggaacgtacccgtacggttacttacgtcggtaccgagggttgccgggactattaaacgttaccgtaacccgttcccccggtcgggtttacggggggcccgggtaacccgaacggtcccgttaacgggacccggttcgtaaccgggttacgacccgaaccgggtaccctcccgtcccggacccccggtttcccgggtacctaacccggtttccgtccccggttcccccctacccgttaccccgttccggaacgttacccgggttactcccggtaaccggg

SEQ ID NO: 292032 - DNA, 1029 bp, Homo sapiens
  misc_feature: GYAE6OF02FQYB4.9.20.B09.1.454.CMB.1.raw
  modified_base (150)..(150): a, c, t, g, unknown or other
  misc_feature (150)..(150): n is a, c, g, or t
  modified_base (177)..(177): a, c, t, g, unknown or other
  misc_feature (177)..(177): n is a, c, g, or t
  modified_base (226)..(226): a, c, t, g, unknown or other
  misc_feature (226)..(226): n is a, c, g, or t
  modified_base (258)..(258): a, c, t, g, unknown or other
  misc_feature (258)..(258): n is a, c, g, or t
tcagtgatacgtctcacgaccggtgctcgatttagtgtagtgtgaaggggctgggcctaagagcagcactggtggtgcctcagccatggcctggaccgttctcctcctcggccctcctctctcactgcacaggatctatcgacctcacgntgtgctgactcacgcccaccgtcggtntccgaggtcggacccgagggacgggaccgccacctattaccgtggtggngggtaacgaagactagttacgacggtaaaggnggaacgtcgtaccgtacgtaggtaacccgaacgacggacgggacccgtaccgggggccccgtacccccggttggttcggggttacggttccggttcttaacgtcgtaaacgggttaacggtacggtcccggtacccccgggacccgtttcccgggtaccgaacccggtttccgtccgggaacggttccccgttacttttcccggtccggtccggtacccttaacccgtaaccggttccgggtaaccggggaaccgaaccccgcccggtaaaccctacgtaacccgttactaccggaaccgggccgggaacccgggggtaaccgggaaccggggggtaacccggggtacggtaacccggggaaccgggttaccgttaaccggtttaacccgttaccggccggggaacccggtttgggggtaccgttaccggacgtttaacgtttaaccggttaccccggttaccccccgggttacccccggggttttaggggggtaccccccggggggggttaacggggaaaccccgtaccggggttaaccccgttaccggggtaacccccgtttacgggaccgggtaacccgggtaaacccggcccccgttaaggtccccccgggttaaccccccggggttccccggtttccccggttaaccgttttaccccgtttccccccgggggtttaaccccttttacccccccgggtacccccttttacgggtacccgtttaaccccgggttaaaccggtttccccgttaacgggtaaccccgggg

SEQ ID NO: 292033 - DNA, 745 bp, Homo sapiens
  misc_feature: GYAE6OF02GBJXY.9.20.B09.1.454.CMB.1.raw
  modified_base (210)..(210): a, c, t, g, unknown or other
  misc_feature (210)..(210): n is a, c, g, or t
  modified_base (226)..(226): a, c, t, g, unknown or other
  misc_feature (226)..(226): n is a, c, g, or t
  modified_base (240)..(240): a, c, t, g, unknown or other
  misc_feature (240)..(240): n is a, c, g, or t
  modified_base (678)..(678): a, c, t, g, unknown or other
  misc_feature (678)..(678): n is a, c, g, or t
tcagtgatacgtctcacgaccggtgctcgatttagtgtagtgtgaagggctgggcctaaggaagcagcactggtggtgcctcagccatgcctggaccgttctcctcctcggcctcctctctcactgcacaggatctatcgacctcacatgtgctgactcagccaccctcggtgtcagttcggccccaggacggcggccaaccatttaccngtcgtgggagaagacncttgcgaaggaagngtcgtccacgtcggtaccaacaggacggccgaggccccgggtcccctggtcggtcggttaccgtccgtagttgaacgttaacgacggttcgaaccccggtcccgtttccgtaccgtacgtcccctggtaccgtccgtccgtttcctccgtcggtccttaacccaacgttccgtagggaaacctaccggcccttaacccgtcaccctaagtccggacggccgggggtaacaacgggccgggggtactgggacgggtacccgtaacgtttcgttttaccgcggtttccgaagttccgttagggtggggttaaatttccctcgtaagttacgtaggttagggttagggttaagggggacctttccgggttcggggacgggttaacggcgtaacggtcggtacgcccttaccgtacgggacaccgggacccgtacggtcccnccccggttcccccgttaacgtccgtaccggttcccgtccccggtttccctaccccggttcctaaccg

SEQ ID NO: 292034 - DNA, 586 bp, Homo sapiens
  misc_feature: GYAE6OF02FH80Y.9.20.B09.1.454.CMB.1.raw
  modified_base (277)..(277): a, c, t, g, unknown or other
  misc_feature (277)..(277): n is a, c, g, or t
  modified_base (325)..(325): a, c, t, g, unknown or other
  misc_feature (325)..(325): n is a, c, g, or t
  modified_base (424)..(424): a, c, t, g, unknown or other
  misc_feature (424)..(424): n is a, c, g, or t
  modified_base (515)..(515): a, c, t, g, unknown or other
  misc_feature (515)..(515): n is a, c, g, or t
  modified_base (553)..(553): a, c, t, g, unknown or other
  misc_feature (553)..(553): n is a, c, g, or t
  modified_base (576)..(576): a, c, t, g, unknown or other
  misc_feature (576)..(576): n is a, c, g, or t
tcagtgatacgtctcacgaccggtgctcgatttagtgtagtgtgaaggggctgggcctaaggaagcagcactggtggtgcctcagccatggcctggaccgtctcctcctcggcctcctctctcactgcacaggatctatgacctcacatgtgctgacctcagccaccctcggtgtcagtggccccaggagggacggccaccattacctgtgtgggagaagacattgcgaaggaagatcgtccacgtggtaccaacagaggccaggccgggcccctgnggtggtcgtcgtatgataacgagtgacccggcccttcgcgatccctgngacgccttctcctgggtacctccaacgttcgtcggggaacaccggcctacccctgaccagtcaggcaacgggcacggcgggagtgcggccacgattacncgaccaggtcgtggcattactatccaccccgtggtccgggtgggggacctaggccgtagaaccggtcctaggtccacgtcccaacggtccncgccccgtcccggttacacccgtccttacgttcccccncccgttccctcctagtaccggtntacccgtcgg

SEQ ID NO: 292035 - DNA, 891 bp, Homo sapiens
  misc_feature: GYAE6OF02FIGY8.9.20.B09.1.454.CMB.1.raw
  modified_base (253)..(253): a, c, t, g, unknown or other
  misc_feature (253)..(253): n is a, c, g, or t
  modified_base (609)..(609): a, c, t, g, unknown or other
  misc_feature (609)..(609): n is a, c, g, or t
tcagtgatacgtctcacgaccggtgctcgatttagtgtagtgtgaaggggcgtgggcctaaggaagcagcactggtggtgcctcagccatggcctggaccgttctcctcctcggcctcctctctcactgcacaggactctatcgacctcacagttgtcgctgactcacgtcccacccgtcggtacgtctacggtcggaccccgagggacgggaccggccctaccgtactttacccgtggtacggtcggggaanaacgtactagttcgacgtaaagggaagtacgttcgtacctacgttacggtaacccaacgacggtaacggcccgacggggcccccgggtacccccttggggttacggggttcgggttacccgttagtacgtagggtaacctaaaccgttcgggtaccggacccccggttacccggttccggtaccgtaaccggttccccgtagggtacgtccccggttccttttccggtacccggttaccgggcccttaccggaaacccgtttccggaccgggaaacctcccggacccctacccgttagacccctatcccggacggttcccgggaacggggtacccggaaccggggcccggggtaanccggggtaaccggacccggttacctttacgttccggaccgtaccgggtagggttccggtgggtacctaacggttttaacttcccggtaccccggtaccccgggttttggggaacccgggggtacggggaacctaccggtccgttaccgggtacccgttcggtaaccgcgacgggacccgttaccggtcctcccgggcccccgttggtacccaccgtttccggttccccgttaacccgtcccccgttagtaacccacgggtaaccctttcgggtacctaccgg

SEQ ID NO: 292036 - DNA, 857 bp, Homo sapiens
  misc_feature: GYAE6OF02FZOWL.9.20.B09.1.454.CMB.1.raw
  modified_base (332)..(332): a, c, t, g, unknown or other
  misc_feature (332)..(332): n is a, c, g, or t
  modified_base (388)..(388): a, c, t, g, unknown or other
  misc_feature (388)..(388): n is a, c, g, or t
tcagtgatacgtctcacgaccggtgctcgatttagtgtagtgtgaaggggctgggcctaaggaagcagcactggtggtgcctcagccatggcctggaccgttctcctcctcggccctcctctctcactgcacaggactctatcgacctcacatgtgctgactcagcccaccctcggtgtccagtccggaccccgagggacgggacgccacctattacctggtggtagggaagaagaactgttgacgaaaggagtaggtgtaccacgtacgtaacccgaacgagacggccgacgggccccggtcccccgttgggttaggtacggttccggttnttacgtgaactaaccgaggttccgacccggtcccgttcggtccgtaacctccccgngaccggtccgtaccgtttcgtccgtcggtaccctaccccggttacgtaccggtacccggggtaaacaccccgggaccctacccggtacgaacccgtaaccgtacgaacgggacggtacccggggaccggtaacggggacccggggttaagcgggaaccggtacccgtaaccgttaacgtaccgtcgtaccgggtaggttcgggacgtccgtaatttaacgttacccgtccccgttaaccccggtttccggggttacgggggaacccccgggggtacgtaaacccggtcccggttaacccggttaaccgtccccgttaaacggggtaccacccgggtaaccccgacgggttcccccgtacccggtaccccccggtcgttaccccggtacccgtttcccggtttacccctaccccccggttccccttacccgggtacctaaccgggtaacccgttagtaccccgttacggg

SEQ ID NO: 292037 - DNA, 866 bp, Homo sapiens
  misc_feature: GYAE6OF02IINJP.9.20.B09.1.454.CMB.1.raw
  modified_base (209)..(209): a, c, t, g, unknown or other
  misc_feature (209)..(209): n is a, c, g, or t
  modified_base (214)..(214): a, c, t, g, unknown or other
  misc_feature (214)..(214): n is a, c, g, or t
  modified_base (217)..(217): a, c, t, g, unknown or other
  misc_feature (217)..(217): n is a, c, g, or t
tcagtgatacgtctcacgaccggtgctcgatttagtgtagtgtgaagggggcctaaggaagcagcactggtggtgcctcagccatggcctggaccgttctcctcctcggcctcctctctcactgcacaggatctatcgacctcactagtgtcgctgctcacgccaccgtggtgtcagtcgcccaggcggacgccacattaccgtgtagnggganaanactacttgacgtaaggagtgtcgtaccgagtacggtaaccaagaggacggtaccggacgggtccccgggaccccgttggtacgggttcggtccgttacgtaaacgttacggtaacgttaaaccgtacgggttaccggtacccccggggtaccccttacgggttaccggtaacccgttcccccggttaggaccgtcccgggtttaccttccgttacggttccgtaccgtttaaccgtaaccggttcggttaaccggggaaacccttaaccggggacccctaacccgttcggaaacctacgtaccgggaacggtaccggaaaccgggggtaccgaaaccgggggtccgggtaaaggtaccgggtaccgggtaacccgttaaacgttaccgttaacggtaccggttaccggtaggttcggtaccggtattaacgtttacgttaccggtaccccggttacccgggttcggggttacccggggtaccggggtaccgtaacggtcccggtttaacgaccccggttagttaacggtaccgaaacccgtccggaaacggttccgacccgttcccggtaccggttaccgtaccgttcccccggttacctacccgttcgaaccgttacggttactcgtaccgacgtcggaccgtccggg

SEQ ID NO: 292038 - DNA, 567 bp, Homo sapiens
  misc_feature: GYAE6OF01CN3IV.14.81.H04.1.454.CMB.1.raw
tcagcgtctagtaccacgaccggtgctcgatttagtagtgtagattcgcggggagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggaggtcggggggagcgtggtccagccgtgggaggtccctgagactctcctgtgcagcctctggacttcaccgtcagttagttctggcatgcacgtcgggtcccgccaggcctccgtggcgaagggggctgggagttggggtgggattatatcaatatgataggaaacttaaagtaaagactatgacagacttccggagaacgggcattcacatctcagacgacactacagacacgtctagtatctgaacaaatcgaacagcctagacgagctaggaacgaccgacggactaaggttagttaacgttacgtaggttaacggaacggtaaaaggtacggttaggggtacggtaggtcgtacggg

SEQ ID NO: 292039 - DNA, 661 bp, Homo sapiens
  misc_feature: GYAE6OF01D2OPZ.14.81.H04.1.454.CMB.1.raw
  modified_base (288)..(288): a, c, t, g, unknown or other
  misc_feature (288)..(288): n is a, c, g, or t
tcagcgtctagtaccacgaccggtgctcgatttagtagtgtagattcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtgggaggtcggggggaggcgtggtccagccgtgggacgtccctgagactctcctgtgcagcctctggattcaccgtcagtagttcnggcatgcacgtcgggtcccgccgaggcctccgaggcgaagggggctgggtagttggggtagggtagtttatactcaagttagtgaagttagggaaaacttaaagtaaaagtacttaagtcgacaacggtacccgttaccggtagggaacggggtacccgtaacgtttaccgaaccctacttacctacccgaaaggaacgtaaccctaaccgtttacccgaaacggaaaccacggtcgttacgttacttccgtacgaacaaatacggaaactacgtaccgtaggaagacgcgtacggacggaccgacggacgtagttagttaatttacgtagtacggaacgtaaaggtacggttagggtacggtagtcggtcgg

SEQ ID NO: 292040 - DNA, 559 bp, Homo sapiens
  misc_feature: GYAE6OF01DZN47.14.81.H04.1.454.CMB.1.raw
  modified_base (348)..(348): a, c, t, g, unknown or other
  misc_feature (348)..(348): n is a, c, g, or t
  modified_base (518)..(518): a, c, t, g, unknown or other
  misc_feature (518)..(518): n is a, c, g, or t
tcagcgtctagtaccacgaccggtgctcgatttagtagtgtagattcgcggggagctctgggagaggagcccagcactagaagtcggcggtgtttccattcggtgatcagcactgaacacagaggactcaccatggagtttggggctgagctgggttttcctcgttgctcttttaagaggtgtccagtgtcaggtgcagctggtggaggtcggggggagcgtggtccagcctgggaggtccctgagctctcctgtgcagcctctggattccaccgtcagttagttctggcatggcacgtgggtcccgccaggctccgaggcgaaggggctggagttgggtgggattanatcatatgataggaaactaaagtaaagactatgacagactccggtagaacgggcctaattccactactctaccgagacgacacttaccgaaggaacacgctagtatctagacaaatcgaacagtccagaacgagacgtagacggacacggacgtagttagtaacttacgngtaggaacgtaaaaggtagttagggtcgggtagcgtacggg

SEQ ID NO: 292041 - DNA, 648 bp, Homo sapiens
  misc_feature: GYAE6OF01AXNZM.14.81.H04.1.454.CMB.1.raw
  modified_base (259)..(259): a, c, t, g, unknown or other
  misc_feature (259)..(259): n is a, c, g, or t
tcagcgtctagtaccacgaccggtgctcgatttagtagtgtagattcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgggggagcgtggtccagcctgggagtccctgagctctcctgtgcagcctntggattcaccgtcagtagttctggctatgcacgtggggtcccgccgaggcctccgagggcgaaggggcctgggagtttggggtgggtagttatagtcaattagtgatagggaaacttaaagtaaagacttagtggacaacggtaccttccggtagggaacgggtcccgtaatttacccaacccgtagttaccctaccgaagtaacgaccctaaccttacccggaaaggaaccctacggtcctaggttactaccgtagaacctaaacgtcgaaacgtacgtacccgttagaacggacgtcgtagggaacggaccgacgggtacgtacggttgtaacgttcgtaggtacggaacggtaaaggtacgtaggggttcggtagtccggtacggg

SEQ ID NO: 292042 - DNA, 549 bp, Homo sapiens
  misc_feature: GYAE6OF01DZ1SG.14.81.H04.1.454.CMB.1.raw
  modified_base (265)..(265): a, c, t, g, unknown or other
  misc_feature (265)..(265): n is a, c, g, or t
  modified_base (287)..(287): a, c, t, g, unknown or other
  misc_feature (287)..(287): n is a, c, g, or t
  modified_base (305)..(305): a, c, t, g, unknown or other
  misc_feature (305)..(305): n is a, c, g, or t
  modified_base (442)..(442): a, c, t, g, unknown or other
  misc_feature (442)..(442): n is a, c, g, or t
  modified_base (516)..(516): a, c, t, g, unknown or other
  misc_feature (516)..(516): n is a, c, g, or t
  modified_base (540)..(540): a, c, t, g, unknown or other
  misc_feature (540)..(540): n is a, c, g, or t
tcagcgtctagtaccacgaccggtgctcgatttagtagtgtagattcgcggggagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggaggtcggggggagcgtggtccagcctgggagtccctgagactctcctgtgcagcctcgnggattccaccgtcagtagttcnggcatgcacgtgggtccnccaggctccaggcgaaggggctgggagttgggtgggattatatcatagtgaagtggaaactaaataaagacttagtgacagacctccggtagaaggccattacaccatcctacaagacgacaccttccgaagaaccncgctagtactctgacaatacgaacagtacctagagacgcgtagaaggaccgacggcgtaggttagtagttacgngtagacgtaaagtagtaggtcggngtcgtacgg

SEQ ID NO: 292043 - DNA, 576 bp, Homo sapiens
  misc_feature: GYAE6OF01BENF3.14.81.H04.1.454.CMB.1.raw
  modified_base (303)..(303): a, c, t, g, unknown or other
  misc_feature (303)..(303): n is a, c, g, or t
  modified_base (353)..(353): a, c, t, g, unknown or other
  misc_feature (353)..(353): n is a, c, g, or t
tcagcgtctagtaccacgaccggtgctcgatttagtagtgtagattcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcggggggaggcgtggtccagcctgggagtccctgagctctcctgtgcagcctctggattcaccgtcagtagttctggcatgcacgtcggggtccnccgaggcctcccgagggccaagggggctgggagttggggtgggagttatntcattagtgatgggaaactaagtaagactatgactagaccgtccgtaggaacgggccgagttccaccactacctaccgaaggacgacctaccttaccgaacggaaccacgctacgtatcctgacaagtcgaacagacctagagacgtcgaggaggacgacggacgtagttagtattacgtggtacgaacggtaaaggaggtaaggtcgggtaagtcgtacggg

SEQ ID NO: 292044 - DNA, 576 bp, Homo sapiens
  misc_feature: GYAE6OF01DJS82.14.81.H04.1.454.CMB.1.raw
  modified_base (277)..(277): a, c, t, g, unknown or other
  misc_feature (277)..(277): n is a, c, g, or t
tcagcgtctagtaccacgaccggtgctcgatttagtagtgtagattcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggaggtcgggggaggcgtggtccagccgtgggacgtccctgagactctcctgtgcagcctctggattcaccgtnagtagttctggcatgcacgtggtccgcaggctccgaggcgaaggggctgggagttggggtgggagttatatcaatagtgagtaggaaactaagtaaagactagtgcaagtaccgtccggtaggaacgggccgtattaccgaaccactactaccgaagtaacgaccctacgttaccgaaggaaccacgtctagtactctagaactaaatacgaactacgcctagacgagtcgtaggacggaccacggctaagttgtacgttcgtgtagaacgtaaagtacgtagggtacgtgtcgtccgg

SEQ ID NO: 292045 - DNA, 694 bp, Homo sapiens
  misc_feature: GYAE6OF01B2LG0.14.81.H04.1.454.CMB.1.raw
  modified_base (260)..(260): a, c, t, g, unknown or other
  misc_feature (260)..(260): n is a, c, g, or t
  modified_base (288)..(288): a, c, t, g, unknown or other
  misc_feature (288)..(288): n is a, c, g, or t
  modified_base (446)..(446): a, c, t, g, unknown or other
  misc_feature (446)..(446): n is a, c, g, or t
tcagcgtctagtaccacgaccggtgctcgatttagtagtgtagattcgcggggagctctgggagaggagcccagcactagaagtcggcggtgtttccattcggtgatcagcactgaacacagaggactcaccatggagtttgggctgagcgtggtttcgtcgtagcgtctttaagaggtgtcagtgtcaggtgcagcgtggtggaggtcggggggagcgtggtccgagccgtgggacgtccctgacgactctccgtgtcncgacgccttcgtggacttccgacccgtntaacggttgttcgtaggtcagtcgcgtacggtcgggtcccgccgtacggccgtcgacggcgaacggggcgtgggagtcgggtgctaggttgtgtggtacgtggaggtaagtaataggaaagttagcgaccgacggtccgtaggacggctagtccactntccgtacgaagtcgtaactaacgttaccaactaactagttacgttagtatacgtacggtaactaaagtcgtaaacgtacgtccgtaaggtacgggtaaaccacgggggaactacccggtaaacggttccgttaagggtttacggtttaaaccgtttacggtttagggtaccggttaacggaacggttaagggtacggggttagggggtaaccggggggttgttaacggtacggttaacgggtaaaggg

SEQ ID NO: 292046 - DNA, 587 bp, Homo sapiens
  misc_feature: GYAE6OF01AGTNG.14.81.H04.1.454.CMB.1.raw
  modified_base (304)..(304): a, c, t, g, unknown or other
  misc_feature (304)..(304): n is a, c, g, or t
  modified_base (503)..(503): a, c, t, g, unknown or other
  misc_feature (503)..(503): n is a, c, g, or t
tcagcgtctagtaccacgaccggtgctcgatttagtagtgtagattcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcggggggagcgtggtccagcctgggacgtccctgagactctccgtgtgcagcctctggattcaccgtcagtagttctggcagtgcacgtgggcccncgaggcctccgaggcaagggggctgggagttggggtgggtattagtatcagtatgaagtaggaaacttaagtaaagacttagtcgacagaccgtccggtagaacgggtccgtaagttccgaccctacttcgtaccgaaggtacgaaccgtacttacccgaacggaacacgtactagtactcgtagactaaagtcgaacngtaccgtagacgagacgtggacgacgacggcgtacgtagttacttcgtggtcgaacgtaaacgtagtagggtcggtgcgtccgg

SEQ ID NO: 292047 - DNA, 696 bp, Homo sapiens
  misc_feature: GYAE6OF01A0UJX.14.81.H04.1.454.CMB.1.raw
  modified_base (551)..(551): a, c, t, g, unknown or other
  misc_feature (551)..(551): n is a, c, g, or t
  modified_base (556)..(556): a, c, t, g, unknown or other
  misc_feature (556)..(556): n is a, c, g, or t
  modified_base (566)..(566): a, c, t, g, unknown or other
  misc_feature (566)..(566): n is a, c, g, or t
  modified_base (583)..(583): a, c, t, g, unknown or other
  misc_feature (583)..(583): n is a, c, g, or t
tcagcgtctagtaccacgaccggtgctcgatttagtagtgtagattcgcggggaggctctgggagaggagccccagcactagaagtcggcggtgtttccattcggtgatcagcactgaacacagaggactcaccatggagtttgggctgagcgttgggttttcctcgttgtcttacttttaagaggtgtccgagttgtcgaggtgcgagcgtgggtgggagggtcggggggaggcggtcggtccgacgccgtggggacggttcccgtgagtcctcgtccgtgtcgcgacgccgtcgtcggtacttccgaccgtactaaggttacgttcgttggacctagtcgaccgacggttccgggtcccgccggacggtccgtaccgacgggaccggtagggtcgtgggtaggttggggtagggttagttatagtatagttagtagtagtaagtaaacgtaaataaagtacttagacgtacgacgtaccgtacggaaggtacggaccgtacttaccgactacgtcccgtagaacgtaaccgactacctacggaacgacnccgtntcgtatcganaacctaaagtccgaacncgtccgtaggtacaggtcgaacggcggaccgtacgttacggtgttaagttacgtcgtacggtaaggaaccgtttaaagggacggttaaccgggtcggtgttcggtacccgggg

SEQ ID NO: 292048 - DNA, 904 bp, Homo sapiens
  misc_feature: GYAE6OF01ER5HU.14.81.H04.1.454.CMB.1.raw
  modified_base (247)..(247): a, c, t, g, unknown or other
  misc_feature (247)..(247): n is a, c, g, or t
  modified_base (836)..(836): a, c, t, g, unknown or other
  misc_feature (836)..(836): n is a, c, g, or t
tcagcgtctagtaccacgaccggtgctcgatttagtagtgtagattcgcggggagctctgggagaggagcccagcactagaagtcggcggtgtttccattcggtgatcagcactgaacacagaggactcaccatggagtttgggctgagcttgggttttcctcgttgcttcttttaagagtgtccagtgtcaggtgcagcgtgggtggaggtcggggggagcgtggtccagccgtgggacgtcccgngacgtactctccgtgtcgcacgtcctcgtaggtacttcccgaaccgttcgtaacggtttagtttccggtggacctaagtcggtacctaccggttcgggggtccccacccgggtaacgggtcccgttacccggaaggggaccgggtaaacgggggggtccgttagggggttacgggttttagggggggttagggggtaactttttaagtaaccgttacgtaaagtttaacgtagggttaaacggttaacgggttaaaaactttaaaaaagttaaaaacgttaccgttaaagtcggtaaaccgtaaccggttaaacccggttacccggggttaaaggggaacccgggggttaccccttaaacgtttaccctaaacccccgtatttacccccgaaacccggtaaggaaaccttaaacccgttaacccggtttaaccccgaaacgggtaaacccgtaacccgggttacccttttaggttaaccttccggttaaacgaaacttaaaacgtaccgaaacgtacgtacccggttagaacgggttacggccggttaagggaacccgggtaacctaggggttacgttaaaccgggttntttaaccgttacggtgggaacgtaaacggtaaaaggtcgggttacgggttcggagtccggttacgggg

SEQ ID NO: 292049 - DNA, 677 bp, Homo sapiens
  misc_feature: GYAE6OF01CK2N6.14.81.H04.1.454.CMB.1.raw
  modified_base (262)..(262): a, c, t, g, unknown or other
  misc_feature (262)..(262): n is a, c, g, or t
  modified_base (282)..(282): a, c, t, g, unknown or other
  misc_feature (282)..(282): n is a, c, g, or t
  modified_base (355)..(355): a, c, t, g, unknown or other
  misc_feature (355)..(355): n is a, c, g, or t
  modified_base (518)..(518): a, c, t, g, unknown or other
  misc_feature (518)..(518): n is a, c, g, or t
tcagcgtctagtaccacgaccggtgctcgatttagtagtgtagattcgcggggagctctgggagaggagcccagcactagaagtcggcggtgtttccattcggtgatcagcactgaacacagaggactcacagtggagtttgggctgagcgttgggttttcctcgttcgcttacgttttaagaggttgtccagtgtcaggtgcagcgttgggcgggagggtcggggggagtccggtcggtccagtccgtgggacggttcccnggacgactcgtcctggtacncgactcctcgtggtaacttccgaccttcgaagttaccctagtcgtctatcggacctacggtccggtccaccgnggttacccgccggaagggcccgggtaagggtccgtggggtaaggtggggtacgtacgtaatttaacgtaccagaaccgtagtagaaccgtaaggaaaccttaagtacgaccagtaacgtcgaaccgtaccgttacgaaggaaccgggtacctattccaacctntacccgtacgaaacaacgtaaactaacgtaaccgaaaaccgaccgtaacggtacacggtaatactacgaactaagaacggaacaccgcgagagagacgagaagacccaggtcctagtacgtattacggtaggtaggatacgagaggtccgtagttaagg

SEQ ID NO: 292050 - DNA, 485 bp, Homo sapiens
  misc_feature: GYAE6OF02FH1PB.14.81.H04.1.454.CMB.1.raw
  modified_base (152)..(152): a, c, t, g, unknown or other
  misc_feature (152)..(152): n is a, c, g, or t
  modified_base (164)..(164): a, c, t, g, unknown or other
  misc_feature (164)..(164): n is a, c, g, or t
  modified_base (169)..(169): a, c, t, g, unknown or other
  misc_feature (169)..(169): n is a, c, g, or t
  modified_base (172)..(172): a, c, t, g, unknown or other
  misc_feature (172)..(172): n is a, c, g, or t
  modified_base (175)..(177): a, c, t, g, unknown or other
  misc_feature (175)..(177): n is a, c, g, or t
  modified_base (180)..(184): a, c, t, g, unknown or other
  misc_feature (180)..(184): n is a, c, g, or t
  modified_base (186)..(186): a, c, t, g, unknown or other
  misc_feature (186)..(186): n is a, c, g, or t
  modified_base (188)..(188): a, c, t, g, unknown or other
  misc_feature (188)..(188): n is a, c, g, or t
  modified_base (194)..(194): a, c, t, g, unknown or other
  misc_feature (194)..(194): n is a, c, g, or t
  modified_base (197)..(197): a, c, t, g, unknown or other
  misc_feature (197)..(197): n is a, c, g, or t
  modified_base (204)..(204): a, c, t, g, unknown or other
  misc_feature (204)..(204): n is a, c, g, or t
  modified_base (211)..(211): a, c, t, g, unknown or other
  misc_feature (211)..(211): n is a, c, g, or t
  modified_base (216)..(216): a, c, t, g, unknown or other
  misc_feature (216)..(216): n is a, c, g, or t
  modified_base (223)..(223): a, c, t, g, unknown or other
  misc_feature (223)..(223): n is a, c, g, or t
  modified_base (307)..(307): a, c, t, g, unknown or other
  misc_feature (307)..(307): n is a, c, g, or t
  modified_base (396)..(396): a, c, t, g, unknown or other
  misc_feature (396)..(396): n is a, c, g, or t
  modified_base (403)..(403): a, c, t, g, unknown or other
  misc_feature (403)..(403): n is a, c, g, or t
tcagcgtctagtaccacgaccggtgctcgatttagtagtgtagattcgcgggcagctctgggagaggagcccagcactagaagtcggcggtgtttccattcggtgatcagcactgaacacagaggactcaccatggagtttgggctgagcgngtttcgctagcncttanagncannnagnnnnngngngcgggngcngtcagcnggagccngagcnctcctgngcagcctctggattcaccgtcagtgttctggcatgcactggtccgccaggctccaggcaaggggctggattggggtggagttanatcatatgatggaactaataaagctatgcagactccgtagaaggcgattacaccatctccagacgacacttccaggacacgctgtatcnacaatanaacacgacagagagcgacgacgacgacggacgagtagttagttacgtaggtagggtaggacggtaggtagggtaggtagtag

SEQ ID NO: 292051 - DNA, 655 bp, Homo sapiens
  misc_feature: GYAE6OF02GU5IH.14.81.H04.1.454.CMB.1.raw
  modified_base (289)..(289): a, c, t, g, unknown or other
  misc_feature (289)..(289): n is a, c, g, or t
  modified_base (300)..(300): a, c, t, g, unknown or other
  misc_feature (300)..(300): n is a, c, g, or t
tcagcgtctagtaccacgaccggtgctcgatttagtagtgtagattcgcgggagctctgggagaggagcccagcactagaagtcggcggtgtttccattcggtgatcagcactgaacacagaggactcaccatggagtttgggctgagcgtggtttcgtcgttagcgtctttaagaggtgtccagtgtcaggtgcagctggtggagtcggggggaggcgtggtccagcctgggaggtccctgagctctcctgtgcagcctctggattcatcgtcagtgttctggcatgnactgggtcccncgagtctacgtaggcgaaggggtctgggtagttgggggtaggtaagtttatagtccagttagtggtaagttaggaaaacttaaaagtaaacgtacgtaagtcggacgaagtaccgttaccggtaggaaacggggtccgtaacttaccaaccgtattccgaccgaagacgtaacctaaccgttaccgaaggtaaccaccgttacgtagtactcgtacgaactaaagtacgaaaccgtacgtccgtaagaaggtacgtacgtacggacggacggacggacggtacggttacggttaacgttacgttaggtacggtaacggtaaacggtaacggtaacgggttacgggtacggtacgg

SEQ ID NO: 292052 - DNA, 559 bp, Homo sapiens
  misc_feature: GYAE6OF02IZK5R.14.81.H04.1.454.CMB.1.raw
  modified_base (265)..(265): a, c, t, g, unknown or other
  misc_feature (265)..(265): n is a, c, g, or t
  modified_base (287)..(287): a, c, t, g, unknown or other
  misc_feature (287)..(287): n is a, c, g, or t
tcagcgtctagtaccacgaccggtgctcgatttagtagtgtagattcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggaggtcggggggagcggtggtccagccgtgggaggtccctgagactctcctgtgcagcctntggattcaccgtcagtagttcnggcatgcacgtgggtccgcgaggcctccgaggcgaaggggctgggattggggtggagttatatcatatggattaggaactaagtaaagactatgacaagaccttcgaggaacgggccgtatcacatctcagacacacttacagaacacgtctagtatctagactaaatagaacgacgaccgtagaacgagtactagggaggacgacggcgtaaggttagttacgttagtacgtaggaacgtaaaggtagttaagggtacggttacgcgtcgg

SEQ ID NO: 292053 - DNA, 570 bp, Homo sapiens
  misc_feature: GYAE6OF02HOVV0.14.81.H04.1.454.CMB.1.raw
  modified_base (305)..(305): a, c, t, g, unknown or other
  misc_feature (305)..(305): n is a, c, g, or t
tcagcgtctagtaccacgaccggtgctcgatttagtagtgtagattcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcggggggaggcgtggtccagcctgggaggtccctgagactctcctgtgcagcctcgtggattcaccgtcagttagttctggcatgcacgtgggtccnccaggctccgagggcaaggggctgggagttggggtggggagttatagtcagtatgatggaaactaaataaagactatgactagacgtccgtagaagggcctattaccaaccatcctacaagacgactacttccgaaggaaccacgtctagtactcgtagactaaaagtcgaaacacgtccgttagacgacgcgtaggaacggaccgacggacgtaggttagtagttacgtggtagacgaaagtagttagggtcggtagcgtacgg

SEQ ID NO: 292054 - DNA, 613 bp, Homo sapiens
  misc_feature: GYAE6OF02IOXHT.14.81.H04.1.454.CMB.1.raw
tcagcgtctagtaccacgaccggtgctcgatttagtagtgtagattcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgggggagcgtggtccagcctgggagtccctgagactctcctgtgcagcctctggattcaccgtcagtagttctggcatgcactgggtccgcaggcctccaggcaaggggctgggattggggtgggagtttatatcatatggattagggaaacttaaagtaaaagacttaagtcgactaggtaccgtccggtaggaaacggggccctaatttaccgaacctactcccgtaccgaaggaacgacctaccgttaccgaacggaaccaccggtacttacgtactcgttacgaacaaagttacgaaacaacgtccgtagaacggacgcgtagggaacggtaccgacgggacgtaaggttagttacttacgtgtacggacgaaaggtagtacggggtacgtaggcgtcgg

SEQ ID NO: 292055 - DNA, 645 bp, Homo sapiens
  misc_feature: GYAE6OF02JIUJP.14.81.H04.1.454.CMB.1.raw
tcagcgtctagtaccacgaccggtgctcgatttagtagtgtagattcgcggggagctctgggagaggagcccagcactagaagtcggcggtgtttccattcggtgatcagcactgaacacagaggactcaccatggagtttgggctgagctgggttttcctcgttgctcttttagaggtgtccagtgtcaggtgcagctggtggagtcgggggagcgtggtccagccgtgggacggtccctggagctctcctgtgcagcctactggacttccaccgtcagtagttctggcatcgcacgtcggggccaccgaggccctaccgagggccgaagggggtcctgggagtttggggtgggatttagtactctagtagtgagtacggaaacttaataaaggactagtacgacgtaaggtacctccggtaggaaacgggccctaatacccgaacctagttaccgtaccaaggtacgtactaacccgttccgaaaggtaacctcgtacctagtactccgtacgaactaaactcgaaccgtacgaccgttaggaacgacgtaccgtaggaccgggtacaccgggtactaggttaagttacttacggtacgtaggaacgtaaggtacgttacggggttaccgtagtcccgtacgg

SEQ ID NO: 292056 - DNA, 611 bp, Homo sapiens
  misc_feature: GYAE6OF02HMOOB.14.81.H04.1.454.CMB.1.raw
tcagcgtctagtaccacgaccggtgctcgatttagtagtgtagattcgcggggagctctgggagaggagcccagcactagaagtcggcggtgtttccattcggtgatcagcactgaacacagaggactcaccatggagtttgggctgagctgggtttttcctcgttgctcttttaagaggtgtccagtgtcaggtgcagctggtggaggtcggggggagcgtggtccagccgtgggaggtccctggagactctcctgtgcagcctctggattcaccgtcagttagttctggcatgcacgtcgggtcccgccgaggcctcccgagggccgaagggggtctgggtagttggggtgggtagtttagtatacatatgagtaggaaactaaagtaaagactatgacagtacgtcctaggggggggggggggggggaacaccggtactaccacctactcctaccgacgacgaccacctaccgacgaacgacgtacgtacgttactctacgtactaaagtacgaacgacgtaccgtagacgacgacgtagacggacgacggacgtagtacgtacttacgtgtagacggtaacgtaagttagggtacggtacgtgtcgg

SEQ ID NO: 292057 - DNA, 701 bp, Homo sapiens
  misc_feature: GYAE6OF02FH91R.14.81.H04.1.454.CMB.1.raw
tcagcgtctagtaccacgaccggtgctcgatttagtagtgtagattcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcggggggagcgtggtccagccgtgggacgtccctgagactctcctgtgcagcctcgtggattcaccgtcagtacgttctggcagtcgcctacgtcggggtcccgccgtaggcctcccgagggacgaacgggggtctggggacgtttgggggtaggggtagttagtatcgaagttagtggtatagggtaaacttaaagtaaaagacttaatcgacgtaacggtaccgtccggtaggaacgggtccgtacgttaccgaaccgtaactccgtaccgagtaacgaccgtaaccgttaccgaaacggaaccgtacgtcgttacgtactacgtacgaaccgtaaagtacgaaaccgacgtaccgttagaacgtaacggtcgtacgggaaccggaccggaaccggacgtaacggttaacgttaacgttaaccggttaggttaagggaaccggtaaagggttaacggttaacggggtaccgggttacgtccggtacccggg

SEQ ID NO: 292058 - DNA, 921 bp, Homo sapiens
  misc_feature: GYAE6OF02JYDAR.14.81.H04.1.454.CMB.1.raw
  modified_base (181)..(181): a, c, t, g, unknown or other
  misc_feature (181)..(181): n is a, c, g, or t
tcagcgtctagtaccacgaccggtgctcgatttagtagtgtagattcgcggggagctctgggagaggagcccagcactagaagtcggcggtgtttccattcggtgatcagcactgaacacagaggactcaccatggagtttgggctgagctgggttttcctcgttgctcttttaagaggtntccagtgtcaggtgcagctggtggagtcgggggagcgtggtccagcctgggagtccctgacgactctccgtgtgcagcctctggacttccgaccgtcagttagttctggcagtcgtctacggtcgggtccccgacgacggtccctacggaggtaccggaacggggtcgtagggtacggtttgggggtaggggtaacgtttaacggttactaccgtaagttaacgtcgtaaaggttaacgggtaaaacttaaaagttaaaacggttacgttaagttacggaaccgtaaacgggtaccgtttacccgggttaaagggaaccgggggtacccttaaacggtttaccccctaaaaccccggtactttaaccccccgttaacggtaacccggtaaaaccggttaaaacccgtaacccccggtttaaccggtaaaacccgggaaaacccgtaacccgggttaaccgtttaaccggttaccggtttaaacccgttaccggtaaaaccggttaaaaacgttacgggtaaaaacccgttaaccgggttaaccccggtttaagggaaacgggttaaaccggtaccgggtttaaacccgggaaccgggggaacccgtaaccgggtttaaccggaaaccggggtttttagttaaaccggtttaaccggttaccgggtaagggttaaaccggtaaaacgggtaaccggggtttaaggggtttaccccgggttaaggtcccggtttacccgggg

SEQ ID NO: 292059 - DNA, 639 bp, Homo sapiens
  misc_feature: GYAE6OF02IC8XH.14.81.H04.1.454.CMB.1.raw
  modified_base (347)..(347): a, c, t, g, unknown or other
  misc_feature (347)..(347): n is a, c, g, or t
  modified_base (356)..(356): a, c, t, g, unknown or other
  misc_feature (356)..(356): n is a, c, g, or t
tcagcgtctagtaccacgaccggtgctcgatttagtagtgtagattcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggaggtcggggggagcgtggtccagcctgggagtccctggagactctcctgtgcagtcctctggacttcaccgtcagtagttctggcatgacacgtcgggtccgccaggcctccgaggccgaagggggctaggacgtttggggnggagtttanagtcagtacgtgtaagtaggaaacttaaagtaaagctaatgaccgaagacgttccggtaaggaagggcctacgttaccgaacctactcgtaccagaacgacgtaccttaccgaaacggtaacccacgtacttacgttactaccgtacgtaaccgtaaagtacgaaacgacggtaccgtagtacggaacgtacgtacgggacggacgacggtacgtaggttaacgtacgttaagtacggtacggtaacggaaaggtacgtaacgggtacggtagacgttaccgg

SEQ ID NO: 292060 - DNA, 693 bp, Homo sapiens
  misc_feature: GYAE6OF02HFJI6.14.81.H04.1.454.CMB.1.raw
  modified_base (369)..(369): a, c, t, g, unknown or other
  misc_feature (369)..(369): n is a, c, g, or t
tcagcgtctagtaccacgaccggtgctcgatttagtagtgtagattcgcggggagctctgggagaggagcccagcactagaagtcggcggtgtttccattcggtgatcagcactgaacacagaggactcaccatggagtttgggctgagccgggttttcctcgttgctcttttaagagtgtccagtgtcaggtgcagctgggtggaggtcggggggaggcggtggtccagccgtgggacggtccctgagactctcctgtgcacgcctctggattccaccgtctagtacgttcgtggcatggacacgtcggggtccgccgaggcctccgagggtcgaaggggcctgggaagttggggtgggtagttatanctaatatgtataggaaacttaaagtaaaagcgtatagacaagtaccgtacgtaggaacgggacctagtccaactctaccaccgaagaacgaacctacgttacccgaaggtaaacctcgacgttagtactctacggaactaaagttaaccgaaacgtacgtaccgtacggaacgtacgtacggtaaggaaccgggaaccggtacccgggtaactacgggttaacgtttaacggttacggttaaacggttcgggaaaacgggtttaacgaaacgggtttaccgggggttaaaccgggtaggttacccggtacgggttaccccgggg

SEQ ID NO: 292061 - DNA, 609 bp, Homo sapiens
  misc_feature: GYAE6OF02HDJN3.14.81.H04.1.454.CMB.1.raw
  modified_base (397)..(397): a, c, t, g, unknown or other
  misc_feature (397)..(397): n is a, c, g, or t
tcagcgtctagtaccacgaccggtgctcgatttagtagtgtagattcgcggggagctctgggagaggagcccagcactagaagtcggcggtgtttccattcggtgatcagcactgaacacagaggactcaccatggagtttgggctgagctgggtttttcctcgttgctcttttaagaggtgtccagtgtcaggtgcagctggtggaggtcggggggagcgtggtccagcctgggaggtccctgagactctcctgtgcagcctctggattcaccgtcagtagttctggctatgcacgtcgggtcccgccaggcctccgaggaccgaagggggcctgggagtttggggtgggagtttatagtcgatagtggatagggaacttaaagtaaagacttagngcaagacgttccggtagaacgggaccgtacttcgaccctatccgtaccaagacgacctacttaccgaaggaacgacgcttacgtactcgtacgacaaagtacgtaacgcgtaccgtagaagcggacgtaggaacggacgacggtacggtaggttacgtaagtttacgttcggtacgtacgtaaggagttagggtacggtaggtcgtaccggg

SEQ ID NO: 292062 - DNA, 722 bp, Homo sapiens
  misc_feature: GYAE6OF02IOPHG.14.81.H04.1.454.CMB.1.raw
  modified_base (294)..(294): a, c, t, g, unknown or other
  misc_feature (294)..(294): n is a, c, g, or t
  modified_base (685)..(685): a, c, t, g, unknown or other
  misc_feature (685)..(685): n is a, c, g, or t
tcagcgtctagtaccacgaccggtgctcgatttagtagtgtagattcgcggggagctctgggagaggagcccagcactagaagtcggcggtgtttccattcggtgatcagcactgaacacagaggactcaccatggagtttgggctgagcttgggtttttcctcgttgctctttttaagaggtgtccagtgtcaggtgcagctggtggaggtcggggggagcggtggtccagccgtgggacggtccctgacgactcctcgtgtgcacgtcctcgtaggactttccgacccgttntaaggttacgttccgtggcctagttcggtacctacggtcggggtccccgaccgacgggtcccgtacccgagggaccgtaacgggggtccttaggggtacggtttggggtacgggtaagttttaacgtacgttacgtaacgttagtacgtaacgttaacgggtaaaacttaaagtaaaacggtaacttacgtgaactaacggtacccgtaccggtaacgggtaaccggggtccttaacttacccaaaccgtacttacccgtacgaacgtaacgtaaccctaccgttaaccggaagacccgacgtctagttctactagaaactaactaacgacgacggtcctagaagtacgtcgagaacggcgaacggtagtaaggttactacttacggtagnggtaaacggaacgtaggttcggaacgttcgtgtacgg

SEQ ID NO: 292063 - DNA, 723 bp, Homo sapiens
  misc_feature: GYAE6OF02FPEHP.14.81.H04.1.454.CMB.1.raw
  modified_base (335)..(335): a, c, t, g, unknown or other
  misc_feature (335)..(335): n is a, c, g, or t
  modified_base (613)..(613): a, c, t, g, unknown or other
  misc_feature (613)..(613): n is a, c, g, or t
  modified_base (648)..(648): a, c, t, g, unknown or other
  misc_feature (648)..(648): n is a, c, g, or t
tcagcgtctagtaccacgaccggtgctcgatttagtagtgtagattcgcggggagctctgggagaggagcccagcactagaagtcggcggtgtttccattcggtgatcagcactgaacacagaggactcacatggagttgggctgagctgggtttcctcgttgctcgtttaagaggtgtccagtgtcaggtgcagcgtgggtggaggtcggggggagcgtggtccgaggccgtagggacggtccctggagtaccgtctccgtgtgcacgcctgtggtacttccgaccggtctaaggttagttccgtgggcctagtcgactacggtcggggtcccnccgtaggccctaccggaggcgaaggggctagggtacggttggggtagggtagttagtacgtacgtaagtacgtggaacgttaagggtaaaacttaaaaggtaaaacgtaccgtttaagacggtaaccgtacggtaacccgtttacggggaacggtaaaccggggtacccgtaattacccgaacccttacgtaccgtaccgaagtaccggtaaccctaccgttaccgaacggtaaccctacggtcgttacgtactgacgagtagtactagaaccgtcgngtaagacgcgttacgaagggaccgagaaccgggtntaaaggttacctttaacggtcgtttaggaacggttaacggtaaaggttaaggtaccgggttcggtacgtacccgg

SEQ ID NO: 292064 - DNA, 747 bp, Homo sapiens
  misc_feature: GYAE6OF02JB1UJ.14.81.H04.1.454.CMB.1.raw
  modified_base (161)..(161): a, c, t, g, unknown or other
  misc_feature (161)..(161): n is a, c, g, or t
  modified_base (271)..(271): a, c, t, g, unknown or other
  misc_feature (271)..(271): n is a, c, g, or t
  modified_base (303)..(303): a, c, t, g, unknown or other
  misc_feature (303)..(303): n is a, c, g, or t
tcagcgtctagtaccacgaccggtgctcgatttagtagtgtagattcgcggggagctctgggagaggagcccagcactagaagtcggcggtgtttccattcggtgatcagcactgaacacagaggactcaccatggagtttgggctgagctgggttttccncgttgctcttttaagaggtgtccagtgtcaggtgcagctggtggaggtcggggggagcggtggtccgagccgtggggaggtcccctggacgactcctcctgtgcagcctntggattccaccgtcagtagttcctggcatgcncgtgggtcccgcaggcctccgaggtaccgaagggggtctacgggtagttggggtagggtagttacgtagtcgtagtagtcggaagttacgggtaaactaaacgtaaaaggtccttaagtcggaccgtaacggtacccgtttaccgggtacgggtaaccggggtacccggtacgtttacccgaacccgtacgttcccgttaacccgaacgggtaaacggtaaccctaacccgttttacccgaaacgggtaaacccgtaccggtaccgttaccggttactaccggtaacgtaagttaaaccgtaacgtaaaccgtaaccggtacccgttacgggaacggaccgtacggaacggtaccggaccggtacggacgttacggttaaggttacgttacgtaggttacggaacgtaaacggtagttacgggtacggttaggtccgttacggg

SEQ ID NO: 292065 - DNA, 862 bp, Homo sapiens
  misc_feature: GYAE6OF02G6KSW.14.81.H04.1.454.CMB.1.raw
  modified_base (178)..(178): a, c, t, g, unknown or other
  misc_feature (178)..(178): n is a, c, g, or t
tcagcgtctagtaccacgaccggtgctcgatttagtagtgtagattcgcggggagctctgggagaggagcccagcactagaagtcggcggtgtttccattcggtgatcagcactgaacacagaggactcaccatggagtttgggctgagctgggttttcctcgttgcttcttttaagnggtgtccagtgtcgaggtgcgagcgtgggtgggagggtcgggggggaggtcggttcgggtcccgaggtcccggtgggggtacggttccccgtaggacgtaccttccgtccgtggtcgccgaccggtcctacgtaaggtactttaccgttaagtttttacgacgttaattagtacgtacctagtacggtacgtccggtcggggtcccgaccggtacgggtcccgtaccgggaacgggggaacggggtccggtaggggtacgggttcgggtccgtacgacggtaacgtaacgttacggtaggttacggtttacggtaagggtagggtaaacgtacgtaacgttccggtaaccgtcccgttaccggtccgggtaacgggtaacccgggttcccgttacccgtccctaacgtacccgtaccgtaacggtaaccgtaaaccgtaaaccgttaaccgaaaccgttaaaccttaacctttaccgtttaccttttaaccgttaaacgtaaacgtaccgtacgtaaccggtaccgtaaacggaaaccgtaaacgggaaacgtaacgggtacggttacggttaggtttaacgtttaggtaagtaacgtaaggtaacgttaaaggtacgttaactagttacgttaaccgttaacgttagggtttacgggtacggttacgtttacgtaggttacgg

SEQ ID NO: 292066 - DNA, 698 bp, Homo sapiens
  misc_feature: GYAE6OF02IR0Z4.14.81.H04.1.454.CMB.1.raw
  modified_base (534)..(534): a, c, t, g, unknown or other
  misc_feature (534)..(534): n is a, c, g, or t
tcagcgtctagtaccacgaccggtgctcgatttagtagtgtagattcgcggggagctctgggagaggagcccagcactagaagtcggcggtgtttccattcggtgatcagcactgaacacagaggactcaccatggagtttgggctgagcttgggtttttcctcgttgctcttttaagaggtgtccagtgtcaggtgcagcgtggtggaggtcggggggaggcgtggtccagccgtgggacgtcccgtggacgactcctcctgtgccaggccttcgtggattccgaccgtctagttagttcgtggctatgccgacgtcgggtcccgccgaggccgtcgagggtcgaacggggtcgtgggtaggttggggtacgggtagtttatacgttctaagttagtaggtagttaaggtaaaacgttaaagtaaaacgtaactttagtacggactacggaaccgttaccggtaggaaccgggtcctaacttccgaacctagtccaacgaaggtacacccgtacttaccggaacgacaccgtnttagtcctagtgaaccctaaagtacgaaccgtgtaccgtaagaacgtcgaacgttacgggaacggaccgacgggtaccgtaaggtttacgttaacggtttaccgtagggtaacctaacggggtaaagttacggtaacggggttacggttacgcgttcccggggg

SEQ ID NO: 292067 - DNA, 851 bp, Homo sapiens
  misc_feature: GYAE6OF02GVVVR.14.81.H04.1.454.CMB.1.raw
  modified_base (178)..(178): a, c, t, g, unknown or other
  misc_feature (178)..(178): n is a, c, g, or t
  modified_base (323)..(323): a, c, t, g, unknown or other
  misc_feature (323)..(323): n is a, c, g, or t
tcagcgtctagtaccacgaccggtgctcgatttagtagtgtagattcgcggggagctctgggagaggagcccagcactagaagtcggcggtgtttccattcggtgatcagcactcgaacacagaggactcaccatggagtttgggctgagcttgggtttcctcgttgcttctttaagnggtcgtccagtgtcaggtgcgagtcgtgggtggagggtcggggggaggcggtcggtccgaggtccggtggggacggtcccgtaggacgtaccgttcctccgtgtcgcgacgtcctgtggacttccaccgttcgaggttacgttcnggctacgtggaccgtacggtccgggtacccgccgtaacgggtcccgtacccggaaggggaccgggaacgggggtaccgttaggggtacgggtttcggggggtaggttaacggtttaactaggttacgtaagttacggtaggtaagtaaacgggtaaaactaaaacgtaaacgtaacgtacgtacgaaccggtaacgaaccgtttacgggtaaggggtaacccgggtaccctttacgtaacccgtaaccgtaaccggttaccgtaaccggtaaccggaaacgtacccgttaaccggttaaccggaaaccggttaaccgtacggtaacgtccgtttaactaccgtaaggtaaacctaacggttaacgaactaaccggtacgttaacggtacggtaccgtacggtaacgggaaccggttacgtaccgggtacgttaaacggttacgttaacgtttaccggggtacgtaaacggtaaaacccgggtaagtacggggtttaaccggttacgggtaccgtaacgggttcccggg

SEQ ID NO: 292068 - DNA, 909 bp, Homo sapiens
  misc_feature: GYAE6OF02I144N.14.81.H04.1.454.CMB.1.raw
  modified_base (304)..(304): a, c, t, g, unknown or other
  misc_feature (304)..(304): n is a, c, g, or t
tcagcgtctagtaccacgaccggtgctcgatttagtagtgtagattcgcggggagctctgggagaggagcccagcactagaagtcggcggtgtttccattcggtgatcagcactgaacacagaggactcaccatggagtttgggctgagcttgggttttcctcgttgtcttcttttaagaggttgtaccagtgtcaggtgcagtctggtggaggtcgggggagcgtgtccaaccgtgggacgtccctgacgacctctccgtgtcgcacgcctcgtgtacttccaccgttacagttacgttccgngggctagtcggactacgtcgggtacccgccgacggtccgtacccggacgggtccggaaacgggggtcttaggggtacggttttacgggggttgggtaaacgtttagtaacgttacgttaagttacggttaaggtaacggttacggtaaaacctttaaaacgttaaaacgtaacgttaaacgtccggtaaccgtaccgggttaacccgttaccggggtaacgggtaaacccggggtaccgttaacccgtttacccgaaaccggtttactaccccgtacccggtaaacgtaaaccggttaacccttaacccggttaacccgaaaaccgggtaaaccgttacccggtaaccggtttacgttaaacgttcccgtaaccggtaaacgtaaaacgttaccggaaaccgtaccgtaccgttaaggaaccggttaacggaacgttacggggaaaccggtaccccggtacgggttaccttaacgggtttacgttttaaacccgggttacgtttaacgggtaaccccgttaaagggtttaaaaaccgggttaccggttaaccggggggtttaaccgtaccgggttaacccgggttacccgggtttcccccggggg

SEQ ID NO: 292069 - DNA, 564 bp, Homo sapiens
  misc_feature: GYAE6OF02HRF1S.14.81.H04.1.454.CMB.1.raw
  modified_base (69)..(69): a, c, t, g, unknown or other
  misc_feature (69)..(69): n is a, c, g, or t
  modified_base (178)..(178): a, c, t, g, unknown or other
  misc_feature (178)..(178): n is a, c, g, or t
  modified_base (182)..(182): a, c, t, g, unknown or other
  misc_feature (182)..(182): n is a, c, g, or t
  modified_base (188)..(188): a, c, t, g, unknown or other
  misc_feature (188)..(188): n is a, c, g, or t
  modified_base (190)..(190): a, c, t, g, unknown or other
  misc_feature (190)..(190): n is a, c, g, or t
  modified_base (234)..(234): a, c, t, g, unknown or other
  misc_feature (234)..(234): n is a, c, g, or t
  modified_base (265)..(265): a, c, t, g, unknown or other
  misc_feature (265)..(265): n is a, c, g, or t
  modified_base (270)..(270): a, c, t, g, unknown or other
  misc_feature (270)..(270): n is a, c, g, or t
  modified_base (279)..(279): a, c, t, g, unknown or other
  misc_feature (279)..(279): n is a, c, g, or t
  modified_base (307)..(307): a, c, t, g, unknown or other
  misc_feature (307)..(307): n is a, c, g, or t
  modified_base (346)..(346): a, c, t, g, unknown or other
  misc_feature (346)..(346): n is a, c, g, or t
  modified_base (451)..(451): a, c, t, g, unknown or other
  misc_feature (451)..(451): n is a, c, g, or t
  modified_base (478)..(478): a, c, t, g, unknown or other
  misc_feature (478)..(478): n is a, c, g, or t
  modified_base (495)..(495): a, c, t, g, unknown or other
  misc_feature (495)..(495): n is a, c, g, or t
  modified_base (503)..(503): a, c, t, g, unknown or other
  misc_feature (503)..(503): n is a, c, g, or t
  modified_base (529)..(529): a, c, t, g, unknown or other
  misc_feature (529)..(529): n is a, c, g, or t
  modified_base (536)..(536): a, c, t, g, unknown or other
  misc_feature (536)..(536): n is a, c, g, or t
  modified_base (545)..(545): a, c, t, g, unknown or other
  misc_feature (545)..(545): n is a, c, g, or t
tcagcgtctagtaccacgaccggtgctcgatttagtagtgtagattcgcgggggagctctgggagaggngcccagcactagaagtcggcggtgtttccattcggtgatcagcactgaaccacagaggactcaccatggagtttgggctgagcggtcgttgcgtaggctcttaagtagncatntcagtncntcgtgtagagtcggggagtcgtgtccgaagtcctgggactccgngacgctcgttcagtcgctagcctgtgactcncgtangtaatcagngtactgcacgtcggtacgctacggctcnggacgagggtcttagaagggttcggagggtatactcttnagtaattggacgttaggaaataacaaaggtacttcggaactggaccaacgtcgaaccggtagctacgttaacaccctagactaaccgtgaacctactactacganaacggtcaaacctttgactcggttaanaacgactaggaccagtnaacgcgtnacgtgactacggcaaggtctacgttntcggtancgttagacnggtaccgtgacctggtacc

SEQ ID NO: 292070 - DNA, 679 bp, Homo sapiens
  misc_feature: GYAE6OF02JMM8P.14.81.H04.1.454.CMB.1.raw
  modified_base (180)..(180): a, c, t, g, unknown or other
  misc_feature (180)..(180): n is a, c, g, or t
tcagcgtctagtaccacgaccggtgctcgatttagtagtgtagattcgcggggagctctgggagaggagcccagcactagaagtcggcggtgtttccattcggtgatcagcactgaacacagaggactcaccatggagtttgggctgagctgggttttcctcgttgctctttaagaggtntccagtgtcaggtgcagctgggtggaggtcggggggagcgtggtccagccgtggggacggtccctgacgacctcctcctggtagccaggtccctcgtgggacttccaaccggtcaaggttagttcgtggcatgccgtagtcgggtcccgtccgaggtcctaccgaggtccgaacgggggtcttggggaacgtttgggggtggggtaagtttactacgtacgaattacgttgaacggttaggtaaacttaaaaggtaaacgtacttaagttacgaacgtacgtaaccgttaccggtagggaacggtccgtattaaccaccgtaacttcctacggaagtaacgtaaccctaccgttaaccggaacgtaaacctacggacctttacgacttcccggtataaaccgtaactacggaactacgtccgaagtagacgtcgtaagacggtacgacgagttacgtattacgtacgtgtagacgtagtagtacggtacgacgtggtcg

SEQ ID NO: 292071 - DNA, 918 bp, Homo sapiens
  misc_feature: GYAE6OF02FY3TG.14.81.H04.1.454.CMB.1.raw
tcagcgtctagtaccacgaccggtgctcgatttagtagtgtagattcgcgggggagctctgggagaggagcccagcactagaagtcggcggtgtttccattcggtgatcagcactgaacacagaggatcaccatggagtttgggctgagcttgggttttcctcgttgctcttttaagaggtgtccagtgtcaggtgcagctggtggaggtcggggggaggtcgtggtccgaggccgtgggggacggttccctgacgtacgttccgttccgtggttcggacctaggcccgttctacgggacttaccgtacccggttctaacggtttaggttcttgggtcagttcggacgtaccgttcggggttcccgccgacggtccgtacccgagggaccggtaacgggggtccttaggggtaagtttgggggttagggggtaacgtttaacgttaagtaccgagtttaagtgtaacgttagggtaaaaccttaaagtaaaacggtaacgttaacgtaggaccggttaaccggaacgtttccccgggttaaggtaaccggggtaccgtaaccgtttaccgaaacccttaccgttaacccgttaccgaacgggtaacccggtaccttaacccggtttaacccaacggtaaaacccggtacccgtaccgggttaacgttaccgttccggtttaacgaaacccggtttaaagttacccggaaaaaccgtaccgggtaacccggtggtaaaccggttaacggtacccgttaacggggtaaacccgggtacgtaaccccgggaaggtttaaccgggttaaaccggttttaaggtttaacccccgtggggttaaacccgggtaaacgggtaaaaccggtttaagggtacccgggggggttttaaaggggtacccggttacccgggtaacccggg

SEQ ID NO: 292072 - DNA, 657 bp, Homo sapiens
  misc_feature: GYAE6OF02GRJ38.14.81.H04.1.454.CMB.1.raw
  modified_base (317)..(317): a, c, t, g, unknown or other
  misc_feature (317)..(317): n is a, c, g, or t
tcagcgtctagtaccacgaccggtgctcgatttagtagtgtagattcgcggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctgggtggaggtcggggggaggcgtggtccagccgtggggacggtccctggacgtactcctcctggtgcagcctgtcggattcgaccgtcagtcgttctggcatgcacgtcgggtccnccgaggcctccgaggacggacggggcgtagggaggttggggtagggtagttatagtaccgtaatacgtggaacgtaaggtaaaacttaaaagtaaaacgtactaagtagacctaggtacctacggtaggaacgggtacctaattccgaaccgtactcctaacgaggtaaccgactaccgtaaccgaacggactacggaccttagtactacgtacgaacgtaagttacgaacgtacgacgtacgaacggtctacgtacggaacgtacgacggtcgtagttagttaacttcggtagtacgggaacgtaagggtaacgtacggggtacgtacggtgtaccggg

SEQ ID NO: 292073 - DNA, 924 bp, Homo sapiens
  misc_feature: GYAE6OF02HRQFV.14.81.H04.1.454.CMB.1.raw
  modified_base (123)..(123): a, c, t, g, unknown or other
  misc_feature (123)..(123): n is a, c, g, or t
tcagcgtctagtaccacgaccggtgctcgatttagtagtgtagattcgcggggagctctgggagaggagcccagcactagaagtcggcggtgtttccattcggtgatcagcactgaacacagnggactcacagtggagtttggctggagtcgttgggttttccctcggttcgtcttacgtttttaaggagggttcgttcccgaaggttgttccgaagggttgccgtaggccgtggggttcgggagggtcgggggggaggtcggttcggtccgaggcccgttggggacggttcccctaggaaccgtacccgttcgttacccgttggcgtaccgtacggttccccttcggttacgggtaacctttacccgtaaccccgggtttactaacggggtttaccggttttccggtcggtaaccgttacggttccgggtacccgtttaaaccccgggtttccggggggcccccggtaaacccccggttcgggtccccccgttcggaaacggggttacccggggtaaaaccggggttccgggttagggttaacgggtttcgggggtaaggttaacggtttacttaacgttaccgtaagttaacgtacggtaggttaaacgtaaacgttaaaaacttaacggtactaagtaccgaagtaccccggtaacgtccggggtaaacggtaacgggtaccgttaacgtaaccgtacgtacttccgaaccgtaaacgtacgaccgtacgtaaccgaaacggtaccgaaccgttcgtaacgtactccgtaagtaacaacgtacgtaccgtaccgtacggtagaacgtacggtgtacggaaccgtacgacggtacgttcggttaacgttacgtaaccggttacggaacggtaacggttaaggtaaccggttaggggtaacgttaccggtaggttaccccggg

SEQ ID NO: 292074 - DNA, 788 bp, Homo sapiens
  misc_feature: GYAE6OF02IQYNJ.14.81.H04.1.454.CMB.1.raw
tcagcgtctagtaccacgaccggtgctcgattttagtagtgtagattcgcgggggagctctgggagaggagcccagcactagaagtcggcggtgtttccattcggtgatcagcactgaacacagaggactcaccatggagtttgggctgagcttgggtttttcctgttgtcttacttttaagaggtgtccagttgtcaggtgcagcgtggtgggagggtcggggggaggcggtggtccgacgtccgtaggggaccggtcccgtaggaccgtacttccgtcctgtcgccgtacgtcccgttcgtggtacttacccgtaccgttacgtacggttcgttcgtcgacgtacgtcgaccgtaccggtccgggtccccgaccggtcggtaccgtaccggacggacgggaacggggtcgtagggtagggttggggtaggtaagttacgtacgtacgtaagttagtacgtaagtaaggtaaacttaaaagtaacgtaatacgtcgtaacgtacgtaccgtacgggtaacggaaccgggtcctttaaacgtccccaaccgttaacgacccgtacgaaacgtaccggtaaaccgtaccttaaccggaacgtaaccgtcgtaagttacgtaactacgtacgaacgtaaacgtaacgacgaccgttacgaagtaacgccggaagttaagggacccgtaccgggtacgtaggttaaacggttacgttaacggttacggaacggttaaaggaacgggttaaacggttcgggtacggggtaacgttacgttccgtacccgggg

SEQ ID NO: 292075 - DNA, 407 bp, Homo sapiens
  misc_feature: GYAE6OF01EA9NR.18.60.F05.1.454.CMB.1.raw
  modified_base (402)..(407): a, c, t, g, unknown or other
  misc_feature (402)..(407): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcaccatctgtcttcatcttcccgcatctgacatactcgtactgagcgggctggcaaggcgcatagnnnnnn

SEQ ID NO: 292076 - DNA, 408 bp, Homo sapiens
  misc_feature: GYAE6OF01ET72M.18.60.F05.1.454.CMB.1.raw
  modified_base (404)..(408): a, c, t, g, unknown or other
  misc_feature (404)..(408): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgtttcggccaagggaccaaggtggaaatcaaacgaactgtggctgcaccatctgtcttcatcttcccgccatctgacatactcgtactgagcgggctggcaaggcgcatagnnnnn

SEQ ID NO: 292077 - DNA, 409 bp, Homo sapiens
  misc_feature: GYAE6OF01BE0L3.18.60.F05.1.454.CMB.1.raw
  modified_base (402)..(409): a, c, t, g, unknown or other
  misc_feature (402)..(409): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggccaaggtggaaatcaaacgaactgtggctgcaccatctgtcttcatcttcccgccatctgacatactcgtactgagcgggctggcaaggcgcatagnnnnnnnn

SEQ ID NO: 292078 - DNA, 406 bp, Homo sapiens
  misc_feature: GYAE6OF01DDKKV.18.60.F05.1.454.CMB.1.raw
  modified_base (398)..(398): a, c, t, g, unknown or other
  misc_feature (398)..(398): n is a, c, g, or t
  modified_base (403)..(406): a, c, t, g, unknown or other
  misc_feature (403)..(406): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtaggctgcaccatctgtcttcatcttcccgccatctgacatactcgtactgagcgggctggcaaggcgnatagnnnn

SEQ ID NO: 292079 - DNA, 407 bp, Homo sapiens
  misc_feature: GYAE6OF01EB8Y8.18.60.F05.1.454.CMB.1.raw
  modified_base (401)..(407): a, c, t, g, unknown or other
  misc_feature (401)..(407): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcaccatctgtcttcatctcccgcatctgacatactcgtactgagcgggctggcaaggcgcatagnnnnnnn

SEQ ID NO: 292080 - DNA, 406 bp, Homo sapiens
  misc_feature: GYAE6OF01CG8LI.18.60.F05.1.454.CMB.1.raw
  modified_base (402)..(406): a, c, t, g, unknown or other
  misc_feature (402)..(406): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacgtagttcatctccgacgttcggccaagggaccaaggtggaaatcaaacgaactgtggctgcaccatctgtcttcatcttcccgctatctgacatactcgtactgagcgggctggcaaggcgcatagnnnnn

SEQ ID NO: 292081 - DNA, 425 bp, Homo sapiens
  misc_feature: GYAE6OF01CA5FL.18.60.F05.1.454.CMB.1.raw
  modified_base (331)..(331): a, c, t, g, unknown or other
  misc_feature (331)..(331): n is a, c, g, or t
  modified_base (394)..(394): a, c, t, g, unknown or other
  misc_feature (394)..(394): n is a, c, g, or t
  modified_base (402)..(425): a, c, t, g, unknown or other
  misc_feature (402)..(425): n is a, c, g, or t
tcagtacgagtatgcacgaccggtgctcgatttagtacgtcatcagggaaagggccaccctctcgttgtagggccagtcagagtgttagcagcaactacttagcctggtaccagcagaccacctggccaggctcccaggctcctcatccatggtgcatccaccagggccactggcatcccagacaggttcagtggcagtggtctgggacagacttcattctcaccatcagcagactggagcctgaagattttgcagtgtattactgtcagcagtacggtagttcatctccgacgttcggccaagggaccaaggtggaaatcaaacgactgnggctgcacatctgtctcatctcccgcatctgacatactcgtactgagcgggctgggcaaggcncattacgnnnnnnnnnnnnnnnnnnnnnnnn

SEQ ID NO: 292082 - DNA, 406 bp, Homo sapiens
  misc_feature: GYAE6OF01BDH4L.18.60.F05.1.454.CMB.1.raw
  modified_base (401)..(406): a, c, t, g, unknown or other
  misc_feature (401)..(406): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcacatctgtcttcatcttcccgcatctgacatactcgtactgagcgggctggcaaggcgcatagnnnnnn

SEQ ID NO: 292083 - DNA, 410 bp, Homo sapiens
  misc_feature: GYAE6OF01DUECG.18.60.F05.1.454.CMB.1.raw
  modified_base (401)..(410): a, c, t, g, unknown or other
  misc_feature (401)..(410): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagtttcatctccgacgttcggccaagggaccaaggtggaaatcaaacgaactgtggctgcacatctgtcttcatctcccgcatctgacatactcgtactgagcgggctggcaaggcgcatagnnnnnnnnnn

SEQ ID NO: 292084 - DNA, 406 bp, Homo sapiens
  misc_feature: GYAE6OF01B7RQ4.18.60.F05.1.454.CMB.1.raw
  modified_base (339)..(339): a, c, t, g, unknown or other
  misc_feature (339)..(339): n is a, c, g, or t
  modified_base (400)..(406): a, c, t, g, unknown or other
  misc_feature (400)..(406): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgctagtttattactgtcagcagtacggtagttcatctccgacgttcggccaagggaccaaggtgaaatcaaacgactgtggctgcacntctgtctcatcttcccgctatctgacatactcgtactgagcgggctggcaaggcacatagnnnnnnn

SEQ ID NO: 292085 - DNA, 407 bp, Homo sapiens
  misc_feature: GYAE6OF01DJSYQ.18.60.F05.1.454.CMB.1.raw
  modified_base (329)..(329): a, c, t, g, unknown or other
  misc_feature (329)..(329): n is a, c, g, or t
  modified_base (400)..(407): a, c, t, g, unknown or other
  misc_feature (400)..(407): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggccaaggtggaaatcaaacgactgnggctgcacatctgtcttcatcttcccgctatctgacatactcgtactgagcgggctggcaaggcgcatagnnnnnnnn

SEQ ID NO: 292086 - DNA, 404 bp, Homo sapiens
  misc_feature: GYAE6OF01DTBSU.18.60.F05.1.454.CMB.1.raw
  modified_base (239)..(239): a, c, t, g, unknown or other
  misc_feature (239)..(239): n is a, c, g, or t
  modified_base (393)..(393): a, c, t, g, unknown or other
  misc_feature (393)..(393): n is a, c, g, or t
  modified_base (399)..(404): a, c, t, g, unknown or other
  misc_feature (399)..(404): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagattttgcagtgtattactgtcagcagtacgtagttcatctccgacgttcggccaaggaccaaggtggaaatcaaacgaactgtggctgcacatctgtcttcatcttcccgcatctgacatactcgtactgagcgggctggcaaggcncatagnnnnnn

SEQ ID NO: 292087 - DNA, 411 bp, Homo sapiens
  misc_feature: GYAE6OF01CHGJ1.18.60.F05.1.454.CMB.1.raw
  modified_base (239)..(239): a, c, t, g, unknown or other
  misc_feature (239)..(239): n is a, c, g, or t
  modified_base (401)..(411): a, c, t, g, unknown or other
  misc_feature (401)..(411): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagattttgctagtgtattactgtcagcagtacggtagttcatctccgacgttcggccaagggaccaaggtggaaatcaaacgactgtggctgcacatctgtcttcatcttcccgcatctgacatactcgtactgagcggctggacaggcgcagtagnnnnnnnnnnn

SEQ ID NO: 292088 - DNA, 404 bp, Homo sapiens
  misc_feature: GYAE6OF01EP1KS.18.60.F05.1.454.CMB.1.raw
  modified_base (379)..(379): a, c, t, g, unknown or other
  misc_feature (379)..(379): n is a, c, g, or t
  modified_base (400)..(404): a, c, t, g, unknown or other
  misc_feature (400)..(404): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcacatctgtcttcatcttcccgcatctgacataccgtactgancgggctggcaaggcgcatagnnnnn

SEQ ID NO: 292089 - DNA, 399 bp, Homo sapiens
  misc_feature: GYAE6OF01CFG8F.18.60.F05.1.454.CMB.1.raw
  modified_base (356)..(356): a, c, t, g, unknown or other
  misc_feature (356)..(356): n is a, c, g, or t
  modified_base (378)..(378): a, c, t, g, unknown or other
  misc_feature (378)..(378): n is a, c, g, or t
  modified_base (387)..(387): a, c, t, g, unknown or other
  misc_feature (387)..(387): n is a, c, g, or t
  modified_base (392)..(399): a, c, t, g, unknown or other
  misc_feature (392)..(399): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagtattttgcagtgtattactgtcagcagtacggtagttcatctcgacgttcggcaagggaccaaggtgaaatcaaacgactgtgctgcacatctgtctcatctccgcatcngactatctcgtactgacgcggntgacaggcnatagnnnnnnnn

SEQ ID NO: 292090 - DNA, 416 bp, Homo sapiens
  misc_feature: GYAE6OF01BY5FD.18.60.F05.1.454.CMB.1.raw
  modified_base (239)..(239): a, c, t, g, unknown or other
  misc_feature (239)..(239): n is a, c, g, or t
  modified_base (406)..(416): a, c, t, g, unknown or other
  misc_feature (406)..(416): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagattttgcagtgtattactgtcagcagtacgtagttcatctccgacgttcggcctaagggaccaaggtggaaaatcaaaacgaactgtggctgcatcatctgtcttcatcttccgccatctgacagtactcgtactgagcgggctggcaaggcgcatacgnnnnnnnnnnn

SEQ ID NO: 292091 - DNA, 619 bp, Homo sapiens
  misc_feature: GYAE6OF01DNHON.18.60.F05.1.454.CMB.1.raw
  modified_base (589)..(619): a, c, t, g, unknown or other
  misc_feature (589)..(619): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagacagacgtggacgctagaagttatttgactaggttagttattacgtgtcgagacgtacggttacgggttagttactacttccgtaccggtaccggttccggaccggaaacgggtaaccgtaaagggtaacggtaaaacttaaccgaaaacggtaacgttgggtacggtcgttaggaccctaacctacgttacgtttcggttacctttactaacctttcccccgtttaccccgacccttacgttcctacggtaacttaaccgtttacccgtaccggttaacgtacggggaaccggggtcccggggttacgttacgggaaaccgggtaacggggcccgtaactaaaggttcggctactcgannnnnnnnnnnnnnnnnnnnnnnnnnnnnnn

SEQ ID NO: 292092 - DNA, 422 bp, Homo sapiens
  misc_feature: GYAE6OF01B9V4R.18.60.F05.1.454.CMB.1.raw
  modified_base (259)..(259): a, c, t, g, unknown or other
  misc_feature (259)..(259): n is a, c, g, or t
  modified_base (278)..(278): a, c, t, g, unknown or other
  misc_feature (278)..(278): n is a, c, g, or t
  modified_base (414)..(422): a, c, t, g, unknown or other
  misc_feature (414)..(422): n is a, c, g, or t
tcagtacgagtatgcacgaccggtgctcgatttagtacgtcatcagggaaaggggctggaatatattgggattacctcttacagtgggaccacccattacaacccgtccctcaaaagtcgactcaccatttccgtggacacgtcgaaaaacgagttctccctggacttgacctctgtgaccgccgcagacacggctgtttattactgtgcgagacgactacctgactccaatccatactttgactattggggccggganccctggtcaccgtctcctnagcctccaccaagggcccatccgtcttccccctggcgccctgctccaggagcacctccgagagcacagccgccctgggctgcctggtcaaggctacttcccatactcgtactgagcgggctggcaaggcgcatagnnnnnnnnn

SEQ ID NO: 292093 - DNA, 411 bp, Homo sapiens
  misc_feature: GYAE6OF01EW942.18.60.F05.1.454.CMB.1.raw
  modified_base (400)..(401): a, c, t, g, unknown or other
  misc_feature (400)..(401): n is a, c, g, or t
  modified_base (403)..(411): a, c, t, g, unknown or other
  misc_feature (403)..(411): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggcaaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcaccatctgtcttcatctccgcatctgacatactcgtactgagcgggctggcaaggcgcatagnngnnnnnnnnn

SEQ ID NO: 292094 - DNA, 408 bp, Homo sapiens
  misc_feature: GYAE6OF01BR2U3.18.60.F05.1.454.CMB.1.raw
  modified_base (402)..(408): a, c, t, g, unknown or other
  misc_feature (402)..(408): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcggtgtattactgtcagcagtacggtagttcatctccgacgttcggaccaagggaccaaggtggaaatcaaaacgaactgtggctgcacatctgtctcatcttcccgcatctgacatactcgtactgagcgggctggcaaggcgcatagnnnnnnn

SEQ ID NO: 292095 - DNA, 521 bp, Homo sapiens
  misc_feature: GYAE6OF01BG2EV.18.60.F05.1.454.CMB.1.raw
  modified_base (447)..(447): a, c, t, g, unknown or other
  misc_feature (447)..(447): n is a, c, g, or t
  modified_base (449)..(450): a, c, t, g, unknown or other
  misc_feature (449)..(450): n is a, c, g, or t
  modified_base (453)..(454): a, c, t, g, unknown or other
  misc_feature (453)..(454): n is a, c, g, or t
  modified_base (457)..(457): a, c, t, g, unknown or other
  misc_feature (457)..(457): n is a, c, g, or t
  modified_base (460)..(460): a, c, t, g, unknown or other
  misc_feature (460)..(460): n is a, c, g, or t
  modified_base (462)..(462): a, c, t, g, unknown or other
  misc_feature (462)..(462): n is a, c, g, or t
  modified_base (469)..(469): a, c, t, g, unknown or other
  misc_feature (469)..(469): n is a, c, g, or t
  modified_base (492)..(492): a, c, t, g, unknown or other
  misc_feature (492)..(492): n is a, c, g, or t
  modified_base (508)..(508): a, c, t, g, unknown or other
  misc_feature (508)..(508): n is a, c, g, or t
tcagtacgagtatgcacgaccggtgctcgatttagtacgtcatcagggaaaggggccaccctcgtcttgtagggccagtcagagtgttaggcagcaactacttagcctggtacccagcagacaccctggccaggtctcccaggctcctcatccatcggtgcatccaccagggccactggccactcccagacaggttcacgtggcaagtggtctgggacagacttcattcgtcaccatcagcaagactggagcctgaacgattttgcagtgtattactgtcagcagtacgtagttcatcgtccgacgttcggccaagggaccaaggtcggaaatccaaaacgaactgtaggtctgcgacctatctcgtctcgattccgttcccgcctacttctacgtactatacgtcggtacctggacggcggcgtggacgaacggcgactagtagtntnnacnnagntgntntcgagtnagcgaggacagtacgcgtgtgancgcgagcgtccaccgngtactcgtgtccc

SEQ ID NO: 292096 - DNA, 419 bp, Homo sapiens
  misc_feature: GYAE6OF01EY5LP.18.60.F05.1.454.CMB.1.raw
  modified_base (259)..(259): a, c, t, g, unknown or other
  misc_feature (259)..(259): n is a, c, g, or t
  modified_base (329)..(329): a, c, t, g, unknown or other
  misc_feature (329)..(329): n is a, c, g, or t
  modified_base (408)..(408): a, c, t, g, unknown or other
  misc_feature (408)..(408): n is a, c, g, or t
  modified_base (414)..(419): a, c, t, g, unknown or other
  misc_feature (414)..(419): n is a, c, g, or t
tcagtacgagtatgcacgaccggtgctcgatttagtacgtcatcagggaaaggggctggaatatattgggattacctcttacagtgggaccacccattacaacccgtccctcaaaagtcgactcaccatttccgtggacacgtcgaaaaacgagttctccctggacttgacctctgtgaccgccgcagacacggctgtttattactgtgcgagacgactacctgactccaatccatactttgactattggggccggganccctggtcaccgtctcctcagcctccaccaagggcccatcggtcttccccctggcgccctgctccaggancacctccgagagcacagcggccctgggctgcctggtcaaggactacttcccatactcgtactgagcgggctggcaggcncatagnnnnnn

SEQ ID NO: 292097 - DNA, 403 bp, Homo sapiens
  misc_feature: GYAE6OF01D8GVO.18.60.F05.1.454.CMB.1.raw
  modified_base (330)..(330): a, c, t, g, unknown or other
  misc_feature (330)..(330): n is a, c, g, or t
  modified_base (361)..(361): a, c, t, g, unknown or other
  misc_feature (361)..(361): n is a, c, g, or t
  modified_base (392)..(392): a, c, t, g, unknown or other
  misc_feature (392)..(392): n is a, c, g, or t
  modified_base (397)..(403): a, c, t, g, unknown or other
  misc_feature (397)..(403): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagtattttgcagtgtattactgtcagcagtacggtagttcatctccgacgttcggccaagggaccaaggtgaaatcaaacgactgngctgcacatctgtcttcatctcccgcatctnacatactcgtactgagcggctggcaacggcnatagnnnnnnn

SEQ ID NO: 292098 - DNA, 409 bp, Homo sapiens
  misc_feature: GYAE6OF01BY3DL.18.60.F05.1.454.CMB.1.raw
  modified_base (403)..(409): a, c, t, g, unknown or other
  misc_feature (403)..(409): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcaccatctgtcttcatcttcccgcatctgactatactcgtactgagcgggctggcaaggcgcatagnnnnnnn

SEQ ID NO: 292099 - DNA, 425 bp, Homo sapiens
  misc_feature: GYAE6OF01A7FMK.18.60.F05.1.454.CMB.1.raw
  modified_base (259)..(259): a, c, t, g, unknown or other
  misc_feature (259)..(259): n is a, c, g, or t
  modified_base (327)..(327): a, c, t, g, unknown or other
  misc_feature (327)..(327): n is a, c, g, or t
  modified_base (339)..(339): a, c, t, g, unknown or other
  misc_feature (339)..(339): n is a, c, g, or t
  modified_base (394)..(394): a, c, t, g, unknown or other
  misc_feature (394)..(394): n is a, c, g, or t
  modified_base (415)..(425): a, c, t, g, unknown or other
  misc_feature (415)..(425): n is a, c, g, or t
tcagtacgagtatgcacgaccggtgctcgatttagtacgtcatcagggaaaggggctggaatatattgggattacctcttacagtgggaccacccattacaacccgtccctcaaaagtcgactcaccatttccgtggacacgtcgaaaaacgagttctccctggacttgacctctgtgaccgccgcagacacggctgtttattactgtgcgagacgactacctgactccaatccatactttgactattggggccggganccctggtcaccgtctcctcagcctccaccaagggcccatcggtcttccccctgcgccctgctccaggngcacctccgagngcacagcggccctgggctgcctggtcaaggacctacttcccatactcgtactgancgggctggcaaggcgcatagnnnnnnnnnnn

SEQ ID NO: 292100 - DNA, 421 bp, Homo sapiens
  misc_feature: GYAE6OF01ETY5L.18.60.F05.1.454.CMB.1.raw
  modified_base (239)..(239): a, c, t, g, unknown or other
  misc_feature (239)..(239): n is a, c, g, or t
  modified_base (411)..(412): a, c, t, g, unknown or other
  misc_feature (411)..(412): n is a, c, g, or t
  modified_base (414)..(421): a, c, t, g, unknown or other
  misc_feature (414)..(421): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagattttgcagtgtattactgtcagcagtacggtagttcatctccgacgtttcggccaagggaccaaggtggaaatcgaaacgactgtgctgcaccatctgtcttcattcctttccgcctatctagactatacctcgtactgacgtcgggctggcaaggcacatagnngnnnnnnnn

SEQ ID NO: 292101 - DNA, 446 bp, Homo sapiens
  misc_feature: GYAE6OF01BIGWE.18.60.F05.1.454.CMB.1.raw
  modified_base (420)..(420): a, c, t, g, unknown or other
  misc_feature (420)..(420): n is a, c, g, or t
  modified_base (425)..(425): a, c, t, g, unknown or other
  misc_feature (425)..(425): n is a, c, g, or t
  modified_base (427)..(446): a, c, t, g, unknown or other
  misc_feature (427)..(446): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacagggttcaggtggcaggtgggtctgggacaggacttcattctcaccatcagcagactggagcctgaagattttgacagtgtattactgtcagcagtacggtagtcatctccgacggtttcggaccgaagggaccaaggtaggaaaatacgaaaacgactggacgctagcaccatctcgtcttcgactccttcccgctatctacgactactactcgtactgagcggctggctaaggcanatgcngnnnnnnnnnnnnnnnnnnnn

SEQ ID NO: 292102 - DNA, 404 bp, Homo sapiens
  misc_feature: GYAE6OF01E2JUB.18.60.F05.1.454.CMB.1.raw
  modified_base (329)..(329): a, c, t, g, unknown or other
  misc_feature (329)..(329): n is a, c, g, or t
  modified_base (392)..(392): a, c, t, g, unknown or other
  misc_feature (392)..(392): n is a, c, g, or t
  modified_base (398)..(404): a, c, t, g, unknown or other
  misc_feature (398)..(404): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtgaaatcaaacgactgngctgcacatctgtctcatcctcccgcatctgactatctcgtactgacggcggctggcaaggcnagtagnnnnnnn

SEQ ID NO: 292103 - DNA, 496 bp, Homo sapiens
  misc_feature: GYAE6OF01DHW4R.18.60.F05.1.454.CMB.1.raw
  modified_base (464)..(466): a, c, t, g, unknown or other
  misc_feature (464)..(466): n is a, c, g, or t
  modified_base (468)..(468): a, c, t, g, unknown or other
  misc_feature (468)..(468): n is a, c, g, or t
  modified_base (470)..(496): a, c, t, g, unknown or other
  misc_feature (470)..(496): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcaggtgggtctgggacagacttcattctcaccatcaccaactgcaggctagaagatgtggctagtttattactgtacagacaatactatacgttcctcctctacgacgttcggcggaggacaagggtgagatacaaacgtatgtcggctggacacctatctcgtctttacgtacttcccgtcccgtacctacttccgtacgaactacgtttacgtccgttacgtcgggacggtcgggactacgggactaaacgggctacgtaagtgcgacnnngngnnnnnnnnnnnnnnnnnnnnnnnnnnn

SEQ ID NO: 292104 - DNA, 414 bp, Homo sapiens
  misc_feature: GYAE6OF01C7VGE.18.60.F05.1.454.CMB.1.raw
  modified_base (347)..(347): a, c, t, g, unknown or other
  misc_feature (347)..(347): n is a, c, g, or t
  modified_base (397)..(397): a, c, t, g, unknown or other
  misc_feature (397)..(397): n is a, c, g, or t
  modified_base (403)..(414): a, c, t, g, unknown or other
  misc_feature (403)..(414): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctcgacgttcggccaagggaccaaggtggaaatcaaacgaactgtgctgcaccatctgtctnactcttccgctatctagacatactcgtactgacgcgggtctggacaggcncatagnnnnnnnnnnnn

SEQ ID NO: 292105 - DNA, 491 bp, Homo sapiens
  misc_feature: GYAE6OF01COFJ2.18.60.F05.1.454.CMB.1.raw
  modified_base (473)..(491): a, c, t, g, unknown or other
  misc_feature (473)..(491): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcaggtgggtctgggacagacttcattctcaccatcagcagactggagcctgaagtattttgctagtgtattactgtcagcagtacggtagtcatctccgtacgttcggacctaagggaccaaggtaggaaatacaaaacggtaactggtacgacgttgactaacccattcctagttccttactaactttcccgtttcccgacctattcctaggacctacttaccgttacgttacgtacggaacggccgggtctacggaacgaagggccgactaagtacgnnnnnnnnnnnnnnnnnnn

SEQ ID NO: 292106 - DNA, 425 bp, Homo sapiens
  misc_feature: GYAE6OF01DRI7B.18.60.F05.1.454.CMB.1.raw
  modified_base (152)..(152): a, c, t, g, unknown or other
  misc_feature (152)..(152): n is a, c, g, or t
  modified_base (258)..(258): a, c, t, g, unknown or other
  misc_feature (258)..(258): n is a, c, g, or t
  modified_base (419)..(425): a, c, t, g, unknown or other
  misc_feature (419)..(425): n is a, c, g, or t
tcagtacgagtatgcacgaccggtgctcgatttagtacgtcatcagggaaagggctggaatatattgggattacctcttacagtgggaccacccattacaacccgtccctcaaaagtcgactcaccatttccgtggacacgtcgaaaaacgngttctccctggacttgacctctgtgaccgccgcagacacggctgtttattactgtgcgagacgactacctgactccaatccatactttgactattggggccggganccctggtcaccgtctcctcagcctccaccaagggcccatcggtccttcccctggccgcccctgctccaggagccacctccgagagcacagcggccctgggctgcctggtcaaggactacttcccatactcgtactgagcgggctgggcaagggcgcatagnnnnnnn

SEQ ID NO: 292107 - DNA, 407 bp, Homo sapiens
  misc_feature: GYAE6OF01AT6YZ.18.60.F05.1.454.CMB.1.raw
  modified_base (240)..(240): a, c, t, g, unknown or other
  misc_feature (240)..(240): n is a, c, g, or t
  modified_base (350)..(350): a, c, t, g, unknown or other
  misc_feature (350)..(350): n is a, c, g, or t
  modified_base (402)..(407): a, c, t, g, unknown or other
  misc_feature (402)..(407): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcaggtgggtctgggacagacttcattctcaccatcagcagactggancctgaagattttgcagtgtattactgtcagcagtacggtagttcattctccgacgttcggccaagggaccaaggtggaaatcaaacgaactgtggctgcacatctgtctnatccttccgcatctgacatacctcgtactgagcgggctggcaaggcgcatgnnnnnn

SEQ ID NO: 292108 - DNA, 425 bp, Homo sapiens
  misc_feature: GYAE6OF01BUDFU.18.60.F05.1.454.CMB.1.raw
  modified_base (415)..(425): a, c, t, g, unknown or other
  misc_feature (415)..(425): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcaggtgggtctgggacagacttcattctcaccatccagcagactggagcctgaagtattttgcagttgtattactgtcagcagtacggtattcatctccgacgttcggccaagggaccaagggtggaaatcgaaaacgaactgtggctgcaccatctgtcttcattcctcccgctatctagactatacctcgtactggagcgggctgggacaaggcacatgnnnnnnnnnnn

SEQ ID NO: 292109 - DNA, 449 bp, Homo sapiens
  misc_feature: GYAE6OF01EQ9OE.18.60.F05.1.454.CMB.1.raw
  modified_base (421)..(449): a, c, t, g, unknown or other
  misc_feature (421)..(449): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctggggacagacttcattctcaccatcagcagactggagcctgaagattttgcagtgtattactgtcagcagtacggtagttcatctccgacgttcggaccaagggaccaaggtgaaatacaaaacgactgtggctgcacatctgtcttcacttcctcccgctatctgactataccttcgtactggacgcgggctcggacaacgggcgctaatcgatcgnnnnnnnnnnnnnnnnnnnnnnnnnnnnn

SEQ ID NO: 292110 - DNA, 451 bp, Homo sapiens
  misc_feature: GYAE6OF01BWNXE.18.60.F05.1.454.CMB.1.raw
  modified_base (238)..(238): a, c, t, g, unknown or other
  misc_feature (238)..(238): n is a, c, g, or t
  modified_base (246)..(246): a, c, t, g, unknown or other
  misc_feature (246)..(246): n is a, c, g, or t
  modified_base (329)..(329): a, c, t, g, unknown or other
  misc_feature (329)..(329): n is a, c, g, or t
  modified_base (387)..(387): a, c, t, g, unknown or other
  misc_feature (387)..(387): n is a, c, g, or t
  modified_base (407)..(408): a, c, t, g, unknown or other
  misc_feature (407)..(408): n is a, c, g, or t
  modified_base (411)..(416): a, c, t, g, unknown or other
  misc_feature (411)..(416): n is a, c, g, or t
  modified_base (418)..(418): a, c, t, g, unknown or other
  misc_feature (418)..(418): n is a, c, g, or t
  modified_base (426)..(426): a, c, t, g, unknown or other
  misc_feature (426)..(426): n is a, c, g, or t
  modified_base (432)..(434): a, c, t, g, unknown or other
  misc_feature (432)..(434): n is a, c, g, or t
  modified_base (436)..(436): a, c, t, g, unknown or other
  misc_feature (436)..(436): n is a, c, g, or t
  modified_base (438)..(438): a, c, t, g, unknown or other
  misc_feature (438)..(438): n is a, c, g, or t
  modified_base (440)..(444): a, c, t, g, unknown or other
  misc_feature (440)..(444): n is a, c, g, or t
  modified_base (446)..(447): a, c, t, g, unknown or other
  misc_feature (446)..(447): n is a, c, g, or t
  modified_base (449)..(451): a, c, t, g, unknown or other
  misc_feature (449)..(451): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtggtctgggacagacttcattctcaccatcagcagactggancctgaagnttttgcagtgtattactgtcagcagtacggtagttcatcgtccgagttcggccaagggaccaaggtggaaatcaaacgactgnggctgcaccatctgtcttcatcctcccgcatctagacatactcgtactgaggccggtntgggcaaggcacagtagatnntgnnnnnngnactcagcngacgtnnngntngnnnnnanncnnn

SEQ ID NO: 292111 - DNA, 488 bp, Homo sapiens
  misc_feature: GYAE6OF01CWKKU.18.60.F05.1.454.CMB.1.raw
  modified_base (221)..(221): a, c, t, g, unknown or other
  misc_feature (221)..(221): n is a, c, g, or t
  modified_base (468)..(488): a, c, t, g, unknown or other
  misc_feature (468)..(488): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcaggtgggtctgggacagacttcattcncaccatcagcagactggagcctagaagtattttgacttagtttattactgtcagctaggttacggttagttcatctccggtacgttccggaccgaaggggacctaagggtaggaaactacgaaacgtacgtggtacggctgaccacctattcgttacgttcttcacttccctccccgctacttcctagactacttaccgtccgtacgtggacggtcgggtcgtggacgaagggcctacgaagtacgnnnnnnnnnnnnnnnnnnnnn

SEQ ID NO: 292112 - DNA, 503 bp, Homo sapiens
  misc_feature: GYAE6OF01DVEXA.18.60.F05.1.454.CMB.1.raw
  modified_base (492)..(503): a, c, t, g, unknown or other
  misc_feature (492)..(503): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctccaggctcctcatccatggtgcatccaccagggccactggcatcccagacaggttcagtggcagtgggtctgggacagacttcattctcaccatcagcagactggagcctagaagtattttgctagttgttattactgtcagacgtaggttacggttagttcacttccgtaccggtacggttccggaccgaagggaccgtaagggtacggaaactacgaaaacgacgtggtacgctcgaccactacgttcttcgttcctttaccttacccgttttccccgacctacttcgtacgtacttacttacccgttaccgttacgtggacgggtccgggtcgtcggaacgtacggccgactagtcgnnnnnnnnnnnn

SEQ ID NO: 292113 - DNA, 537 bp, Homo sapiens
  misc_feature: GYAE6OF01BID5I.18.60.F05.1.454.CMB.1.raw
  modified_base (499)..(499): a, c, t, g, unknown or other
  misc_feature (499)..(499): n is a, c, g, or t
  modified_base (508)..(537): a, c, t, g, unknown or other
  misc_feature (508)..(537): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcaggtgggtctgggacagacttcattctcacatcagcagactggacgtcctaggaagtagttttgactagtagtattactgtacagtacgaggttacggtagtttacatccgtccggtacggttccggaccgaacgggaaccgaagggtacggtaaaactacgaaaacggtaacgtaggtacggcctagacctaactacttcgtacgttccttacactttccgttccccgtactacttcctagtaactacgttactccgtactcggacgggtcggtacgtcgggacgaacggtcgacgtagtacgntagctgacnnnnnnnnnnnnnnnnnnnnnnnnnnnnnn

SEQ ID NO: 292114 - DNA, 424 bp, Homo sapiens
  misc_feature: GYAE6OF01CHI6V.18.60.F05.1.454.CMB.1.raw
  modified_base (240)..(240): a, c, t, g, unknown or other
  misc_feature (240)..(240): n is a, c, g, or t
  modified_base (339)..(339): a, c, t, g, unknown or other
  misc_feature (339)..(339): n is a, c, g, or t
  modified_base (398)..(398): a, c, t, g, unknown or other
  misc_feature (398)..(398): n is a, c, g, or t
  modified_base (408)..(408): a, c, t, g, unknown or other
  misc_feature (408)..(408): n is a, c, g, or t
  modified_base (413)..(424): a, c, t, g, unknown or other
  misc_feature (413)..(424): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcactctcaccatcagcagcctggacncctgaagtattttgctagtttattactgtacaacacgtggacaacgtggccatccaccgttcggccgaggggacacgacgtggagtaataaacgactgnggtctgcacatctgtctcactcctcccgctatctgactatacctcgtactgacgcggtntggcaggcgnagtgnnnnnnnnnnnn

SEQ ID NO: 292115 - DNA, 447 bp, Homo sapiens
  misc_feature: GYAE6OF01B6ZUW.18.60.F05.1.454.CMB.1.raw
  modified_base (374)..(374): a, c, t, g, unknown or other
  misc_feature (374)..(374): n is a, c, g, or t
  modified_base (433)..(447): a, c, t, g, unknown or other
  misc_feature (433)..(447): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcacatcagcagactggacgcctagaagtattttgctagtgtattactgtcagcgtagtacggtattcactcctccggtacgttcggaccgaagggaccaaggtagaaactacgaaacgtactgcggctgcacatctctctcactcctcccgacntctcgactatacctcgtactggacggtcggcgtacggacgtaagggccgtacagtacgnnnnnnnnnnnnnnn

SEQ ID NO: 292116 - DNA, 420 bp, Homo sapiens
  misc_feature: GYAE6OF01EQGKZ.18.60.F05.1.454.CMB.1.raw
  modified_base (239)..(239): a, c, t, g, unknown or other
  misc_feature (239)..(239): n is a, c, g, or t
  modified_base (364)..(364): a, c, t, g, unknown or other
  misc_feature (364)..(364): n is a, c, g, or t
  modified_base (369)..(369): a, c, t, g, unknown or other
  misc_feature (369)..(369): n is a, c, g, or t
  modified_base (404)..(404): a, c, t, g, unknown or other
  misc_feature (404)..(404): n is a, c, g, or t
  modified_base (409)..(420): a, c, t, g, unknown or other
  misc_feature (409)..(420): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagattttgcagttgtattactgtcagcagttacggtagttcatcgtccgacgttcggccaagggaccaaggtgaaatacgaaacgaactgtaggctgacacatctgtcttcactctcccncatcngacatactcgtagtgacggcggctggcgaaggcgnatagnnnnnnnnnnnn

SEQ ID NO: 292117 - DNA, 425 bp, Homo sapiens
  misc_feature: GYAE6OF01CSGQ5.18.60.F05.1.454.CMB.1.raw
  modified_base (242)..(242): a, c, t, g, unknown or other
  misc_feature (242)..(242): n is a, c, g, or t
  modified_base (359)..(359): a, c, t, g, unknown or other
  misc_feature (359)..(359): n is a, c, g, or t
  modified_base (416)..(425): a, c, t, g, unknown or other
  misc_feature (416)..(425): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcaggtgggtctggggacaggacttcattctcaccatcagcagactggancctgaagattttgctagtgtattactgtcagcagtacggtagttcatctccgacgttcggaccaagggaccaaggtggaaatcaaaacgaactggtcggactgacacatctgtcttnacttctccgctatctgactatactcgtactgacgcggctggacgaaggtcgcatagnnnnnnnnnn

SEQ ID NO: 292118 - DNA, 482 bp, Homo sapiens
  misc_feature: GYAE6OF01BZG70.18.60.F05.1.454.CMB.1.raw
  modified_base (242)..(242): a, c, t, g, unknown or other
  misc_feature (242)..(242): n is a, c, g, or t
  modified_base (350)..(350): a, c, t, g, unknown or other
  misc_feature (350)..(350): n is a, c, g, or t
  modified_base (443)..(443): a, c, t, g, unknown or other
  misc_feature (443)..(443): n is a, c, g, or t
  modified_base (446)..(446): a, c, t, g, unknown or other
  misc_feature (446)..(446): n is a, c, g, or t
  modified_base (454)..(454): a, c, t, g, unknown or other
  misc_feature (454)..(454): n is a, c, g, or t
  modified_base (457)..(482): a, c, t, g, unknown or other
  misc_feature (457)..(482): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggcctcccaggctcctcatccatggtgcatccacagggccactggcatcccagacaggttcagtggcaggtgggtctgggacaggacttcattctcaccatcagcagactggacncctgaagtattttgcagtgtattatgtcagcaggtacggtagtcatctccgtacgttcggaccaaggacctaaggtagaaatacgaaacgtactgtacgactgacacntctgtctcgactccttcccgactatctacgactataccttacgtactggacggcgggtactacgggacaacgggtccgtactaagtagcacgntanacgatcgntannnnnnnnnnnnnnnnnnnnnnnnnn

SEQ ID NO: 292119 - DNA, 426 bp, Homo sapiens
  misc_feature: GYAE6OF01DWMNT.18.60.F05.1.454.CMB.1.raw
  modified_base (332)..(332): a, c, t, g, unknown or other
  misc_feature (332)..(332): n is a, c, g, or t
  modified_base (348)..(348): a, c, t, g, unknown or other
  misc_feature (348)..(348): n is a, c, g, or t
  modified_base (408)..(426): a, c, t, g, unknown or other
  misc_feature (408)..(426): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtggggtctggggacagacttcattctcaccatcagcagactggagcctgaagattttgcagtgtattactgtcagctagtacggtagtctatctccgacgttcggccaagggaccaaggtgaaatcaaacgactgngctgcacatctgtctnactcttcccgctagtctgacattactcgtactgacggcggctaggcagggcgctatacgnnnnnnnnnnnnnnnnnnn

SEQ ID NO: 292120 - DNA, 439 bp, Homo sapiens
  misc_feature: GYAE6OF01BFOF5.18.60.F05.1.454.CMB.1.raw
  modified_base (424)..(439): a, c, t, g, unknown or other
  misc_feature (424)..(439): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggaccaagggaccaaggtggaaatacaaaacgaactgtcggctgacacatctgtcttcactcctcccgcactctcgactactacttcgtactggacggcggtcgtcggacgaaggccgacgtaatgcnnnnnnnnnnnnnnnn

SEQ ID NO: 292121 - DNA, 458 bp, Homo sapiens
  misc_feature: GYAE6OF01CXH9B.18.60.F05.1.454.CMB.1.raw
  modified_base (240)..(240): a, c, t, g, unknown or other
  misc_feature (240)..(240): n is a, c, g, or t
  modified_base (342)..(342): a, c, t, g, unknown or other
  misc_feature (342)..(342): n is a, c, g, or t
  modified_base (432)..(458): a, c, t, g, unknown or other
  misc_feature (432)..(458): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcaggtgggtctgggacagacttcattctcaccatcagcagactggancctagaagtattttgctagttgttattacgtgtcagctagtacggtagtttcatctccgacgttcggaccgaagggacaaggtagaaatcgaaaacgactgngctgacacgtatcgtgtctcactcttacccgctatctactacgtaactactcgtactggagccgggtctacgggacagggctacagtagnnnnnnnnnnnnnnnnnnnnnnnnnnn

SEQ ID NO: 292122 - DNA, 439 bp, Homo sapiens
  misc_feature: GYAE6OF01BOIPE.18.60.F05.1.454.CMB.1.raw
  modified_base (400)..(400): a, c, t, g, unknown or other
  misc_feature (400)..(400): n is a, c, g, or t
  modified_base (422)..(439): a, c, t, g, unknown or other
  misc_feature (422)..(439): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagctgaagtattttgcagtgtattactgtcagctagtacggtagttcattctccgacgttcggacaagggaaccaggtaggaaaatcgaaaacgtactggtggctgactacgattctgtcttcattcctcccgtacagtctagactatacttcgtactgacgnggtctggcaaggtcgcaagtgnnnnnnnnnnnnnnnnnn

SEQ ID NO: 292123 - DNA, 593 bp, Homo sapiens
  misc_feature: GYAE6OF01EFDMR.18.60.F05.1.454.CMB.1.raw
  modified_base (553)..(553): a, c, t, g, unknown or other
  misc_feature (553)..(553): n is a, c, g, or t
  modified_base (559)..(559): a, c, t, g, unknown or other
  misc_feature (559)..(559): n is a, c, g, or t
  modified_base (562)..(562): a, c, t, g, unknown or other
  misc_feature (562)..(562): n is a, c, g, or t
  modified_base (565)..(565): a, c, t, g, unknown or other
  misc_feature (565)..(565): n is a, c, g, or t
  modified_base (567)..(593): a, c, t, g, unknown or other
  misc_feature (567)..(593): n is a, c, g, or t
tcagtacgagtatgcacgaccggtgctcgatttagtacgtcatcagggaaagggccaccctctcttgtagggccagtcagagtgttagcagcaactacttagcctggtaccagcagaccacctggccaggcctcccaggctcctcatccatggtgcactcccgaccgagggcccacgtggcactccccagacaggttcaggtggcaggtgggtcgtgggacagtacttcattctcaccatcagcagacgtggacgcctagaacgtattttgctagtgttattactgtcagctaggttacggtagttcattccgtaccgtacggttaccggaccgaaaggggtacccgtaagggtagaaaaccgtacgaaaacggtacgttagggcggtacgttcgacccgtaacctacgttccgttgttacccgtttactaacgttccccgttaccccgacccttattcccgacgtaacttaaccgttacttccggtaacgttcgggaaccgggtcgggtaccggtacgggaccggtaaacgggtccgaaccgtaaggttacngacgtncgnacngnnnnnnnnnnnnnnnnnnnnnnnnnnn

SEQ ID NO: 292124 - DNA, 418 bp, Homo sapiens
  misc_feature: GYAE6OF01A2F09.18.60.F05.1.454.CMB.1.raw
  modified_base (376)..(376): a, c, t, g, unknown or other
  misc_feature (376)..(376): n is a, c, g, or t
  modified_base (402)..(418): a, c, t, g, unknown or other
  misc_feature (402)..(418): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcaggtggtctgggacagacttcattctcaccatcagcagactggagcctgaagattttgcagttgtattactgtcagcagtacggtagttcattcgtccgacgttcggccaagggaccaaggtgaaatcaaacgatgtgctgcacagtctgtcttcgatctcccgcatctgacatctcgtacngagcggactggacaggcgcagtacgnnnnnnnnnnnnnnnnn

SEQ ID NO: 292125 - DNA, 563 bp, Homo sapiens
  misc_feature: GYAE6OF01A0KIY.18.60.F05.1.454.CMB.1.raw
  modified_base (248)..(248): a, c, t, g, unknown or other
  misc_feature (248)..(248): n is a, c, g, or t
  modified_base (258)..(258): a, c, t, g, unknown or other
  misc_feature (258)..(258): n is a, c, g, or t
  modified_base (529)..(529): a, c, t, g, unknown or other
  misc_feature (529)..(529): n is a, c, g, or t
  modified_base (538)..(563): a, c, t, g, unknown or other
  misc_feature (538)..(563): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggcctcccaggctcctcatccatggtgcatccaccgagggcccactggcactcccagacgtaggttcagtggctaggtgggtctgggacagtacttcattctcaccatcagcagctggacncctagaagtnttttgactagttgttattaccgtgtacacgtacgtaaggttacggttagttacctacgttcccgtacccggtaaccgggttccgggaccggtaaacggggtaaccgtaaggggtaacggaaaactaccggaaaacggttacgtggtcggtactacggaccaaccgtagttcgttacgttcttactaccttcccgttcccgactactctacaacttacttaccgtcgtagtcgcgggtcggcgtaggacgacggcaacgtgtacgctagctnagcagcatnnnnnnnnnnnnnnnnnnnnnnnnnn

SEQ ID NO: 292126 - DNA, 431 bp, Homo sapiens
  misc_feature: GYAE6OF01CPI6M.18.60.F05.1.454.CMB.1.raw
  modified_base (238)..(238): a, c, t, g, unknown or other
  misc_feature (238)..(238): n is a, c, g, or t
  modified_base (384)..(384): a, c, t, g, unknown or other
  misc_feature (384)..(384): n is a, c, g, or t
  modified_base (411)..(411): a, c, t, g, unknown or other
  misc_feature (411)..(411): n is a, c, g, or t
  modified_base (414)..(431): a, c, t, g, unknown or other
  misc_feature (414)..(431): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggctgggacagacttcattctcaccatcagcagactggancctagaaaattttgcagttgtattactgtcagcagtagtagttcatctcgacgttcggccaagggaccaaggttgaaatacgaaacgtaactgtggctgcactactctgtcttcacttccttccgcctatctgacatacctgtacngaggccgggtctaggacaaggcgacanagnnnnnnnnnnnnnnnnnn

SEQ ID NO: 292127 - DNA, 633 bp, Homo sapiens
  misc_feature: GYAE6OF01BZ50C.18.60.F05.1.454.CMB.1.raw
  modified_base (600)..(600): a, c, t, g, unknown or other
  misc_feature (600)..(600): n is a, c, g, or t
  modified_base (602)..(621): a, c, t, g, unknown or other
  misc_feature (602)..(621): n is a, c, g, or t
  modified_base (623)..(633): a, c, t, g, unknown or other
  misc_feature (623)..(633): n is a, c, g, or t
tcagtacgagtatgcacgaccggtgctcgatttagtacgtcatcaggggaaagggcccaccctctcttgtagggccagtcagagtgttagcagcaactacttagcctggtaccagcagacacctggccaggcctcccaggcctcctcactccagtggtgcactcccgaccgagggcccacgtggccactcccagacgtaggttcgagtggcgtagggttgggtccgtgggaactaggtaccttactacttcctaccaaccctatccgaagaccgtaagaaccggtggaacgtccgtaagtaagttagttttacggacttagttttaacttacgtgtaaccaaacgtaaccggtagtaccaacgtcggacccgtaactccgtaaccggttaccggggaccggaaccggggaccgaacggtacgtagggtaaacgtaaacgttaaaaccgaacggtcggtcggtaccacgtacctaaccgtactgttaccgtccttacctaccgttccctacccgacctacgttactacgtactacgttaaccgtacgtacgtacggtcgggcggtacggtacggagacggacgacgagtacccccccccgncnnnnnnnnnnnnnnnnnnnncnnnnnnnnnnn

SEQ ID NO: 292128 - DNA, 544 bp, Homo sapiens
  misc_feature: GYAE6OF01EQJBE.18.60.F05.1.454.CMB.1.raw
  modified_base (153)..(153): a, c, t, g, unknown or other
  misc_feature (153)..(153): n is a, c, g, or t
  modified_base (224)..(224): a, c, t, g, unknown or other
  misc_feature (224)..(224): n is a, c, g, or t
  modified_base (246)..(246): a, c, t, g, unknown or other
  misc_feature (246)..(246): n is a, c, g, or t
  modified_base (511)..(511): a, c, t, g, unknown or other
  misc_feature (511)..(511): n is a, c, g, or t
  modified_base (514)..(514): a, c, t, g, unknown or other
  misc_feature (514)..(514): n is a, c, g, or t
  modified_base (516)..(544): a, c, t, g, unknown or other
  misc_feature (516)..(544): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtncatccaccagggccatggcatcccagacaggttcagtggcaggtgggtctgggacagacttcattctcacntcagcagctggagcctgaagtnttttgactagttgtattactgtcagtctaggttacggttagttaccagttaccgtcccggacggtttccgggtaccggaaacggggtaccctaaagggtacggaaaacgttaccaaaaaccgggtaatcgggtaggactacgacctaacccgtaatcttcgttcttacctactttccctcccgacctattacgtacgtaactacttacccgttactaacgtggtaccggtcgggtacgtggaaccgtacgggccgaacagttagntcntnnnnnnnnnnnnnnnnnnnnnnnnnnnnn

SEQ ID NO: 292129 - DNA, 526 bp, Homo sapiens
  misc_feature: GYAE6OF01BKLT6.18.60.F05.1.454.CMB.1.raw
  modified_base (153)..(153): a, c, t, g, unknown or other
  misc_feature (153)..(153): n is a, c, g, or t
  modified_base (495)..(495): a, c, t, g, unknown or other
  misc_feature (495)..(495): n is a, c, g, or t
  modified_base (500)..(506): a, c, t, g, unknown or other
  misc_feature (500)..(506): n is a, c, g, or t
  modified_base (508)..(526): a, c, t, g, unknown or other
  misc_feature (508)..(526): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtncatcccaccagggccactggcatcccagacaggttcagtggcaggtgggtctgggacagacttcattctcaccatcagcagacgtggagccgtgaagactttttgctagtgtattactgtcagctagttacggtagttcattcctccgtacgttccggaccgtaagggaaccgtaaggtggtaaatacgaaaaccgaactcggtggctgaccaacctattcgttgttctttcctacttccctttcccgacctacttcctcggaactaacttaccgttaccgttacgtacggacgggtaccggggtcgtcgggaaccgaaaggggcccgtacgaagtcggacngtcgnnnnnnngnnnnnnnnnnnnnnnnnnn

SEQ ID NO: 292130 - DNA, 632 bp, Homo sapiens
  misc_feature: GYAE6OF01AS4NR.18.60.F05.1.454.CMB.1.raw
  modified_base (471)..(471): a, c, t, g, unknown or other
  misc_feature (471)..(471): n is a, c, g, or t
  modified_base (574)..(574): a, c, t, g, unknown or other
  misc_feature (574)..(574): n is a, c, g, or t
  modified_base (578)..(578): a, c, t, g, unknown or other
  misc_feature (578)..(578): n is a, c, g, or t
  modified_base (581)..(583): a, c, t, g, unknown or other
  misc_feature (581)..(583): n is a, c, g, or t
  modified_base (592)..(594): a, c, t, g, unknown or other
  misc_feature (592)..(594): n is a, c, g, or t
  modified_base (596)..(596): a, c, t, g, unknown or other
  misc_feature (596)..(596): n is a, c, g, or t
  modified_base (598)..(598): a, c, t, g, unknown or other
  misc_feature (598)..(598): n is a, c, g, or t
  modified_base (600)..(600): a, c, t, g, unknown or other
  misc_feature (600)..(600): n is a, c, g, or t
  modified_base (602)..(602): a, c, t, g, unknown or other
  misc_feature (602)..(602): n is a, c, g, or t
  modified_base (605)..(605): a, c, t, g, unknown or other
  misc_feature (605)..(605): n is a, c, g, or t
  modified_base (613)..(615): a, c, t, g, unknown or other
  misc_feature (613)..(615): n is a, c, g, or t
  modified_base (617)..(617): a, c, t, g, unknown or other
  misc_feature (617)..(617): n is a, c, g, or t
  modified_base (622)..(622): a, c, t, g, unknown or other
  misc_feature (622)..(622): n is a, c, g, or t
  modified_base (624)..(624): a, c, t, g, unknown or other
  misc_feature (624)..(624): n is a, c, g, or t
  modified_base (626)..(628): a, c, t, g, unknown or other
  misc_feature (626)..(628): n is a, c, g, or t
  modified_base (630)..(630): a, c, t, g, unknown or other
  misc_feature (630)..(630): n is a, c, g, or t
tcagtacgagtatgcacgaccggtgctcgatttagtacgtcatcaagggaaagggccaccctactcttgtagggccagtcagagtgttagcagcaaactacttagcctggtaccagcagacacctggccaggctcccaggctccttcgatccatggtgcagtccaccacgggcccacgtggcatcccagacgaggttcagttcggcgaggttgggtctgggacagaccgttacaagttctaccaccatacacgcctaggaccgtggacgcctagaacgatttttcgcgtaggttagttacttacttcgtacgagtacctaaggttaccggttagttacctatccgtaccccgtacggttcccgggtaccctaacggggtaccccgtaagggttaacggaaaatccgtaaaaacgtacgttacggtcggacctacggccctaaaccgtccgttacctcgtttccgtttaacncgttacccgtttccccggacttacgtcgtacggtaacctaccttacgttaccgttactacggacgggtccgtacggttacgacgtaacggcgtactaagtcgngtancgnnncgatcactnnntntntntntcnctcgcgcnnncngagananannngntc

SEQ ID NO: 292131 - DNA, 773 bp, Homo sapiens
  misc_feature: GYAE6OF01CK32J.18.60.F05.1.454.CMB.1.raw
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccagtggtgcactccgaccgacgggccactggcactcccagacaggttcagtggcaggtgggtctgggacagtacttcattcctccaccagtcagccagtaccgtggacgccgtagtaagttagttttcgcgtaaggttgttaacttacgttcggtacaacggtcggtaacggttacggtttacgtacgtaacgttcccgttaccggtaaccggtttaccggaccggtaaacggggtaccgtaaaggggttaaacgtaaaacgtaccggtaaaaaccggtacggtcggtacggtacgtaccgaccgtaacctacgttccgtttacgttcccgttacctaccgtttaccccgttcccggtaacttaccgttacgtacgggttacccttaaccgttacccggttaacggttaaccgttacggggaccggggtacccggggtttaccgtacggggaaccgggtaaaccgggtcccgtaaacgtaacggggttaccgacgtacgcgtacgtacgtacgtacgtacgtacgtacgtacgtacgtacgtacgtacgtacgtacgtacgtacgtacgtacgtacgtacgtacgtacggtacgacgacggtacgtacgtacgtacggcgtcgtacg

SEQ ID NO: 292132 - DNA, 615 bp, Homo sapiens
  misc_feature: GYAE6OF01DX5FM.18.60.F05.1.454.CMB.1.raw
  modified_base (151)..(151): a, c, t, g, unknown or other
  misc_feature (151)..(151): n is a, c, g, or t
  modified_base (288)..(288): a, c, t, g, unknown or other
  misc_feature (288)..(288): n is a, c, g, or t
  modified_base (539)..(539): a, c, t, g, unknown or other
  misc_feature (539)..(539): n is a, c, g, or t
  modified_base (578)..(579): a, c, t, g, unknown or other
  misc_feature (578)..(579): n is a, c, g, or t
  modified_base (583)..(615): a, c, t, g, unknown or other
  misc_feature (583)..(615): n is a, c, g, or t
tcagtacgagtatgcacgaccggtgctcgatttagtacgtcatcagggaagggccaccctctcttgtagggccagtcagagtgttagcagcaactacttagcctggtaccagcagcacctggccaggctcccaggctcctcatccatggtncactcccaaccgagggcccacgtggctactacccgagacagggttcaggtcggcagggtgggtcgtgggaccaggtacttctattcctacaacccgtatccgaggccaggacgtagggacaccgtaggtaaacgttntttcggactaggtttattaacgttacgtcgtacacggtagtaaacgggtttacggttagttacctaacgtttccggtaccgtaccggtttaccgggaaccccggtaaagggtaaaccgtaaagggttacgtaaaaactaacccggaaaacgtaccggtggtacggtactaccggaactaccgtatccgtttacgtcctactccttacccgtcccgacttagtccgaacttactacgtacgttaccgtacgnggtaccgggcgtaacggtcggacgtaacgcggtataggnngagnnnnnnnnnnnnnnnnnnnnnnnnnnnnnnnnn

SEQ ID NO: 292133 - DNA, 618 bp, Homo sapiens
  misc_feature: GYAE6OF01CFLYE.18.60.F05.1.454.CMB.1.raw
  modified_base (227)..(227): a, c, t, g, unknown or other
  misc_feature (227)..(227): n is a, c, g, or t
  modified_base (571)..(571): a, c, t, g, unknown or other
  misc_feature (571)..(571): n is a, c, g, or t
  modified_base (579)..(579): a, c, t, g, unknown or other
  misc_feature (579)..(579): n is a, c, g, or t
  modified_base (582)..(582): a, c, t, g, unknown or other
  misc_feature (582)..(582): n is a, c, g, or t
  modified_base (586)..(586): a, c, t, g, unknown or other
  misc_feature (586)..(586): n is a, c, g, or t
  modified_base (588)..(588): a, c, t, g, unknown or other
  misc_feature (588)..(588): n is a, c, g, or t
  modified_base (591)..(591): a, c, t, g, unknown or other
  misc_feature (591)..(591): n is a, c, g, or t
  modified_base (593)..(593): a, c, t, g, unknown or other
  misc_feature (593)..(593): n is a, c, g, or t
  modified_base (595)..(598): a, c, t, g, unknown or other
  misc_feature (595)..(598): n is a, c, g, or t
  modified_base (600)..(615): a, c, t, g, unknown or other
  misc_feature (600)..(615): n is a, c, g, or t
  modified_base (617)..(618): a, c, t, g, unknown or other
  misc_feature (617)..(618): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcactccaccagggccactggcactcccagacctaggttcaggtggcaggtgggtctgggacagtacttcattcnccaccatcagcaggacgtggacgcctaggtaagtactttttggactaggttgtttaactttacgttgttacaacggtcgtaaggttacgggttactttacctacgttcccgtaccggtaccggtttaccgggacccggtaaacgggaacccgtaaagggtacggaaaactaccgaaaaccggtaacgtgggtacggtcctagacccaacgtacgttccttacgtttccgttactaccctttcccgttaccccgctacttcgtacgtaacttaacttaccgttaccgtacgtcggtacgggtcccgggtacgtacgggtaacgaacgggccaacttaggtagcgngactgacncgngtcncnctncncnnnngnnnnnnnnnnnnnnnngnn

SEQ ID NO: 292134 - DNA, 542 bp, Homo sapiens
  misc_feature: GYAE6OF01CWFOU.18.60.F05.1.454.CMB.1.raw
  modified_base (275)..(275): a, c, t, g, unknown or other
  misc_feature (275)..(275): n is a, c, g, or t
  modified_base (292)..(292): a, c, t, g, unknown or other
  misc_feature (292)..(292): n is a, c, g, or t
  modified_base (513)..(514): a, c, t, g, unknown or other
  misc_feature (513)..(514): n is a, c, g, or t
  modified_base (516)..(542): a, c, t, g, unknown or other
  misc_feature (516)..(542): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggcaggcctcccaggctcctcatccatggtgcactcccaccgagggccacgtggccactcccaagacaggttcaggtgcgaggtgggtctgggacagtacttctattcctacaccatcagtcagacgtggacgtccgtagaagtattttcggntaaggttgttattactntcgagtactaggttacgttagttccacgtccgtccggtacgttccggaaccgaaggggaccgtaaagggtagaaaactaccgaaaacgtacgtggtacgctacgacctacgtacttcgtcgtctcgtacttcccttacccgcttactcgtacgtctaacgttccgtcggtaaccgtgggacgggtccgggtcgtcgggaaccgtaagggcacgaagtcganngnnnnnnnnnnnnnnnnnnnnnnnnnnn

SEQ ID NO: 292135 - DNA, 621 bp, Homo sapiens
  misc_feature: GYAE6OF01AP882.18.60.F05.1.454.CMB.1.raw
  modified_base (585)..(585): a, c, t, g, unknown or other
  misc_feature (585)..(585): n is a, c, g, or t
  modified_base (589)..(589): a, c, t, g, unknown or other
  misc_feature (589)..(589): n is a, c, g, or t
  modified_base (593)..(621): a, c, t, g, unknown or other
  misc_feature (593)..(621): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcaggtgggtctgggacagacttcattcctcaccatcagacagtacgtggacgtccgtaggaatagtttttcgacgtaggttaggtttaactttacgtcgttacgacgacgttaacggttaacgggtttacgtttactaacgttcccgtaccggttaccggtttacccgggaccggtaaacggggaacccgtaaaggggttaacggtaaaactaaccgaaaacgtaacgtcgggtcggtacgtacggaccacgtagttccgttacgttccgttacttaaccgttccccttaccccgtacctacttccgtacgtaaccttacttaaccgttacggtaccgttacgggacgggtcccgggtacgtcgggaccgaaggtccgtacgtaagtagacncgtncgannnnnnnnnnnnnnnnnnnnnnnnnnnnn

SEQ ID NO: 292136 - DNA, 578 bp, Homo sapiens
  misc_feature: GYAE6OF01E2S3W.18.60.F05.1.454.CMB.1.raw
  modified_base (427)..(427): a, c, t, g, unknown or other
  misc_feature (427)..(427): n is a, c, g, or t
  modified_base (534)..(534): a, c, t, g, unknown or other
  misc_feature (534)..(534): n is a, c, g, or t
  modified_base (541)..(541): a, c, t, g, unknown or other
  misc_feature (541)..(541): n is a, c, g, or t
  modified_base (543)..(544): a, c, t, g, unknown or other
  misc_feature (543)..(544): n is a, c, g, or t
  modified_base (546)..(549): a, c, t, g, unknown or other
  misc_feature (546)..(549): n is a, c, g, or t
  modified_base (551)..(552): a, c, t, g, unknown or other
  misc_feature (551)..(552): n is a, c, g, or t
  modified_base (554)..(557): a, c, t, g, unknown or other
  misc_feature (554)..(557): n is a, c, g, or t
  modified_base (561)..(563): a, c, t, g, unknown or other
  misc_feature (561)..(563): n is a, c, g, or t
  modified_base (566)..(566): a, c, t, g, unknown or other
  misc_feature (566)..(566): n is a, c, g, or t
  modified_base (568)..(575): a, c, t, g, unknown or other
  misc_feature (568)..(575): n is a, c, g, or t
  modified_base (577)..(577): a, c, t, g, unknown or other
  misc_feature (577)..(577): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggcctcccaggctcctcatccatggtgcactccacgagggccacgtggcactccccaagacgaggttcaggtggccagggttgggtccgtggggaactagaacgttctacttctaccaccatcgacgcagactggacgccttaggaagtaatttttcggacgtaaggttagttaactttaccgtaggttccgaacgcgtaacggttaccggttagttactacttccgaccggtacggtttccggacaacggggaactagggtagaaactacgaaaaggactgtcgctcgacactagttcngttcctataccgtccgttacccgacgacttactacgacgtaactacccgttacgtagcgggtcgggaggttacggaccgtagggcccaaggtacttggacagtcacngtactcncnncnnnnanncnnnngcgnnngcngnnnnnnnngng

SEQ ID NO: 292137 - DNA, 703 bp, Homo sapiens
  misc_feature: GYAE6OF01EPSDB.18.60.F05.1.454.CMB.1.raw
  modified_base (238)..(238): a, c, t, g, unknown or other
  misc_feature (238)..(238): n is a, c, g, or t
  modified_base (628)..(628): a, c, t, g, unknown or other
  misc_feature (628)..(628): n is a, c, g, or t
  modified_base (630)..(630): a, c, t, g, unknown or other
  misc_feature (630)..(630): n is a, c, g, or t
  modified_base (644)..(644): a, c, t, g, unknown or other
  misc_feature (644)..(644): n is a, c, g, or t
  modified_base (651)..(651): a, c, t, g, unknown or other
  misc_feature (651)..(651): n is a, c, g, or t
  modified_base (658)..(658): a, c, t, g, unknown or other
  misc_feature (658)..(658): n is a, c, g, or t
  modified_base (663)..(663): a, c, t, g, unknown or other
  misc_feature (663)..(663): n is a, c, g, or t
  modified_base (668)..(668): a, c, t, g, unknown or other
  misc_feature (668)..(668): n is a, c, g, or t
  modified_base (677)..(677): a, c, t, g, unknown or other
  misc_feature (677)..(677): n is a, c, g, or t
  modified_base (688)..(688): a, c, t, g, unknown or other
  misc_feature (688)..(688): n is a, c, g, or t
  modified_base (692)..(692): a, c, t, g, unknown or other
  misc_feature (692)..(692): n is a, c, g, or t
  modified_base (695)..(695): a, c, t, g, unknown or other
  misc_feature (695)..(695): n is a, c, g, or t
  modified_base (700)..(702): a, c, t, g, unknown or other
  misc_feature (700)..(702): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggcctcccaggctcctcatccatggtgcatccaccgagggccacgtggcactcccgaagacgaggtttcaggtggctaggtggggtctaggggacagtaccttcactttcncaccgtatccagcaggtacgtgggactcctaggtaactagttttgactagttacggtttaattacgttcgtacacggtacgaaggtttacgggttatttaccgtcgtttaccgttacccggtacgggtttacccggaaccggtaaacggggtaacctaaaggggttaacgaaaacgttaaccgaaaaccggtaacgttcggtacggggtacttacggacctaactacgttcgtttagttaccctttactaaccctttaccccgttccccgtacgttaacgttccgtaaggtaacccttacgtttaacccgttacccggtttacgagggttaccgggtcccggggtcgttaacggggacccggtaacgggtccgtaagtacgttacggacncncgtagacagcgtcngtatacntacgtangtagngactnagacgcgtnactcgacgtanacgnganatacnnng

SEQ ID NO: 292138 - DNA, 579 bp, Homo sapiens
  misc_feature: GYAE6OF01C16LF.18.60.F05.1.454.CMB.1.raw
  modified_base (230)..(230): a, c, t, g, unknown or other
  misc_feature (230)..(230): n is a, c, g, or t
  modified_base (546)..(546): a, c, t, g, unknown or other
  misc_feature (546)..(546): n is a, c, g, or t
  modified_base (548)..(548): a, c, t, g, unknown or other
  misc_feature (548)..(548): n is a, c, g, or t
  modified_base (550)..(550): a, c, t, g, unknown or other
  misc_feature (550)..(550): n is a, c, g, or t
  modified_base (552)..(552): a, c, t, g, unknown or other
  misc_feature (552)..(552): n is a, c, g, or t
  modified_base (554)..(577): a, c, t, g, unknown or other
  misc_feature (554)..(577): n is a, c, g, or t
  modified_base (579)..(579): a, c, t, g, unknown or other
  misc_feature (579)..(579): n is a, c, g, or t
tcagtacgagtatgcacgaccggtgctcgatttagtacgtcatcagggaaagggccaccctctcttgtagggccagtcagagtgttagcgaggcaactacttagcctggtaccagcagacacctggccaggctccaggctcctcactccatggtgcatccaccagggccactggcactcccagacaggttcagtggcaggtcgggtcctggggacagtacgttcattccncacccatccgagcgaagacctgggcgcctgaagtattttgctagtagttattactagtcagtcgtagttacggttattcactccgtaccggtacggttaccggccgtaaaggggacccgaaaggggttacgggaaaacttaccgaaaaccggtacgtcggtacggtacttagggacctaacgacgttcgttacgttccttaccgtaactcccgtttccccgctaacttccgtacgtactacttaccgtaccgtaccgttagggcgggccgggtacgtacggacgtaacggccgtacgaacgtaggcagtgcgtgcngngngngnnnnnnnnnnnnnnnnnnnnnnnngn

SEQ ID NO: 292139 - DNA, 799 bp, Homo sapiens
  misc_feature: GYAE6OF01BWZ89.18.60.F05.1.454.CMB.1.raw
  modified_base (157)..(157): a, c, t, g, unknown or other
  misc_feature (157)..(157): n is a, c, g, or t
  modified_base (720)..(720): a, c, t, g, unknown or other
  misc_feature (720)..(720): n is a, c, g, or t
  modified_base (730)..(730): a, c, t, g, unknown or other
  misc_feature (730)..(730): n is a, c, g, or t
  modified_base (771)..(771): a, c, t, g, unknown or other
  misc_feature (771)..(771): n is a, c, g, or t
tcagtacgagtatgcacgaccggtgctcgatttagtacgtcatcagggaaagggccacccgtctcttgtagggccagtcagagtgttagcagcaactactagcctggtaccagcagacacctggccaggcctccgaggctcctcgatccagtggtcncatccacgagggccacgtggcactcccgagacgtaggttcagtcgcaggtgggtccgtagggacagtaccttcgactttccgccaaccgtactccgagtaccgacggtaccgttgggacgtccgtaggtaacggtacgttttacggcgtaacggttacgttacgtttacgtcggtacgtacggtacgtaacgggttaccgggttacgtttaccgtacgttacccggttaccggtaaccgggtttacccgggaccgtaaacggggtaacccgtaaacggggttaacgggtaaaaccttaccggaaaaaccggtaacggtttcggtaccgggtaccgtacggtaaacccgtaccgtaacgttcccgtaccggtttaccgttacccgtacgttaccccgttaccccgtaccgttaacgttacccgtacggtaaccttacggttaacccgttaccggtaacgtacgggtaccggggtacccggtacgggttaccgaacggtaaccgggtccgtaacggtaacgttacggcgtacacggtactacgtacgtagtacgacgtccggtancgtcgtacgngtacgagtccgaagccggtacaggttacgacgtcgtaccgngtcgtacgcctaaggtcgagcggttacg

SEQ ID NO: 292140 - DNA, 737 bp, Homo sapiens
  misc_feature: GYAE6OF01DGHUE.18.60.F05.1.454.CMB.1.raw
  modified_base (157)..(157): a, c, t, g, unknown or other
  misc_feature (157)..(157): n is a, c, g, or t
  modified_base (605)..(605): a, c, t, g, unknown or other
  misc_feature (605)..(605): n is a, c, g, or t
  modified_base (695)..(695): a, c, t, g, unknown or other
  misc_feature (695)..(695): n is a, c, g, or t
  modified_base (697)..(697): a, c, t, g, unknown or other
  misc_feature (697)..(697): n is a, c, g, or t
  modified_base (703)..(705): a, c, t, g, unknown or other
  misc_feature (703)..(705): n is a, c, g, or t
  modified_base (707)..(707): a, c, t, g, unknown or other
  misc_feature (707)..(707): n is a, c, g, or t
  modified_base (709)..(709): a, c, t, g, unknown or other
  misc_feature (709)..(709): n is a, c, g, or t
  modified_base (714)..(720): a, c, t, g, unknown or other
  misc_feature (714)..(720): n is a, c, g, or t
  modified_base (723)..(726): a, c, t, g, unknown or other
  misc_feature (723)..(726): n is a, c, g, or t
  modified_base (728)..(734): a, c, t, g, unknown or other
  misc_feature (728)..(734): n is a, c, g, or t
  modified_base (736)..(737): a, c, t, g, unknown or other
  misc_feature (736)..(737): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggcctcctcatccagtgggtcncactacccaccgacggggacccacgttggaccacgttccccgaaggtaaccgtacgggtttacgagggttcggccgtaagggttcggggtaccgttacggggaactaacgggtacctttaccgtactttcctaccaaccctaagttccgaacgaccgaaggtaaccgtcggacgtcccgtaaggtaaagttagtttttcgacgttaggttacgtttaactttcgttaggtaccaaggtaccgtaacggttttaacgggttacgtttaccgtaccgtttcccggtaccccggtttaccgggttaccgggaacccggtaaacggggtaaccggttaagggtaacggtaaaaaccgttaccggaaaaaccggtaacgtttagggtcggtaccgtacgtaaccgaaccgttacgttccgtttcgtccttaccgttacccttcccgttacccncttacgttacgtacgaaccttacgttaacccttaccgtaacgtcggacgggttcggtacgtaacgggtcgaaccggacgactagtacgcncngactcnnnancntcagnnnnnnncgnnnncnnnnnnngnn

SEQ ID NO: 292141 - DNA, 700 bp, Homo sapiens
  misc_feature: GYAE6OF01CVJ2G.18.60.F05.1.454.CMB.1.raw
  modified_base (132)..(132): a, c, t, g, unknown or other
  misc_feature (132)..(132): n is a, c, g, or t
  modified_base (152)..(152): a, c, t, g, unknown or other
  misc_feature (152)..(152): n is a, c, g, or t
  modified_base (584)..(584): a, c, t, g, unknown or other
  misc_feature (584)..(584): n is a, c, g, or t
  modified_base (617)..(617): a, c, t, g, unknown or other
  misc_feature (617)..(617): n is a, c, g, or t
  modified_base (624)..(624): a, c, t, g, unknown or other
  misc_feature (624)..(624): n is a, c, g, or t
  modified_base (627)..(627): a, c, t, g, unknown or other
  misc_feature (627)..(627): n is a, c, g, or t
  modified_base (631)..(631): a, c, t, g, unknown or other
  misc_feature (631)..(631): n is a, c, g, or t
  modified_base (635)..(635): a, c, t, g, unknown or other
  misc_feature (635)..(635): n is a, c, g, or t
  modified_base (638)..(638): a, c, t, g, unknown or other
  misc_feature (638)..(638): n is a, c, g, or t
  modified_base (643)..(644): a, c, t, g, unknown or other
  misc_feature (643)..(644): n is a, c, g, or t
  modified_base (660)..(660): a, c, t, g, unknown or other
  misc_feature (660)..(660): n is a, c, g, or t
  modified_base (697)..(697): a, c, t, g, unknown or other
  misc_feature (697)..(697): n is a, c, g, or t
tcagtacgagtatgcacgaccggtgctcgatttagtacgtcatcagggaaaggggctggaatatattgggattacctcttacagtggaccaccattacacccgtcctacaaaagtcgactcaccatttccgnggacacgtacgaaaaaacgngttcctcccgtggacttgacctctagtcgaccgcgtcagacacggtctagtttactacgtgtcgacgtagccactcctcgacctcaaactcctaattacgttagacttaggttcgggggccgggtactccgtggcctaccgttcacgtcgacgtaccctaccaccggaaggtcccgtagttcccggttcccttaccccgtcggtccgtcccgtacgcccacggtaacggccgtccaacccgtccggagaacccgtcaaccggacggtcccgggtaccccgttggaccgttcgcccgtttacgggacgaaaccgttcctttaaccccgaaccttcggtaacccgttacgtacggacggtaccggggtaccggggttactaaacggggtaaccggtaaccggtcgaacccggttaagttacgaacgcggttacnccgaagttcgagtccgaaagcttaggcttccgntacgtcncgnacgnactnacnctgcnnctacgacgtcgacgcncacgtcgtagcgcgtactacacgtcgtacacgacgcngtc

SEQ ID NO: 292142 - DNA, 682 bp, Homo sapiens
  misc_feature: GYAE6OF01EZUQM.18.60.F05.1.454.CMB.1.raw
  modified_base (616)..(616): a, c, t, g, unknown or other
  misc_feature (616)..(616): n is a, c, g, or t
  modified_base (677)..(677): a, c, t, g, unknown or other
  misc_feature (677)..(677): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcagtccagtggtgcaagtcccaaccgaggggcccaacgtggcactccccaagacgtagggttcaggtcggcaggttggggtcctgggacagacttcgattctcgaccattccagcacgacgttggacgtccgtagaacgttagttttgacgtaggttagtactttaacgtcgtacacggacgtaacgttacgggtagttctacgttccgtaccggtaccggttaccggaccgtaaccgggaacgtaagggtacggtaaactacgaaaaccgtacgtcggtacggacgtacgtacctaaccggtattccggttacgtttaccctttacgaaccgttttccccgtaccccgtaccgtacttccggtacgtaaccgtacgttaccgttccgtacgttagggaccggtcgggtcacggggtacgtaaccgggcgtaactaacggcgtactcggaacttcggaagtcctaggactccgngtactcgtagactacgtcaggtcagactcgcgagacgtcgacgtacgtcgtacgagatcgngtgcg

SEQ ID NO: 292143 - DNA, 497 bp, Homo sapiens
  misc_feature: GYAE6OF01CIVTQ.18.60.F05.1.454.CMB.1.raw
  modified_base (154)..(154): a, c, t, g, unknown or other
  misc_feature (154)..(154): n is a, c, g, or t
  modified_base (223)..(223): a, c, t, g, unknown or other
  misc_feature (223)..(223): n is a, c, g, or t
  modified_base (279)..(279): a, c, t, g, unknown or other
  misc_feature (279)..(279): n is a, c, g, or t
  modified_base (341)..(341): a, c, t, g, unknown or other
  misc_feature (341)..(341): n is a, c, g, or t
  modified_base (451)..(452): a, c, t, g, unknown or other
  misc_feature (451)..(452): n is a, c, g, or t
  modified_base (454)..(455): a, c, t, g, unknown or other
  misc_feature (454)..(455): n is a, c, g, or t
  modified_base (457)..(497): a, c, t, g, unknown or other
  misc_feature (457)..(497): n is a, c, g, or t
tcagtacgagtatgcacgaccggtgctcgatttagtacgtcatcagggaaaggggctggaatatattgggattacctcttacagtgggaccacccattacaacccgtccctcaaaagtcgactcaccatttccgtggacacggtcgaaaaacgngttctccctggacttgaccctctgtgaccgccgcagacacagctgttatactgtgcgagacgactaccngactcaatccatactttgactagttgggggcgggagccctgggtcaccgtctcctnagcctccaccaagggcccaatcggtccttcccctggcgccctgctccgagagcacctcgagngcacgacgcgccctgggctggcccgtggtcaaacggcctacgtccccattaccgtacgtacctggacggaccggggcttgggacaaacggggcgccgtaagtaacggcanncnnannnnnnnnnnnnnnnnnnnnnnnnnnnnnnnnnnnnnnnnn

SEQ ID NO: 292144 - DNA, 413 bp, Homo sapiens
  misc_feature: GYAE6OF02GW2EE.18.60.F05.1.454.CMB.1.raw
  modified_base (395)..(395): a, c, t, g, unknown or other
  misc_feature (395)..(395): n is a, c, g, or t
  modified_base (401)..(413): a, c, t, g, unknown or other
  misc_feature (401)..(413): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcaacagtgtgctgaggtacctctcacgttcggcggagggaccaggggtggacatcaagcgaactgtggctgcaccatctgtcttcatcttccgcatctgacatactgtactgagcgggctggcaaggcncatagnnnnnnnnnnnnn

SEQ ID NO: 292145 - DNA, 405 bp, Homo sapiens
  misc_feature: GYAE6OF02FWF20.18.60.F05.1.454.CMB.1.raw
  modified_base (395)..(395): a, c, t, g, unknown or other
  misc_feature (395)..(395): n is a, c, g, or t
  modified_base (401)..(405): a, c, t, g, unknown or other
  misc_feature (401)..(405): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccgggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctcgacgttcggccaagggaccaaggtggaaatcaaacgaactgtggctgcaccatctgtcttcatcttcccgcatctgacatactcgtactgagcgggctggcaaggcncatagnnnnn

SEQ ID NO: 292146 - DNA, 409 bp, Homo sapiens
  misc_feature: GYAE6OF02IU7E7.18.60.F05.1.454.CMB.1.raw
  modified_base (268)..(268): a, c, t, g, unknown or other
  misc_feature (268)..(268): n is a, c, g, or t
  modified_base (405)..(409): a, c, t, g, unknown or other
  misc_feature (405)..(409): n is a, c, g, or t
tcagtacgagtatgcacgaccggtgctcgatttagtacgtcatcagggaaaggggccacccgtctcttgtagggtccagtcagagtgttacgcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattacngtcagcagtacgtagttcatctccgacgttcggccaagggaccaaggtggaaatcaaacgaactgtggctgcaccatctgtcttcatcttcccgcatctgacatacctgtactgagcgggctggcaaggcgcatagnnnnn

SEQ ID NO: 292147 - DNA, 404 bp, Homo sapiens
  misc_feature: GYAE6OF02HICI1.18.60.F05.1.454.CMB.1.raw
  modified_base (399)..(404): a, c, t, g, unknown or other
  misc_feature (399)..(404): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcacatctgtctcatcttccgcatctgacatactcgtactgagcgggctggcaaggcgcatagnnnnnn

SEQ ID NO: 292148 - DNA, 407 bp, Homo sapiens
  misc_feature: GYAE6OF02IMB0W.18.60.F05.1.454.CMB.1.raw
  modified_base (402)..(407): a, c, t, g, unknown or other
  misc_feature (402)..(407): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggccaaggtggaaatcaaacgaactgtggctgcaccatctgtcttcatcttcccgccatctgacatactcgtactgagcgggctggcaaggcgcatagnnnnnn

SEQ ID NO: 292149 - DNA, 406 bp, Homo sapiens
  misc_feature: GYAE6OF02GPBNU.18.60.F05.1.454.CMB.1.raw
  modified_base (394)..(394): a, c, t, g, unknown or other
  misc_feature (394)..(394): n is a, c, g, or t
  modified_base (400)..(406): a, c, t, g, unknown or other
  misc_feature (400)..(406): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggccaaggtggaaatcaaacgaactgtggctgcaccatctgtcttcatcttcccgcatctgacatactcgtactgagcggctggcaaggcncatagnnnnnnn

SEQ ID NO: 292150 - DNA, 410 bp, Homo sapiens
  misc_feature: GYAE6OF02I1CP1.18.60.F05.1.454.CMB.1.raw
  modified_base (402)..(410): a, c, t, g, unknown or other
  misc_feature (402)..(410): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcacatctgtcttcatcttcccgcatctgacatactcgtactgagcgggctggctaaggcgcatagnnnnnnnnn

SEQ ID NO: 292151 - DNA, 408 bp, Homo sapiens
  misc_feature: GYAE6OF02GGJZD.18.60.F05.1.454.CMB.1.raw
  modified_base (401)..(408): a, c, t, g, unknown or other
  misc_feature (401)..(408): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggccaaggtggaaatcaaacgaactgtggctgcaccatctgtcttcatcttccgccatctgacatactcgtactgagcgggctggcaaggcgcatagnnnnnnnn

SEQ ID NO: 292152 - DNA, 409 bp, Homo sapiens
  misc_feature: GYAE6OF02IQFLW.18.60.F05.1.454.CMB.1.raw
  modified_base (404)..(409): a, c, t, g, unknown or other
  misc_feature (404)..(409): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtatttcatctccgacgttcggccaagggaccaaggtggaaatcaaaacgaactgtggctgcaccatctgtcttcatcttcccgccatctgacatactcgtactgagcgggctggcaaggcgcatagnnnnnn

SEQ ID NO: 292153 - DNA, 406 bp, Homo sapiens
  misc_feature: GYAE6OF02H4L9W.18.60.F05.1.454.CMB.1.raw
  modified_base (399)..(406): a, c, t, g, unknown or other
  misc_feature (399)..(406): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggccaaggtggaaatcaaacgactgtggctgcaccatctgtcttcatcttccgcatctgacatactcgtactgagcgggctggcaaggcgcatagnnnnnnnn

SEQ ID NO: 292154 - DNA, 409 bp, Homo sapiens
  misc_feature: GYAE6OF02GJRWH.18.60.F05.1.454.CMB.1.raw
  modified_base (403)..(409): a, c, t, g, unknown or other
  misc_feature (403)..(409): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcaccatctgtcttcatcttcccgccatctgacatactcgtactgagcgggctggcaaggcgcatagnnnnnnn

SEQ ID NO: 292155 - DNA, 409 bp, Homo sapiens
  misc_feature: GYAE6OF02HPTF5.18.60.F05.1.454.CMB.1.raw
  modified_base (405)..(409): a, c, t, g, unknown or other
  misc_feature (405)..(409): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaagggtggaaaatcaaaacgaactgtggctgcaccatctgtcttcatcttcccgccatctgacaactcgtactgagcgggctggcaaggcgcatagnnnnn

SEQ ID NO: 292156 - DNA, 406 bp, Homo sapiens
  misc_feature: GYAE6OF02IIYKH.18.60.F05.1.454.CMB.1.raw
  modified_base (402)..(406): a, c, t, g, unknown or other
  misc_feature (402)..(406): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtgttcatctccgacgttcggccaagggaccaaggtggaaatcaaacgaactgtggctgcaccatctgtcttcatcttcccgcatctcgacatactcgtactgagcgggctggcaaggcgcatagnnnnn

SEQ ID NO: 292157 - DNA, 443 bp, Homo sapiens
  misc_feature: GYAE6OF02GH4C0.18.60.F05.1.454.CMB.1.raw
  modified_base (360)..(360): a, c, t, g, unknown or other
  misc_feature (360)..(360): n is a, c, g, or t
  modified_base (415)..(443): a, c, t, g, unknown or other
  misc_feature (415)..(443): n is a, c, g, or t
tcagtacgagtatgcacgaccggtgctcgatttagtacgtcatcagggaaaggggccaccctcgtcttgtagggccagtcagagtgttaggcagcaactacttagcctggtacccagcagacaccctggccaggctcccaggctcctcatccatggtgcatccaccagggccactggcatcccagacagggttcacgtggcagtgggtctgggacagacttcattctcaccatcagccaagactggagcctgaagattttgcagtgtattactgtcagcagtacggtagttcatctccgacgttcggccaagggaccaaggtggaaatcaaacgaactgtaggctgcaccatctgtcttnatcttcccgcatctgactatactcgtactgacgcgggctgggacaggcgcatagnnnnnnnnnnnnnnnnnnnnnnnnnnnnn

SEQ ID NO: 292158 - DNA, 409 bp, Homo sapiens; identical to SEQ ID NO: 292154
  misc_feature: GYAE6OF02FUNZS.18.60.F05.1.454.CMB.1.raw
  modified_base (403)..(409): a, c, t, g, unknown or other
  misc_feature (403)..(409): n is a, c, g, or t

SEQ ID NO: 292159 - DNA, 409 bp, Homo sapiens; identical to SEQ ID NO: 292077
  misc_feature: GYAE6OF02GVHGJ.18.60.F05.1.454.CMB.1.raw
  modified_base (402)..(409): a, c, t, g, unknown or other
  misc_feature (402)..(409): n is a, c, g, or t

SEQ ID NO: 292160 - DNA, 419 bp, Homo sapiens
  misc_feature: GYAE6OF02HZR4I.18.60.F05.1.454.CMB.1.raw
  modified_base (319)..(319): a, c, t, g, unknown or other
  misc_feature (319)..(319): n is a, c, g, or t
  modified_base (327)..(327): a, c, t, g, unknown or other
  misc_feature (327)..(327): n is a, c, g, or t
  modified_base (403)..(403): a, c, t, g, unknown or other
  misc_feature (403)..(403): n is a, c, g, or t
  modified_base (405)..(419): a, c, t, g, unknown or other
  misc_feature (405)..(419): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctccaggctcctcatccatggtgcatccaccagggccactggcatcccagacaggttcagtggcagtgggtctgggacagacttcattctcaccatcagcagactggagcctgaagattttgcagtgtattactgtcagcagtacgtagttcatctccgacgtttcggccaagggaccaaggtggaaatnaaacgacngtgctgcacatctgtcttcatcttcccgccatctgacatactcgtactgagcggctggcaacgggcgacagtacgncnnnnnnnnnnnnnnn

SEQ ID NO: 292161 - DNA, 409 bp, Homo sapiens
  misc_feature: GYAE6OF02FTL9E.18.60.F05.1.454.CMB.1.raw
  modified_base (395)..(395): a, c, t, g, unknown or other
  misc_feature (395)..(395): n is a, c, g, or t
  modified_base (400)..(409): a, c, t, g, unknown or other
  misc_feature (400)..(409): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaagaactgtggctgcacatctgtcttcatcttcccgcatctgactatactcgtactgagcgggctggcaaggcnatagnnnnnnnnnn

SEQ ID NO: 292162 - DNA, 428 bp, Homo sapiens
  misc_feature: GYAE6OF02ITNCY.18.60.F05.1.454.CMB.1.raw
  modified_base (412)..(428): a, c, t, g, unknown or other
  misc_feature (412)..(428): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagatttgcagtgtattactgtcagcagtacgtagttcatctccgacgttcggcctaagggaccaaggtgggaaatacgaaaacgaactgtaggctgacaccagtctgtcttcattctcccgcatctgacattactcgtaactgagtcggctaggcaaggctcatacgnnnnnnnnnnnnnnnnn

SEQ ID NO: 292163 - DNA, 451 bp, Homo sapiens
  misc_feature: GYAE6OF02FZJVI.18.60.F05.1.454.CMB.1.raw
  modified_base (244)..(244): a, c, t, g, unknown or other
  misc_feature (244)..(244): n is a, c, g, or t
  modified_base (251)..(251): a, c, t, g, unknown or other
  misc_feature (251)..(251): n is a, c, g, or t
  modified_base (415)..(416): a, c, t, g, unknown or other
  misc_feature (415)..(416): n is a, c, g, or t
  modified_base (420)..(420): a, c, t, g, unknown or other
  misc_feature (420)..(420): n is a, c, g, or t
  modified_base (422)..(425): a, c, t, g, unknown or other
  misc_feature (422)..(425): n is a, c, g, or t
  modified_base (427)..(451): a, c, t, g, unknown or other
  misc_feature (427)..(451): n is a, c, g, or t
tcagtacgagtatgcacgaccggtgctcgatttagtacgtcatcagggaaagggccaccctcgtcttgtagggccagtccaggagtgttagcagcaactacttagcctggtaccagcacgacacctggccaggctcccaggctcctcatccatggtgcatccaccagggccactggcatcccagacaggttcagtggcagtgggtctgggacagacttcattctcaccatcagcagactggacncctgaanattttgcagtgtattactgtcagcagtacgtagttcatctccgacgttcggccaaggaccaaggtgaatcaaagaactgtgactgcacatctagtcttcattcttcccgcctatctacgactatactcgtactgacgcggtctggccaaggccgacactacgannacgncnnnntnnnnnnnnnnnnnnnnnnnnnnnnn

SEQ ID NO: 292164 - DNA, 406 bp, Homo sapiens
  misc_feature: GYAE6OF02G0UE7.18.60.F05.1.454.CMB.1.raw
  modified_base (403)..(406): a, c, t, g, unknown or other
  misc_feature (403)..(406): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcaccatctgtcttcatcttcccgccatctgacatactcgtactgagcgggctggcaaggcgcatagnnnn

SEQ ID NO: 292165 - DNA, 415 bp, Homo sapiens
  misc_feature: GYAE6OF02FG7EB.18.60.F05.1.454.CMB.1.raw
  modified_base (239)..(239): a, c, t, g, unknown or other
  misc_feature (239)..(239): n is a, c, g, or t
  modified_base (400)..(401): a, c, t, g, unknown or other
  misc_feature (400)..(401): n is a, c, g, or t
  modified_base (403)..(415): a, c, t, g, unknown or other
  misc_feature (403)..(415): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagattttgcagtgtattactgtcagcagtacggtagttcatctccgacgttcggccaagggccaaggtgaaatcaaacgatgtggctgcacatctgtcttcatcttcccgcctatctagacatactcgtactgagcgggctggcaaggcgcatagnngnnnnnnnnnnnnn

SEQ ID NO: 292166 - DNA, 420 bp, Homo sapiens
  misc_feature: GYAE6OF02G7BVV.18.60.F05.1.454.CMB.1.raw
  modified_base (414)..(420): a, c, t, g, unknown or other
  misc_feature (414)..(420): n is a, c, g, or t
tcagtacgagtatgcacgaccggtgctcgatttagtacgtcatcagggaaaggggctggaatatattgggattacctcttacagtgggaccacccattacaacccgtccctcaaaagtcgactcaccatttccgtggacacgtcgaaaaacgagttctccctggacttgacctctgtgaccgccgcagacacggctgtttattactgtgcgagacgactacctgactccaatccatactttgactattggggccgggagccctggtcaccgtctcctcagcctccaccaagggcccatcggtcttccccctggcgccctgctccaggagcacctccgagagcacagcggcctgggctgcctggtcaaggactacttcccatactcgtactgagcgggctggcaaggcgcatagnnnnnnn

SEQ ID NO: 292167 - DNA, 410 bp, Homo sapiens
  misc_feature: GYAE6OF02FR7S0.18.60.F05.1.454.CMB.1.raw
  modified_base (401)..(410): a, c, t, g, unknown or other
  misc_feature (401)..(410): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggccaaggtggaaatcaaacgaactgtggctgcaccatctgtcttcatcttccgccatctgacatactcgtactgagcgggctggcaaggcgcatagnnnnnnnnnn

SEQ ID NO: 292168 - DNA, 402 bp, Homo sapiens
  misc_feature: GYAE6OF02IOQ8T.18.60.F05.1.454.CMB.1.raw
  modified_base (390)..(390): a, c, t, g, unknown or other
  misc_feature (390)..(390): n is a, c, g, or t
  modified_base (395)..(402): a, c, t, g, unknown or other
  misc_feature (395)..(402): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtgaatcaaacgaatgtggctgcacatctgtcttcatcttcccgcatctgacatactcgtactgagcggctggcaggcncatgnnnnnnnn

SEQ ID NO: 292169 - DNA, 408 bp, Homo sapiens
  misc_feature: GYAE6OF02HNGTR.18.60.F05.1.454.CMB.1.raw
  modified_base (398)..(398): a, c, t, g, unknown or other
  misc_feature (398)..(398): n is a, c, g, or t
  modified_base (403)..(408): a, c, t, g, unknown or other
  misc_feature (403)..(408): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgactgtggctgcacatctgtcttcatccttcccgctatctgacatacctcgtactgagcgggctggcaaggcgnatagnnnnnn

SEQ ID NO: 292170 - DNA, 410 bp, Homo sapiens
  misc_feature: GYAE6OF02I2TB4.18.60.F05.1.454.CMB.1.raw
  modified_base (395)..(395): a, c, t, g, unknown or other
  misc_feature (395)..(395): n is a, c, g, or t
  modified_base (401)..(410): a, c, t, g, unknown or other
  misc_feature (401)..(410): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtgaaatcaaacgaactgtaggctgcaccatctgtcttcatctcccgcatctgacatactcgtactgagcgggctggcaaggcncatagnnnnnnnnnn

SEQ ID NO: 292171 - DNA, 433 bp, Homo sapiens
  misc_feature: GYAE6OF02JYWP6.18.60.F05.1.454.CMB.1.raw
  modified_base (417)..(433): a, c, t, g, unknown or other
  misc_feature (417)..(433): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtttattactgtcaacaacgtggcaactggccgatcaccttcggccaggggacacgactggagattaaacgaactgtggctgcacatctagtcttcgatcctttcccgctatacctgaccattctcgtactggtagcgggtactgggacaaggcgcgatacgnnnnnnnnnnnnnnnnn

SEQ ID NO: 292172 - DNA, 408 bp, Homo sapiens
  misc_feature: GYAE6OF02GHLWI.18.60.F05.1.454.CMB.1.raw
  modified_base (396)..(396): a, c, t, g, unknown or other
  misc_feature (396)..(396): n is a, c, g, or t
  modified_base (401)..(408): a, c, t, g, unknown or other
  misc_feature (401)..(408): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaagggtggaaatcaaacgaactgtggctgcaccatctgtcttcatcttcccgcatctgacatactcgtactgagcgggctggcaggcnatagnnnnnnnn

SEQ ID NO: 292173 - DNA, 506 bp, Homo sapiens
  misc_feature: GYAE6OF02IVDF9.18.60.F05.1.454.CMB.1.raw
  modified_base (467)..(467): a, c, t, g, unknown or other
  misc_feature (467)..(467): n is a, c, g, or t
  modified_base (472)..(472): a, c, t, g, unknown or other
  misc_feature (472)..(472): n is a, c, g, or t
  modified_base (475)..(479): a, c, t, g, unknown or other
  misc_feature (475)..(479): n is a, c, g, or t
  modified_base (481)..(481): a, c, t, g, unknown or other
  misc_feature (481)..(481): n is a, c, g, or t
  modified_base (483)..(491): a, c, t, g, unknown or other
  misc_feature (483)..(491): n is a, c, g, or t
  modified_base (493)..(506): a, c, t, g, unknown or other
  misc_feature (493)..(506): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctccaggctcctcatccatggtgcatccaccagggccactggcatcccagacaggttcagtggcagtgggtctgggacagacttcattctcaccatcagcagactggagcctgaagattttgcaacttactaattgtcagcaggcgtacactaactttcccgctcgtactttcgggacgggacggaccgaaggtggaagtactaacgaaacgtaactggtacggctcgacacctatactcgttacttactacttccttcccgactactctacgactaactaacgttaccgtacgtagacggcgggtcgtaggaaccgaacggccgactaacgttacgntcganacnnnnnanannnnnnnnnannnnnnnnnnnnnn

SEQ ID NO: 292174 - DNA, 617 bp, Homo sapiens
  misc_feature: GYAE6OF02JKELV.18.60.F05.1.454.CMB.1.raw
  modified_base (588)..(617): a, c, t, g, unknown or other
  misc_feature (588)..(617): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccaggggccacgtggcatccccagacaggttcagtggcaggtgggtctgggacagacttcatttctcaccatccagcagactggagccgtgaacgtatttttggacctaggtagttactttaactggttcaaggcctaagtttaaccggggttagtttaccgtattccgttacccggtacggtttccgggacccggtaaacggggaacctaaacggggttggtaaaaacgtaccgaaaaacggtaccgttaggtacggggtacctaggacctaacccctagttaccgtttggtaccttttaccggtacttccccttttaacccccggacccgttaactcccttagggtaacctaacctttaccgtacccgtttacgtaggtaccggtcggggtaccttggggactaaccggggcgaccgtaaatggtcnnnnnnnnnnnnnnnnnnnnnnnnnnnnnn

SEQ ID NO: 292175 - DNA, 408 bp, Homo sapiens
  misc_feature: GYAE6OF02G9JHG.18.60.F05.1.454.CMB.1.raw
  modified_base (239)..(239): a, c, t, g, unknown or other
  misc_feature (239)..(239): n is a, c, g, or t
  modified_base (334)..(334): a, c, t, g, unknown or other
  misc_feature (334)..(334): n is a, c, g, or t
  modified_base (400)..(400): a, c, t, g, unknown or other
  misc_feature (400)..(400): n is a, c, g, or t
  modified_base (405)..(408): a, c, t, g, unknown or other
  misc_feature (405)..(408): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagattttgcagtgtattactgtcagcagtacggtagttcatctccgacgttcggccaagggaccaaggtggaaatcaaacgaactgtggntcgcaccatctgtcttcattccttcccgccatctgacatactcgtactgagcggctggcaaggcgnatagnnnn

SEQ ID NO: 292176 - DNA, 488 bp, Homo sapiens
  misc_feature: GYAE6OF02JAM9G.18.60.F05.1.454.CMB.1.raw
  modified_base (434)..(434): a, c, t, g, unknown or other
  misc_feature (434)..(434): n is a, c, g, or t
  modified_base (455)..(455): a, c, t, g, unknown or other
  misc_feature (455)..(455): n is a, c, g, or t
  modified_base (464)..(464): a, c, t, g, unknown or other
  misc_feature (464)..(464): n is a, c, g, or t
  modified_base (470)..(488): a, c, t, g, unknown or other
  misc_feature (470)..(488): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattcctcacccatcagctaagcgtggacgcctagaagtattttgctagtgtattactgtcagcgaagtaggttatcattcctccggtacggttccggaccgaacgggaaccgaagggtaggaaaataccgaaaacgaactggtcggtctagccaaccgtattcttcgtactttcactttccctcccgcctatacctcgacctactaccgttcgttaccngggtacgccgggtctcggganaacgggcanagtagnnnnnnnnnnnnnnnnnnn

SEQ ID NO: 292177 - DNA, 473 bp, Homo sapiens
  misc_feature: GYAE6OF02IGIM0.18.60.F05.1.454.CMB.1.raw
  modified_base (153)..(153): a, c, t, g, unknown or other
  misc_feature (153)..(153): n is a, c, g, or t
  modified_base (240)..(240): a, c, t, g, unknown or other
  misc_feature (240)..(240): n is a, c, g, or t
  modified_base (437)..(437): a, c, t, g, unknown or other
  misc_feature (437)..(437): n is a, c, g, or t
  modified_base (439)..(439): a, c, t, g, unknown or other
  misc_feature (439)..(439): n is a, c, g, or t
  modified_base (443)..(473): a, c, t, g, unknown or other
  misc_feature (443)..(473): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtncatccaccagggccactggcatcccagacaggttcagtggcaggtgggtctgggacagacttcactctcaccatcagcagcctggancctagaagtattttgctagtttattactgtacaactaacgtggacaacgtggaccgtatcctaccgttcggccgaggggtaccacgactggaataattaaacgactgtggctgacaccattctgttcttcactcctcccgccattctcgactattacctcgtacgtgacgtcgggctggcgaacggcgactagtagntngtannnnnnnnnnnnnnnnnnnnnnnnnnnnnnn

SEQ ID NO: 292178 - DNA, 524 bp, Homo sapiens
  misc_feature: GYAE6OF02JI0YX.18.60.F05.1.454.CMB.1.raw
  modified_base (370)..(370): a, c, t, g, unknown or other
  misc_feature (370)..(370): n is a, c, g, or t
  modified_base (488)..(488): a, c, t, g, unknown or other
  misc_feature (488)..(488): n is a, c, g, or t
  modified_base (491)..(492): a, c, t, g, unknown or other
  misc_feature (491)..(492): n is a, c, g, or t
  modified_base (494)..(494): a, c, t, g, unknown or other
  misc_feature (494)..(494): n is a, c, g, or t
  modified_base (496)..(524): a, c, t, g, unknown or other
  misc_feature (496)..(524): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggcccactggcatcccagacaggttcagtggcagtgggtctgggacagacttcattctcacatcagcagactggacgcctagaacgtattttgctagttgtatttactgttcagcaggttacgttagttcatcctccggtacgttcggccgaaagggaccgaaggtacggaaataccgaaaacggactggtaggcctagacctaacnctccgttagtcctttacgacttcctttaccccggacctacgttctacgactaacgttacctcgtacttaggacggtcggggtactcggggacgtaacgggcgtaccgtagttacggangcnngngnnnnnnnnnnnnnnnnnnnnnnnnnnnnn

SEQ ID NO: 292179 - DNA, 433 bp, Homo sapiens
  misc_feature: GYAE6OF02IL9D1.18.60.F05.1.454.CMB.1.raw
  modified_base (239)..(239): a, c, t, g, unknown or other
  misc_feature (239)..(239): n is a, c, g, or t
  modified_base (406)..(407): a, c, t, g, unknown or other
  misc_feature (406)..(407): n is a, c, g, or t
  modified_base (410)..(433): a, c, t, g, unknown or other
  misc_feature (410)..(433): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagattttgcagtgtattactgtcagcagtacggtagtcatctccgacgttcggccaagggaccaaggtggaaatcaaacgactgtgctgcacatctgtcttcactcttcccgctactctgacatactcgtactggagcgggctgggcaacgggcgcagtagnncgnnnnnnnnnnnnnnnnnnnnnnnn

SEQ ID NO: 292180 - DNA, 613 bp, Homo sapiens
  misc_feature: GYAE6OF02J3RL8.18.60.F05.1.454.CMB.1.raw
  modified_base (154)..(154): a, c, t, g, unknown or other
  misc_feature (154)..(154): n is a, c, g, or t
  modified_base (583)..(585): a, c, t, g, unknown or other
  misc_feature (583)..(585): n is a, c, g, or t
  modified_base (587)..(613): a, c, t, g, unknown or other
  misc_feature (587)..(613): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggcctcccaggctcctcatccatggtncactccaccgagggccctacgtggccactccccgagacgtagggttccaggtggcctagggtgggtccgttaggggacctacgtacttctcttccaccacctatccgagaccaggaccggttggactccgtagaagttcgtttgacgtagttagtacttacgtgtacgacgtacgttacgtacggttactctaccgtaccgtaccggtcggtaccggaaccggtaacgggtaacgaaggtaacgaaacctaccggaaacggtacgtggtaccggactaccgtacctaactcgttccttaggtacccttcgtacccttaccccgtttacccgacttaccgttcgtacccgtaaacttcccgtttaaccgggtccgttaacggtcgggccgggtacggtaccggtaggaccgacggtccgaataccgtgcnnnannnnnnnnnnnnnnnnnnnnnnnnnnn

SEQ ID NO: 292181 - DNA, 473 bp, Homo sapiens
  misc_feature: GYAE6OF02HPPH9.18.60.F05.1.454.CMB.1.raw
  modified_base (153)..(153): a, c, t, g, unknown or other
  misc_feature (153)..(153): n is a, c, g, or t
  modified_base (243)..(243): a, c, t, g, unknown or other
  misc_feature (243)..(243): n is a, c, g, or t
  modified_base (444)..(473): a, c, t, g, unknown or other
  misc_feature (444)..(473): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtncatccaccagggccactggcatcccagacaggttcagtggcaggtgggtctagggacagtacttcattctcaccatcagcagactgggancctgaagtatttgctagttgtattactgtcagcaggtacggtagttcattcctccgacgttcggacctaagggacctaggtagaaactacaaacgaatgcggctcgacacattctgtctacacttccgttacccgctacgtctacgactaatccgtcgtaactggacggtcggcgtaggccgaacgggcacgtagtgcatnnnnnnnnnnnnnnnnnnnnnnnnnnnnnn

SEQ ID NO: 292182 - DNA, 432 bp, Homo sapiens
  misc_feature: GYAE6OF02HSJW3.18.60.F05.1.454.CMB.1.raw
  modified_base (409)..(409): a, c, t, g, unknown or other
  misc_feature (409)..(409): n is a, c, g, or t
  modified_base (411)..(432): a, c, t, g, unknown or other
  misc_feature (411)..(432): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacgtagttcatctccgacgttcggccaagggaccaaggtggaaatcgaaacgactgtgctgcacatctgtctctatcttcccgcctatctgacatacctacgtactgacgcgggtctggcgaggcgacagtagcancnnnnnnnnnnnnnnnnnnnnnn

SEQ ID NO: 292183 - DNA, 410 bp, Homo sapiens
  misc_feature: GYAE6OF02FNF4J.18.60.F05.1.454.CMB.1.raw
  modified_base (399)..(399): a, c, t, g, unknown or other
  misc_feature (399)..(399): n is a, c, g, or t
  modified_base (401)..(401): a, c, t, g, unknown or other
  misc_feature (401)..(401): n is a, c, g, or t
  modified_base (404)..(410): a, c, t, g, unknown or other
  misc_feature (404)..(410): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtgcagtggtctgggacagacttcattctcaccatcagcagactggagcctgagattttgcagtgtattactgtcagcagtacggtagttcatctccgacgttcggccaagggaccaaggtaggaaatcgaaacgactgtggctgcaccatctgtcttcactctcccgctatctgacatactcgtactgacgcggtcgtggcaaggccananagnnnnnnn

SEQ ID NO: 292184 - DNA, 517 bp, Homo sapiens
  misc_feature: GYAE6OF02IWDPH.18.60.F05.1.454.CMB.1.raw
  modified_base (219)..(219): a, c, t, g, unknown or other
  misc_feature (219)..(219): n is a, c, g, or t
  modified_base (242)..(242): a, c, t, g, unknown or other
  misc_feature (242)..(242): n is a, c, g, or t
  modified_base (475)..(475): a, c, t, g, unknown or other
  misc_feature (475)..(475): n is a, c, g, or t
  modified_base (486)..(486): a, c, t, g, unknown or other
  misc_feature (486)..(486): n is a, c, g, or t
  modified_base (491)..(491): a, c, t, g, unknown or other
  misc_feature (491)..(491): n is a, c, g, or t
  modified_base (493)..(493): a, c, t, g, unknown or other
  misc_feature (493)..(493): n is a, c, g, or t
  modified_base (495)..(517): a, c, t, g, unknown or other
  misc_feature (495)..(517): n is a, c, g, or t
tcagtacgagtatgcacgaccggtgctcgatttagtacgtcatcagggaaagggccgaccctctcttgtagggccagtcagagtgttagcagcaactacttagcctggtaccagcagacacctggccaggctcccaggctcctcatccatggtgcatccaccaggccactggcatcccagacaggttcagtgcagtgggtctgggacagacttcattcncgaccagtcagcagacctggganccctagaacggtattttggctaaggttcgttaatttaacctgtacaggccagttaccggtagttcatcctccgtacggttccgaccgtaaagggcctaaagggttggaaaacttcgaaaacgtacgttgtaggacctgtaccacctatcttgtcttcacgttccttccccgctacgtctacggatactacctttcgaacttggaacgcggggttacacgggtacaggacccgntagtaacgtgntacgntncnnnnnnnnnnnnnnnnnnnnnnn

SEQ ID NO: 292185 - DNA, 627 bp, Homo sapiens
  misc_feature: GYAE6OF02J274S.18.60.F05.1.454.CMB.1.raw
  modified_base (575)..(575): a, c, t, g, unknown or other
  misc_feature (575)..(575): n is a, c, g, or t
  modified_base (577)..(578): a, c, t, g, unknown or other
  misc_feature (577)..(578): n is a, c, g, or t
  modified_base (580)..(580): a, c, t, g, unknown or other
  misc_feature (580)..(580): n is a, c, g, or t
  modified_base (583)..(583): a, c, t, g, unknown or other
  misc_feature (583)..(583): n is a, c, g, or t
  modified_base (585)..(585): a, c, t, g, unknown or other
  misc_feature (585)..(585): n is a, c, g, or t
  modified_base (587)..(587): a, c, t, g, unknown or other
  misc_feature (587)..(587): n is a, c, g, or t
  modified_base (599)..(600): a, c, t, g, unknown or other
  misc_feature (599)..(600): n is a, c, g, or t
  modified_base (602)..(602): a, c, t, g, unknown or other
  misc_feature (602)..(602): n is a, c, g, or t
  modified_base (604)..(604): a, c, t, g, unknown or other
  misc_feature (604)..(604): n is a, c, g, or t
  modified_base (607)..(607): a, c, t, g, unknown or other
  misc_feature (607)..(607): n is a, c, g, or t
  modified_base (610)..(614): a, c, t, g, unknown or other
  misc_feature (610)..(614): n is a, c, g, or t
  modified_base (616)..(617): a, c, t, g, unknown or other
  misc_feature (616)..(617): n is a, c, g, or t
  modified_base (619)..(627): a, c, t, g, unknown or other
  misc_feature (619)..(627): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcaggtggcaggtgggtctgggaccagaccttcacttctcaccatcagaccagactggggactcctagtaagtattttcgcgtagttagttacttacgtcgtacagtccgtaaggttacggttaacgtctaacttccgtaccgtaaccggtttaccgggaccgtaaacgggggtaacccaaagggttacgggaaaacttaaccgaaaaccggtaacgtcggtacggtccgtacgacccgtaacctattccgtacggttccttactacgttccctttaccccggactaaccgtccttaacgtaacctaaccttaccgtaccgttaacgtcggggtaacgtcccgggtacgtcgggaacccggttaacgggccgttaacgaacgtacggcncnncnctncncncgacgacgtacnncncncgncannnnncnncnnnnnnnnn

SEQ ID NO: 292186 - DNA, 599 bp, Homo sapiens
  misc_feature: GYAE6OF02HD5S4.18.60.F05.1.454.CMB.1.raw
  modified_base (554)..(554): a, c, t, g, unknown or other
  misc_feature (554)..(554): n is a, c, g, or t
  modified_base (558)..(558): a, c, t, g, unknown or other
  misc_feature (558)..(558): n is a, c, g, or t
  modified_base (561)..(561): a, c, t, g, unknown or other
  misc_feature (561)..(561): n is a, c, g, or t
  modified_base (563)..(564): a, c, t, g, unknown or other
  misc_feature (563)..(564): n is a, c, g, or t
  modified_base (567)..(568): a, c, t, g, unknown or other
  misc_feature (567)..(568): n is a, c, g, or t
  modified_base (570)..(570): a, c, t, g, unknown or other
  misc_feature (570)..(570): n is a, c, g, or t
  modified_base (572)..(573): a, c, t, g, unknown or other
  misc_feature (572)..(573): n is a, c, g, or t
  modified_base (575)..(576): a, c, t, g, unknown or other
  misc_feature (575)..(576): n is a, c, g, or t
  modified_base (578)..(578): a, c, t, g, unknown or other
  misc_feature (578)..(578): n is a, c, g, or t
  modified_base (581)..(582): a, c, t, g, unknown or other
  misc_feature (581)..(582): n is a, c, g, or t
  modified_base (584)..(584): a, c, t, g, unknown or other
  misc_feature (584)..(584): n is a, c, g, or t
  modified_base (586)..(589): a, c, t, g, unknown or other
  misc_feature (586)..(589): n is a, c, g, or t
  modified_base (591)..(592): a, c, t, g, unknown or other
  misc_feature (591)..(592): n is a, c, g, or t
  modified_base (596)..(598): a, c, t, g, unknown or other
  misc_feature (596)..(598): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccaggaccactggcatcccagacaggttcagtggcagtgggtctgggacaggacttcattctcaccatcagcgacgtcgagactcgagaacgtttgtcgacgtagtagttacttagtcgacgacgacgtaacggttacgttacgtctagtcccgtacggttccggccgaacgggacgaacggtaggtaagtaactaaccgaaacgtcgttaggacgtcgtacgacctaacgtacctcgtacgtttccacttaccgtttcccgtaccctacgttacctccgttaacgaacctttaacccgtttcccgttaacggttaccggtacgggaaccgggggttcccgtacgggtacgggaaaaccggtcccggtaacgtaccgtaaaggtcgacagcgacngacngcngnnacnncntnncnngngcnngngnnnngnngcgnnng

SEQ ID NO: 292187 - DNA, 519 bp, Homo sapiens
  misc_feature: GYAE6OF02GTIRU.18.60.F05.1.454.CMB.1.raw
  modified_base (208)..(208): a, c, t, g, unknown or other
  misc_feature (208)..(208): n is a, c, g, or t
  modified_base (419)..(419): a, c, t, g, unknown or other
  misc_feature (419)..(419): n is a, c, g, or t
  modified_base (461)..(461): a, c, t, g, unknown or other
  misc_feature (461)..(461): n is a, c, g, or t
  modified_base (472)..(472): a, c, t, g, unknown or other
  misc_feature (472)..(472): n is a, c, g, or t
  modified_base (475)..(475): a, c, t, g, unknown or other
  misc_feature (475)..(475): n is a, c, g, or t
  modified_base (479)..(479): a, c, t, g, unknown or other
  misc_feature (479)..(479): n is a, c, g, or t
  modified_base (481)..(481): a, c, t, g, unknown or other
  misc_feature (481)..(481): n is a, c, g, or t
  modified_base (483)..(483): a, c, t, g, unknown or other
  misc_feature (483)..(483): n is a, c, g, or t
  modified_base (485)..(485): a, c, t, g, unknown or other
  misc_feature (485)..(485): n is a, c, g, or t
  modified_base (487)..(487): a, c, t, g, unknown or other
  misc_feature (487)..(487): n is a, c, g, or t
  modified_base (489)..(489): a, c, t, g, unknown or other
  misc_feature (489)..(489): n is a, c, g, or t
  modified_base (493)..(493): a, c, t, g, unknown or other
  misc_feature (493)..(493): n is a, c, g, or t
  modified_base (495)..(496): a, c, t, g, unknown or other
  misc_feature (495)..(496): n is a, c, g, or t
  modified_base (499)..(499): a, c, t, g, unknown or other
  misc_feature (499)..(499): n is a, c, g, or t
  modified_base (501)..(501): a, c, t, g, unknown or other
  misc_feature (501)..(501): n is a, c, g, or t
  modified_base (503)..(504): a, c, t, g, unknown or other
  misc_feature (503)..(504): n is a, c, g, or t
  modified_base (506)..(511): a, c, t, g, unknown or other
  misc_feature (506)..(511): n is a, c, g, or t
  modified_base (513)..(513): a, c, t, g, unknown or other
  misc_feature (513)..(513): n is a, c, g, or t
  modified_base (515)..(515): a, c, t, g, unknown or other
  misc_feature (515)..(515): n is a, c, g, or t
  modified_base (518)..(519): a, c, t, g, unknown or other
  misc_feature (518)..(519): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtgcaggtgggtctggacngacttcattctcaccatccagtcagactggagtcctagaacgtagttttggctaagtgtattactgtacgagcagtacggttatcgtaatccgtccgacgttcggaccaagggacctaaggtacggaatacaaacgaactggtcggctagacacctatctgtcttacgactcccgttccgaccattctcgtactacgtactccggttaacncggtaacgtccgggcgttgggactaaacgggcacgtacgtancgtaggctagntcnagtnangngngngnacgngnngcncncnngnnnnnnancncgnn

SEQ ID NO: 292188 - DNA, 497 bp, Homo sapiens
  misc_feature: GYAE6OF02HBI18.18.60.F05.1.454.CMB.1.raw
  modified_base (271)..(271): a, c, t, g, unknown or other
  misc_feature (271)..(271): n is a, c, g, or t
  modified_base (389)..(389): a, c, t, g, unknown or other
  misc_feature (389)..(389): n is a, c, g, or t
  modified_base (402)..(402): a, c, t, g, unknown or other
  misc_feature (402)..(402): n is a, c, g, or t
  modified_base (462)..(462): a, c, t, g, unknown or other
  misc_feature (462)..(462): n is a, c, g, or t
  modified_base (467)..(497): a, c, t, g, unknown or other
  misc_feature (467)..(497): n is a, c, g, or t
tcagtacgagtatgcacgaccggtgctcgatttagtacgtcatcaggggaaagggccaccctctcttgtagggccagtcagagtgttagcagcaaactacttagcctggtaccagcagacacctggccaggctcccaggctcctcatccatggtgcactcccaccagggccactggcatcccagacaggttcagtggcaggtgggtcgtgggacagtacttcattctcaccatcagcacgacgtggacgcctagaacgtatttgactagtnttattactgtcagcaggttacggtagttcactcgtaccgtacggttcggaccgtaacgggaccgaagggtaggaaataccgaaaacgtacgtgtcggactgaccactatctagtctcnctcctcccgactntactcgactactccgtatacgttgacggtcgggtgtacgggcgaacggctaaggaatgtncgtannnnnnnnnnnnnnnnnnnnnnnnnnnnnnn

SEQ ID NO: 292189 - DNA, 499 bp, Homo sapiens
  misc_feature: GYAE6OF02HPXYW.18.60.F05.1.454.CMB.1.raw
  modified_base (357)..(357): a, c, t, g, unknown or other
  misc_feature (357)..(357): n is a, c, g, or t
  modified_base (468)..(469): a, c, t, g, unknown or other
  misc_feature (468)..(469): n is a, c, g, or t
  modified_base (471)..(471): a, c, t, g, unknown or other
  misc_feature (471)..(471): n is a, c, g, or t
  modified_base (473)..(499): a, c, t, g, unknown or other
  misc_feature (473)..(499): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatcccaccagggccactggcatcccagacaggttcaggtggcaggtgggtcgtggggacagtacttcacttctcaccatcagcagtactggacgcctagaagtattttgctagttgttattactgtcagactaggtacggtgttcatcctccgtacggttccgaccgaagggaccgaaaggtgaaactacgaaacgtacgtgnggctcgctacactctacgttctacactccgttcccgctactctgaactcttaccgtcgtactaggacgggtcggtacgtcgggacgtaaaggcgacttacgtgctgacgannantnnnnnnnnnnnnnnnnnnnnnnnnnnn

SEQ ID NO: 292190 - DNA, 681 bp, Homo sapiens
  misc_feature: GYAE6OF02IXOWW.18.60.F05.1.454.CMB.1.raw
  modified_base (610)..(610): a, c, t, g, unknown or other
  misc_feature (610)..(610): n is a, c, g, or t
  modified_base (654)..(681): a, c, t, g, unknown or other
  misc_feature (654)..(681): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcactcccaccgacgggccacgtggccactcccgagaccaggttccaggtcggacgaggtgggtaccgtgggacaacgtcttctatttcctaccacctatacgacgacaacggtcgttacgggacgtacccgtaggtaaggttactttttcggacgtaggtttaggttaacttaccgttggttacgacgggtaccgttaacgggtttaaccgggttacgttttaccgaacgtttcccggttacccgggttaacccgggtttaccgggacccgtaaacggggtaacccggttaaaagggtaacggtaaaacgtacccgtaaaacggtaacgcggttaacggtcgttaccgacggtaaacctgttaccgttaccgtttacgttccgtaaccgttccccgttaccccgaccgtacgttacgtcccggaattaccgttcgtaccggtaactcgggtaacggngggttccctagggaccacgggtccagttgaactgctcgatcagnnnnnnnnnnnnnnnnnnnnnnnnnnnn

SEQ ID NO: 292191 - DNA, 437 bp, Homo sapiens
  misc_feature: GYAE6OF02HKYEU.18.60.F05.1.454.CMB.1.raw
  modified_base (211)..(211): a, c, t, g, unknown or other
  misc_feature (211)..(211): n is a, c, g, or t
  modified_base (242)..(242): a, c, t, g, unknown or other
  misc_feature (242)..(242): n is a, c, g, or t
  modified_base (249)..(249): a, c, t, g, unknown or other
  misc_feature (249)..(249): n is a, c, g, or t
  modified_base (259)..(259): a, c, t, g, unknown or other
  misc_feature (259)..(259): n is a, c, g, or t
  modified_base (324)..(324): a, c, t, g, unknown or other
  misc_feature (324)..(324): n is a, c, g, or t
  modified_base (337)..(337): a, c, t, g, unknown or other
  misc_feature (337)..(337): n is a, c, g, or t
  modified_base (382)..(382): a, c, t, g, unknown or other
  misc_feature (382)..(382): n is a, c, g, or t
  modified_base (402)..(402): a, c, t, g, unknown or other
  misc_feature (402)..(402): n is a, c, g, or t
  modified_base (404)..(404): a, c, t, g, unknown or other
  misc_feature (404)..(404): n is a, c, g, or t
  modified_base (408)..(437): a, c, t, g, unknown or other
  misc_feature (408)..(437): n is a, c, g, or t
tcagtacgagtatgcacgaccggtgctcgatttagtacgtcatcagggaaagggccaaccctctccttgtagggccagtccagagtgttagcagcaactacttagcctggtaccagcagacacctggccaggctcccaggctcctcatccatggtgcatccacagggccactggcatcccagacaggttcagtggcaggtggtctgggacngacttcattctcaccatccagcagactggancctgaanttttgcagtntattatgtcagcagtacggtgtcatctcgagttcgcaagggccaaggtggaatcaaacgaactgngctgacacatctntacttcatccttcccgcatcctgacatactcgtactggagcggtntgggcaacggcgcagtaggncngacnnnnnnnnnnnnnnnnnnnnnnnnnnnnnn

SEQ ID NO: 292192 - DNA, 587 bp, Homo sapiens
  misc_feature: GYAE6OF02HQPP7.18.60.F05.1.454.CMB.1.raw
  modified_base (289)..(289): a, c, t, g, unknown or other
  misc_feature (289)..(289): n is a, c, g, or t
  modified_base (296)..(296): a, c, t, g, unknown or other
  misc_feature (296)..(296): n is a, c, g, or t
  modified_base (370)..(370): a, c, t, g, unknown or other
  misc_feature (370)..(370): n is a, c, g, or t
  modified_base (523)..(523): a, c, t, g, unknown or other
  misc_feature (523)..(523): n is a, c, g, or t
  modified_base (535)..(535): a, c, t, g, unknown or other
  misc_feature (535)..(535): n is a, c, g, or t
  modified_base (538)..(538): a, c, t, g, unknown or other
  misc_feature (538)..(538): n is a, c, g, or t
  modified_base (544)..(546): a, c, t, g, unknown or other
  misc_feature (544)..(546): n is a, c, g, or t
  modified_base (548)..(548): a, c, t, g, unknown or other
  misc_feature (548)..(548): n is a, c, g, or t
  modified_base (551)..(551): a, c, t, g, unknown or other
  misc_feature (551)..(551): n is a, c, g, or t
  modified_base (553)..(553): a, c, t, g, unknown or other
  misc_feature (553)..(553): n is a, c, g, or t
  modified_base (557)..(557): a, c, t, g, unknown or other
  misc_feature (557)..(557): n is a, c, g, or t
  modified_base (559)..(559): a, c, t, g, unknown or other
  misc_feature (559)..(559): n is a, c, g, or t
  modified_base (565)..(565): a, c, t, g, unknown or other
  misc_feature (565)..(565): n is a, c, g, or t
  modified_base (568)..(569): a, c, t, g, unknown or other
  misc_feature (568)..(569): n is a, c, g, or t
  modified_base (574)..(574): a, c, t, g, unknown or other
  misc_feature (574)..(574): n is a, c, g, or t
  modified_base (578)..(579): a, c, t, g, unknown or other
  misc_feature (578)..(579): n is a, c, g, or t
  modified_base (581)..(581): a, c, t, g, unknown or other
  misc_feature (581)..(581): n is a, c, g, or t
  modified_base (583)..(583): a, c, t, g, unknown or other
  misc_feature (583)..(583): n is a, c, g, or t
  modified_base (585)..(586): a, c, t, g, unknown or other
  misc_feature (585)..(586): n is a, c, g, or t
tcagtacgagtatgcacgaccggtgctcgatttagtacgtcatcagggaaagggccaccctctcttgtagggccagtcagagtgttagcagcaactacttagcctggtaccagcagaccacctggccaggctcccaggctcctcatccatggtgacatccaccagggccactggcatcccagacgaggttcagtggcaggtgggtctgggacagacttacacttctaccaaccaatcaacgcacgtacgtggacgctagaagttacttttgactagtagttaattaccngtactanactaaggttacggtgttaccattaccgtaccgtaccggttcggaaccgtaacggggaactaagggtacgtaaanaccgaaaagtaccgtgtcggactacggactaaccgtataccttgtacttcactttaccgtacccgactaacgtcctaacgtactacttaacggtcctaaacgtcggacggtaccgggtacgtacggaccgaaaggggcctaagtaaccggtancgatcgaatacncgntacacnnnangananagananagtacncannacacncacnncngntnnc

SEQ ID NO: 292193 - DNA, 628 bp, Homo sapiens
  misc_feature: GYAE6OF02IOYBF.18.60.F05.1.454.CMB.1.raw
  modified_base (595)..(601): a, c, t, g, unknown or other
  misc_feature (595)..(601): n is a, c, g, or t
  modified_base (603)..(606): a, c, t, g, unknown or other
  misc_feature (603)..(606): n is a, c, g, or t
  modified_base (608)..(628): a, c, t, g, unknown or other
  misc_feature (608)..(628): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcaggtgggtctgggacagtacttcattctcacctatcagcagactgggacgccgtagaagtattttgacgtagttagttacttacgtgtacaggtctaggttacggtagtttaccacgtttccgtcccgggtaccggtttaccgggaaccggtaaaccggggtaacccgtaaagggtaacggtaaaacgtaaccgtaaaaccggtaacgttacggtacgggacctaccggactaacccgaacgtttccttacggttcctttacctaacgtttcccctttccccggacccttacggttaccctacgttaacctaacgtttaaccccgtaccgtttacggtagggaacgggtcggggtccttacggggacgtaaccggggctaaccgtaggttaagctgtaccnnnnnnncnnnngnnnnnnnnnnnnnnnnnnnnn

SEQ ID NO: 292194 - DNA, 470 bp, Homo sapiens
  misc_feature: GYAE6OF02GHIS6.18.60.F05.1.454.CMB.1.raw
  modified_base (364)..(364): a, c, t, g, unknown or other
  misc_feature (364)..(364): n is a, c, g, or t
  modified_base (387)..(387): a, c, t, g, unknown or other
  misc_feature (387)..(387): n is a, c, g, or t
  modified_base (394)..(394): a, c, t, g, unknown or other
  misc_feature (394)..(394): n is a, c, g, or t
  modified_base (419)..(419): a, c, t, g, unknown or other
  misc_feature (419)..(419): n is a, c, g, or t
  modified_base (435)..(435): a, c, t, g, unknown or other
  misc_feature (435)..(435): n is a, c, g, or t
  modified_base (439)..(439): a, c, t, g, unknown or other
  misc_feature (439)..(439): n is a, c, g, or t
  modified_base (441)..(441): a, c, t, g, unknown or other
  misc_feature (441)..(441): n is a, c, g, or t
  modified_base (443)..(444): a, c, t, g, unknown or other
  misc_feature (443)..(444): n is a, c, g, or t
  modified_base (446)..(470): a, c, t, g, unknown or other
  misc_feature (446)..(470): n is a, c, g, or t
tcagtacgagtatgcacgaccggtgctcgatttagtacgtcatcagggaaaggggccaccctctcttgtagggccagtcagagtgttagcagcaactacttagcctggtaccagcagacacctggccaggctcccaggctcctcatccatggtgcatccaccagggcccactggcactcccagaccaggttcagtggcaggtgggtctgggacagtaccttcattctcaccatcagcagactggacgcctggaatattttgctaggtgttattacgtgtcgagcgagtacggttattcatctccgtacgttcggaccaagggaccaagggtgaaactacgaaacgaacgtgtcggctgccaccntctgtctctattccctccgactntaccgtnacatacctcgtactggacgcgggtncgggagacggcgacanacgntnanngnnnnnnnnnnnnnnnnnnnnnnnnn

SEQ ID NO: 292195 - DNA, 482 bp, Homo sapiens
  misc_feature: GYAE6OF02ID8Y1.18.60.F05.1.454.CMB.1.raw
  modified_base (242)..(242): a, c, t, g, unknown or other
  misc_feature (242)..(242): n is a, c, g, or t
  modified_base (345)..(345): a, c, t, g, unknown or other
  misc_feature (345)..(345): n is a, c, g, or t
  modified_base (463)..(482): a, c, t, g, unknown or other
  misc_feature (463)..(482): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatcccaccagggccactggcatcccagacaggttcagtggcagtgggtctgggacagacttcagttctcgaccatcagcagactggancctgagtattttgctagtgttattactgtcagcagtacgtagttcaattcctacgtacgttcggacccaagggaccaagggtacggaaatcaaacgtaactgnggactcggacactagtcttgttctcacttccttcccgcctattccctacgtacttacgttaaccgtttccgtaaacgtggacggccgggtacgtcggaccgaacgggtcacgaatgannnnnnnnnnnnnnnnnnnn

SEQ ID NO: 292196 - DNA, 598 bp, Homo sapiens
  misc_feature: GYAE6OF02GSJHF.18.60.F05.1.454.CMB.1.raw
  modified_base (215)..(215): a, c, t, g, unknown or other
  misc_feature (215)..(215): n is a, c, g, or t
  modified_base (219)..(219): a, c, t, g, unknown or other
  misc_feature (219)..(219): n is a, c, g, or t
  modified_base (232)..(232): a, c, t, g, unknown or other
  misc_feature (232)..(232): n is a, c, g, or t
  modified_base (238)..(238): a, c, t, g, unknown or other
  misc_feature (238)..(238): n is a, c, g, or t
  modified_base (252)..(252): a, c, t, g, unknown or other
  misc_feature (252)..(252): n is a, c, g, or t
  modified_base (568)..(568): a, c, t, g, unknown or other
  misc_feature (568)..(568): n is a, c, g, or t
  modified_base (570)..(598): a, c, t, g, unknown or other
  misc_feature (570)..(598): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccgagggccactggcatcccagacaggttcagtgcagtgggtctggacagtcttcnttcncaccatcagcagntggacnctagaatagttttnacgtagttacgttagttactggttacagtcctaaggttacgggttattacctaacgttccgtacccggtacggtttccggaaccggtaaacgggtacccgtaaagggtaacgggtaaaactaaccggaaaaaccgtacgttcgggtaacgtccgttaaaggaccctaactaacgttccttaggttaccctttacaacctttcccgtccccaactactttaccgtaactacctaaacgttaccgtttaccggtacgttacgggaacgggttcccgggtacttaacgggacgaaaccggcgttaacgaacgtagcagncnnnnnnnnnnnnnnnnnnnnnnnnnnnnn

SEQ ID NO: 292197 - DNA, 688 bp, Homo sapiens
  misc_feature: GYAE6OF02HH0AY.18.60.F05.1.454.CMB.1.raw
  modified_base (225)..(225): a, c, t, g, unknown or other
  misc_feature (225)..(225): n is a, c, g, or t
  modified_base (637)..(637): a, c, t, g, unknown or other
  misc_feature (637)..(637): n is a, c, g, or t
  modified_base (648)..(648): a, c, t, g, unknown or other
  misc_feature (648)..(648): n is a, c, g, or t
  modified_base (658)..(658): a, c, t, g, unknown or other
  misc_feature (658)..(658): n is a, c, g, or t
  modified_base (662)..(688): a, c, t, g, unknown or other
  misc_feature (662)..(688): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggcctcccaggctcctcatccatggtgcactccaccgagggtcccatggcactcccgagacaggttcaggtgcgaggtcgggtctcgggacagacttnaactttcctaccaccgtataccgagctaggactgggactcccgtagtaaacgttagttttcgaccgtaaggttagttacgtttaacgttcgtactacgacttaaggttaaccgggtttaggttaccctagttacccgttacccgggtaccggttttcccgggaaccggtaaaccggggtaaccggtaaacggggttaacggtaaaaaccgttaaacggtaaaacccggtaaacggttacgggtaacggttacccggtaacggtacccgtaaccgtacgtttaaccggttccgtttaccgtttacgtaacctttcccgttaaccccgtccttacgttaccgtacggtaacctacgttaccttaccgtaaggtacggacggtcccgggtctacgggtccggaaccggcgttaanacggttaagcncagtcaggcncgannnnnnnnnnnnnnnnnnnnnnnnnnn

SEQ ID NO: 292198 - DNA, 513 bp, Homo sapiens
  misc_feature: GYAE6OF02HM7G3.18.60.F05.1.454.CMB.1.raw
  modified_base (242)..(242): a, c, t, g, unknown or other
  misc_feature (242)..(242): n is a, c, g, or t
  modified_base (349)..(349): a, c, t, g, unknown or other
  misc_feature (349)..(349): n is a, c, g, or t
  modified_base (474)..(474): a, c, t, g, unknown or other
  misc_feature (474)..(474): n is a, c, g, or t
  modified_base (478)..(478): a, c, t, g, unknown or other
  misc_feature (478)..(478): n is a, c, g, or t
  modified_base (481)..(481): a, c, t, g, unknown or other
  misc_feature (481)..(481): n is a, c, g, or t
  modified_base (483)..(488): a, c, t, g, unknown or other
  misc_feature (483)..(488): n is a, c, g, or t
  modified_base (490)..(490): a, c, t, g, unknown or other
  misc_feature (490)..(490): n is a, c, g, or t
  modified_base (492)..(513): a, c, t, g, unknown or other
  misc_feature (492)..(513): n is a, c, g, or t
tcagtacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatgggtgcatccaccagggccactggcatcccagacaggttcagtggcagtgggtctgggacagacttcattctccaccatccagcagactggancctgaagtattttgcagtgtattactgtcagcagttacggtattccagttctccggtacggttcggaccgaacgggaccaagggtacgaaataccaaacgaactggnggcctagccactatctgttacttcactccttccccgccagttcacggaactacttaccgttccgtaacgttcgacgggtcccggggacgttaccgggacgaacgggcccgtacgtaaggttacgntacncgncnnnnnngncnnnnnnnnnnnnnnnnnnnnnn

SEQ ID NO: 292199 - DNA, 545 bp, Homo sapiens
  misc_feature: GYAE6OF02IQFZ9.18.60.F05.1.454.CMB.1.raw
  modified_base (514)..(531): a, c, t, g, unknown or other
  misc_feature (514)..(531): n is a, c, g, or t
  modified_base (533)..(545): a, c, t, g, unknown or other
  misc_feature (533)..(545): n is a, c, g, or t
tcagtacgagtatgcacgaccggtgctcgatttagtacgtcatcagggaaagggccaccctctcttgtagggccagtcagagtgttagcagcaaactactttagcctggtaccagcaggacacctggccaggctcccaggctccctcatccatgggtgccactcccaccgacgggcccacgttggcactccccagacgaggttcaggtggctaggtggggtctagggacagtacttcattcctccaccatccagccaggactggacgcctagaagtctttttgctagttagtattactgtcgagcgtacggttacggttacgttcacgttcctaccggtacggttccggaccggaaacgggtacccgaaagggttacggaaaataccgaaaacgaacgttcggtaggctagccaacacgtcttgttcttcacttccgtcccaccttacgtctcactacttaccgtacgtactggacggcgggtctcggacgacggtcgtaacattacggatcgnnnnnnnnnnnnnnnnnngnnnnnnnnnnnnn

SEQ ID NO: 292200 - DNA, 742 bp, Homo sapiens
  misc_feature: GYAE6OF02FPUDD.18.60.F05.1.454.CMB.1.raw
  modified_base (112)..(112): a, c, t, g, unknown or other
  misc_feature (112)..(112): n is a, c, g, or t
  modified_base (153)..(153): a, c, t, g, unknown or other
  misc_feature (153)..(153): n is a, c, g, or t
  modified_base (350)..(350): a, c, t, g, unknown or other
  misc_feature (350)..(350): n is a, c, g, or t
  modified_base (589)..(589): a, c, t, g, unknown or other
  misc_feature (589)..(589): n is a, c, g, or t
  modified_base (618)..(618): a, c, t, g, unknown or other
  misc_feature (618)..(618): n is a, c, g, or t
tcagtacgagtatgcacgaccggtgctcgatttagtacgtcatcagggaaaggggctggaatatattgggattacctcttacagtgggaccacccattacaacccgtccctnaaaagtcgactcaccatttccgtggacacgtcgaaaaacgngttcctcctggacttgacctctgtcgaccgccgcagaccacggtcttgtttattactgtgcgagacgactacctgacctccaatccaattacctttgactagtcgggggccgggtatcccgtggtccaccgttctccgtcacggtccctaccgaaccgtaacgggccctaagttccgggttcccctttccccccggnggccccgtaccccgttggtaccccttaccggaagggacctacccgtaccccgttaccgggaacgacgccgaacggtacggtccccgggtccggttggggcccttcggtaccccgttagggtaaccccaaagggtcccctttaaccgttccccaagttaccgttccgggttaactcgggtaacggccggggtacgttacgggaaccggtaaacggtccgtaacgagtacgtgcgtcgatnacgtcgaacgtgccgagtgactgtaccgngtacgacgacgtcgtactacgacgtacgtacgtcgacgtcgtacgtacgtacgtacgtacgtacgtacgtacgacgtacggtacgtacgtacgtacgtacgtacgtacgtacgtacgacgtacg

SEQ ID NO: 292201 - DNA, 688 bp, Homo sapiens
  misc_feature: GYAE6OF01D6VNQ.11.10.A10.1.454.CMB.1.raw
  modified_base (210)..(210): a, c, t, g, unknown or other
  misc_feature (210)..(210): n is a, c, g, or t
  modified_base (216)..(216): a, c, t, g, unknown or other
  misc_feature (216)..(216): n is a, c, g, or t
tcagcgagagataccacgaccggtgctcgatttagcgtcgatctcagggagctctgagagaggagcccagccctgggattttcaggtgttttcatttggtgatcaggactgaacagagagaactcaccatggagtttgggctgagcggtcgtggtttctaaggtcggctaattttaaaaggtgtcagtgtgaggtgcagctgttggagtntggggnggcgttggtacgagcgtggggtcggcgtgagactcaccgtgtgcgacgcctcgtgtacttactaacctttaaactaactacgaccatagacgcgtcggtccgccgacggccgtaccggacgggaacgggcggtggtaggtcgggtcgtcgtaggttagttggtggtaggtggtggtagtacgtagtacgtacgttacgtacgacgtacgtaccggtacggtaacgggtaccggttaccgtaccgtacgtaccgtaccgtacgaacgaacgtaaacttaaccgtaaacgtaaaagtaagtaagtagtaataagtagtaacgtaaagtaagaacgaacgacgtacgagacggaccggaacggaacgaccggtaccgtacgttacgtttacgttagtacggtacggtaaaggtaacggtacggtacgtaagtaacgttaacggtacgtaccgtaaccggtaccggtacgggtagg

SEQ ID NO: 292202 - DNA, 517 bp, Homo sapiens
  misc_feature: GYAE6OF01CUUC4.11.10.A10.1.454.CMB.1.raw
  modified_base (195)..(195): a, c, t, g, unknown or other
  misc_feature (195)..(195): n is a, c, g, or t
  modified_base (354)..(354): a, c, t, g, unknown or other
  misc_feature (354)..(354): n is a, c, g, or t
  modified_base (489)..(489): a, c, t, g, unknown or other
  misc_feature (489)..(489): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccgaggggaaanagcccaccctctcctgcagggccagtcagagtgttaggagcaacttagcctggtaccagcaagaacctggccaggcctcccaggctcctcatctatggtgcatcccaccgagggccacgtcggtttcccagccaggttcagtgcagtgggtctgagacngagttcactctcacatcgaacgcctgcagtctagaagtattttgactagtttattactgtcagctagtataataacgtgacctcggtacgttcggacgaaggaaccgaggtaggaagtacgaaacgtatgtggtngcaccgatctgttctacatcctccgtcc

SEQ ID NO: 292203 - DNA, 507 bp, Homo sapiens
  misc_feature: GYAE6OF01EDIS8.11.10.A10.1.454.CMB.1.raw
  modified_base (193)..(193): a, c, t, g, unknown or other
  misc_feature (193)..(193): n is a, c, g, or t
  modified_base (349)..(349): a, c, t, g, unknown or other
  misc_feature (349)..(349): n is a, c, g, or t
  modified_base (478)..(478): a, c, t, g, unknown or other
  misc_feature (478)..(478): n is a, c, g, or t
tcagcgagagataccacgaccggtgctcgatttagcgtcgatctcagggggaactgctcagttaggacccagacggaaccatggaagccccagcgcagcttctcttcctcctgctactctggctcccagatagcactggagaaatagtgatgacgcagtctccagccaccctgtctgtgtctccaggggaaanagccaccctctcctgcagggccagtcagagtgttaggagcaacttagcctggtaccagcagaaacctggccaggctcccaggctcctcatctatggtgcatccaccagggccactggtttcccagccaggttcagtggcagtgggtctgagacagngttcactctcaccatcaacggcctgcagtctagaagtatttgctagtttattactgtcagcagtataataactgacctcggacgttcggaccgaagggaccaaggtggaagtacgaaacgacgtggtgntgcaccatcgtgtcttacactctcccgtc

SEQ ID NO: 292204 - DNA, 502 bp, Homo sapiens
  misc_feature: GYAE6OF01A9MV4.11.10.A10.1.454.CMB.1.raw
  modified_base (193)..(193): a, c, t, g, unknown or other
  misc_feature (193)..(193): n is a, c, g, or t
tcagcgagagataccacgaccggtgctcgatttagcgtcgatctcagggggaactgctcagttaggacccagacggaaccatggaagccccagcgcagcttctcttcctcctgctactctggctcccagatagcactggagaaatagtgatgacgcagtctccagccaccctgtctgtgtctccaggggaaanagccaccctctcctgcagggccagtcagagtgttaggagcaacttagcctggtaccagcagaaacctggccaggctccaggctcctcatctatggtgcatccaccagggccactggttcccagccaggttcagtggcagtgggtctgagacagagttcactctcaccatcaacgcctgcagtctgaagtatttgctagtttattactgtcagcagtataatactggcctcggacgttcggccaagggaccgaaggtggaagtacgaaacgaacgtgtggctgcaccatctgtcttcatccgttcccgcc

SEQ ID NO: 292205 - DNA, 584 bp, Homo sapiens
  misc_feature: GYAE6OF01C54MZ.11.10.A10.1.454.CMB.1.raw
tcagcgagagataccacgaccggtgctcgatttagcgtcgatctcaggggctgtcgtgatgattgcgtggtgggactctgtcccgctccaaggcacccgctctctgggacgggtgccccccggggtttttggactcctgggggtgacttagcagccgtctgcttgcagttggacttcccaggccgacagtggtctggcttctgaggggtcaggccagaatgtggggtacgtgggaggccagcagagggttccatgagaagggcaggacagggccacggacagtcagcttccatgtgacgccccggagacagaaggtctctgggtggcgttggggtttttgtgggggtgagggagtgggacattctgcctattgtgatttactactaactactactacatggacgtctggggacaagggaccaacggtcaccgtctcctcacgcctccaccgaacggcccagtccggtctcccctgccaccctcctaccacgacgcacctcgtcggggcacgacgccggcccgtgggccgtgcccgtcgggtaccgaaacggtaccgttaccgttaccgtatccgtcgtcgtccg

SEQ ID NO: 292206 - DNA, 495 bp, Homo sapiens
  misc_feature: GYAE6OF01BHPJO.11.10.A10.1.454.CMB.1.raw
  modified_base (193)..(193): a, c, t, g, unknown or other
  misc_feature (193)..(193): n is a, c, g, or t
  modified_base (471)..(471): a, c, t, g, unknown or other
  misc_feature (471)..(471): n is a, c, g, or t
  modified_base (477)..(477): a, c, t, g, unknown or other
  misc_feature (477)..(477): n is a, c, g, or t
  modified_base (485)..(485): a, c, t, g, unknown or other
  misc_feature (485)..(485): n is a, c, g, or t
tcagcgagagataccacgaccggtgctcgatttagcgtcgatctcagggggaactgctcagttaggacccagacggaaccatggaagccccagcgcagcttctcttcctcctgctactctggctcccagatagcactggagaaatagtgatgacgcagtctccagccaccctgtctgtgtctccaggggaaanagccaccctctcctgcagggccagtcagagtgttaggagcaacttagcctggtaccagcagaaacctggccaggctccaggctcctcatctatggtgcatccaccagggccactggtttcccagccaggttcagtggcagtgggtctgagacagagttcactctcaccatcaacgcctgcagtctgaagtatttgctagtttattactgtcagcagtataataactgcctcggacgttcggaccgaagggaccaaggtggaagtcaaacgactgtggntgcacntctgtctnatcctccgcc

SEQ ID NO: 292207 - DNA, 513 bp, Homo sapiens
  misc_feature: GYAE6OF01BR5Q6.11.10.A10.1.454.CMB.1.raw
  modified_base (193)..(193): a, c, t, g, unknown or other
  misc_feature (193)..(193): n is a, c, g, or t
tcagcgagagataccacgaccggtgctcgatttagcgtcgatctcagggggaactgctcagttaggacccagacggaaccatggaagccccagcgcagcttctcttcctcctgctactctggctcccagatagcactggagaaatagtgatgacgcagtctccagccaccctgtctgtgtctccaggggaaanagccaccctctcctgcagggccagtcagagtgttaggagcaacttagcctggtaccagcagaaacctggccaggctccaggctcctcatctatggtgcatccacagggccactggttcccagccaggttcagtggcagtgggtctgagacagagttcactctcaccatcaacggcctgcagtctgaagtattttgctagtttattactgtcagcagttataataactggtacctcggtacgttcggaccaagggaccaagggtaggaagtacgaaacgaacgtgtggctggcacctatctgtcttcacttcctcccgtcc

SEQ ID NO: 292208 - DNA, 525 bp, Homo sapiens
  misc_feature: GYAE6OF01CMCZH.11.10.A10.1.454.CMB.1.raw
  modified_base (195)..(195): a, c, t, g, unknown or other
  misc_feature (195)..(195): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccgaggggaaanagccaccctctcctgcagggccagtcatagtgttaggagcaacttagcctggtaccagcagaaacctggccaggctccaggctcctcatctatggtgcatccaccagggccacgtcggtttcccagccaggttcagtggcagtgggtctgagacagagttcactctcacctatcaacgggcctgcagtctagaagtattttgctagtttattacttgtcagctagtataaatacgtggccttcggaccgttcggaccgaagggaccgaaggtaggaagtacgaaacgtagtaggtggtctgcaccattctcgtcttcactcttcccgtcc

SEQ ID NO: 292209 - DNA, 505 bp, Homo sapiens
  misc_feature: GYAE6OF01BUCLH.11.10.A10.1.454.CMB.1.raw
  modified_base (150)..(150): a, c, t, g, unknown or other
  misc_feature (150)..(150): n is a, c, g, or t
  modified_base (173)..(173): a, c, t, g, unknown or other
  misc_feature (173)..(173): n is a, c, g, or t
  modified_base (177)..(177): a, c, t, g, unknown or other
  misc_feature (177)..(177): n is a, c, g, or t
  modified_base (179)..(180): a, c, t, g, unknown or other
  misc_feature (179)..(180): n is a, c, g, or t
  modified_base (182)..(184): a, c, t, g, unknown or other
  misc_feature (182)..(184): n is a, c, g, or t
  modified_base (186)..(187): a, c, t, g, unknown or other
  misc_feature (186)..(187): n is a, c, g, or t
  modified_base (192)..(193): a, c, t, g, unknown or other
  misc_feature (192)..(193): n is a, c, g, or t
  modified_base (203)..(203): a, c, t, g, unknown or other
  misc_feature (203)..(203): n is a, c, g, or t
  modified_base (211)..(212): a, c, t, g, unknown or other
  misc_feature (211)..(212): n is a, c, g, or t
  modified_base (215)..(215): a, c, t, g, unknown or other
  misc_feature (215)..(215): n is a, c, g, or t
  modified_base (217)..(217): a, c, t, g, unknown or other
  misc_feature (217)..(217): n is a, c, g, or t
  modified_base (219)..(219): a, c, t, g, unknown or other
  misc_feature (219)..(219): n is a, c, g, or t
  modified_base (223)..(223): a, c, t, g, unknown or other
  misc_feature (223)..(223): n is a, c, g, or t
  modified_base (226)..(227): a, c, t, g, unknown or other
  misc_feature (226)..(227): n is a, c, g, or t
  modified_base (229)..(229): a, c, t, g, unknown or other
  misc_feature (229)..(229): n is a, c, g, or t
  modified_base (231)..(231): a, c, t, g, unknown or other
  misc_feature (231)..(231): n is a, c, g, or t
  modified_base (233)..(233): a, c, t, g, unknown or other
  misc_feature (233)..(233): n is a, c, g, or t
  modified_base (246)..(246): a, c, t, g, unknown or other
  misc_feature (246)..(246): n is a, c, g, or t
  modified_base (248)..(249): a, c, t, g, unknown or other
  misc_feature (248)..(249): n is a, c, g, or t
  modified_base (251)..(251): a, c, t, g, unknown or other
  misc_feature (251)..(251): n is a, c, g, or t
  modified_base (274)..(274): a, c, t, g, unknown or other
  misc_feature (274)..(274): n is a, c, g, or t
  modified_base (276)..(276): a, c, t, g, unknown or other
  misc_feature (276)..(276): n is a, c, g, or t
  modified_base (279)..(279): a, c, t, g, unknown or other
  misc_feature (279)..(279): n is a, c, g, or t
tcagcgagagataccacgaccggtgctcgatttagcgtcgatctcaggggagctctgagagaggagcccagccctgggattttcaggtgttttcatttggtgatcaggactgaacagagagaactcaccatggagtttgggctgagcggngtgttctaggcggcatttaaggncagngnngnnngnngtgannggagctgacngctgggcnngancncnctgngcnncncngntctactacacacncnngngcgtggcgcgcgcgcgaggaggngnggngtggtcgtgtagtagtggtggtgtggtggtgcgagatacgtcgcgacgacgtcgtacgacggtcgtacgactactctacgacgacgactaactaacaaagaagtagtatagtatatagactaatagaacgacgacgtagagacgacgacgacgacgtacgtagttacgttacgtagtagacgaagacgtcgacgtagtacgtacgtacgtacgtacgtcgtggtag

SEQ ID NO: 292210 - DNA, 511 bp, Homo sapiens
  misc_feature: GYAE6OF01AZCX4.11.10.A10.1.454.CMB.1.raw
  modified_base (194)..(194): a, c, t, g, unknown or other
  misc_feature (194)..(194): n is a, c, g, or t
  modified_base (480)..(480): a, c, t, g, unknown or other
  misc_feature (480)..(480): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccaggggaaangccaccctctcctgcagggccagtcagagtgttaggagcaacttagcctggtaccagcagaaacctggccaggctcccaggctcctcatctatggtgcatccaccagggccactggtttcccagccaggttcagtggcagtgggtctgagacagagttcactctcaccatcaacggctgcagtctagaagtattttgctagtttattactgtcagctagtataatactcggtacctcggtacgttcggaccaagggaccgaaggtggaagtacaaacgagtgtggntgcacgatctgttctctattcccgtccgtcc

SEQ ID NO: 292211 - DNA, 574 bp, Homo sapiens
  misc_feature: GYAE6OF01DUEPQ.11.10.A10.1.454.CMB.1.raw
  modified_base (193)..(193): a, c, t, g, unknown or other
  misc_feature (193)..(193): n is a, c, g, or t
tcagcgagagataccacgaccggtgctcgatttagcgtcgatctcagggggaactgctcagttaggacccagacggaaccatggaagccccagcgcagcttctcttcctcctgctactctggctcccagatagcactggagaaatagtgatgacgcagtctccagccaccctgtctgtgtctccaggggaaangccaccctctcctgcagggccagtcagagtgttaggagcaacttgcctggtaccagcagaacctggccaggctccaggctcctcatctatggtgcatccaccgagggccacgtggtttcccagccaggttcagtggcagtgggtctgagacagagttcactctcaccatcaacggcctgctattctagaagtattttcgactagttttattacttgtactagctaagttaattaataacgtggtacccttcggtacggttccggaccgtaaacgggtaaccgtaagggtaggtaacgtacgaaaaccggtaacgtacggtacggtacgttacggaccaaccgtatccgttagttaccttactacttcccttcccggtaccc

SEQ ID NO: 292212 - DNA, 521 bp, Homo sapiens
  misc_feature: GYAE6OF01BSSBD.11.10.A10.1.454.CMB.1.raw
  modified_base (484)..(484): a, c, t, g, unknown or other
  misc_feature (484)..(484): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccgaggggaaagagccaccctctcctgcagggccagtcagagtgttaggagcaacttagcctggtaccagcagaaacctggccaggctccaggctcctcatctatggtgcatccaccagggccacgtcggttcccagtccaggttcagtggcagtgggtctgagacgagtagttcactctcaccatcaacgctgcagtctgagtatttgctagtttattactgtcagctagtataatactggtcctcggtacgttcggaccgaacgggaccaggtaggaacgtacgaaacgacgtgtcggngtacgcacatcgtgtcttacgacttccttccgtaccc

SEQ ID NO: 292213 - DNA, 578 bp, Homo sapiens
  misc_feature: GYAE6OF01AW7ZD.11.10.A10.1.454.CMB.1.raw
  modified_base (180)..(180): a, c, t, g, unknown or other
  misc_feature (180)..(180): n is a, c, g, or t
  modified_base (214)..(214): a, c, t, g, unknown or other
  misc_feature (214)..(214): n is a, c, g, or t
  modified_base (241)..(241): a, c, t, g, unknown or other
  misc_feature (241)..(241): n is a, c, g, or t
  modified_base (249)..(249): a, c, t, g, unknown or other
  misc_feature (249)..(249): n is a, c, g, or t
  modified_base (362)..(362): a, c, t, g, unknown or other
  misc_feature (362)..(362): n is a, c, g, or t
  modified_base (471)..(471): a, c, t, g, unknown or other
  misc_feature (471)..(471): n is a, c, g, or t
tcagcgagagataccacgaccggtgctcgatttagcgtcgatctcaggggagctctgagagaggagcccagccctgggattttcaggtgttttcatttggtgatcaggactgaacagagagaactcaccatggagtttgggctgagcggtcgtggttctaggtcggctaattttaaaggngtcagtgtgagtgcagctgtgagtgtggggaggngtgtgagccgtggggtgcgtgagctcncgtgtgcncgctcgtgtatctacttaacaactacgtcatgcgtcgtcggtccgccgcggcgtcggagggacgggcggtggtaggtcggtcgtcgtaggttagtggtggtggtggtggtagngagtatacgtcgtacgacgtacgtcggtacggtacggtcggtacgtactactcgtaccgacgacgtaactaactaacgaaagaaagtagtagtagtagtatagtacaanagacgacgtacgagagacggacgacgacgacgtacgtacgttacgttcgtagtacgtacgagacggtcggacgtagtacgtacgtacgtacgtacgtcggtggtacg

SEQ ID NO: 292214 - DNA, 512 bp, Homo sapiens
  misc_feature: GYAE6OF01BCRQV.11.10.A10.1.454.CMB.1.raw
  modified_base (194)..(194): a, c, t, g, unknown or other
  misc_feature (194)..(194): n is a, c, g, or t
  modified_base (504)..(504): a, c, t, g, unknown or other
  misc_feature (504)..(504): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccaggggaaangccaccctctcctgcagggccagtcagagtgttaggagcaacttagcctggtaccagcagaacctggccaggctccaggctcctcatctatggtgcatcccacgagggccacgtggttcccagccaggttcagtgcagtggtctgagacagtagttcactctcaccatcaacgctgcagtctagaagtatttgacttagtttattactgtcagtctagtataatactcggtacctcggacgttcgacgtaagggaccgaggtaggaagtacgaagacgtaacgtgtaggcgtgctacatcgtcgtcttcntcctcccg

SEQ ID NO: 292215 - DNA, 607 bp, Homo sapiens
  misc_feature: GYAE6OF01CW5X9.11.10.A10.1.454.CMB.1.raw
  modified_base (191)..(191): a, c, t, g, unknown or other
  misc_feature (191)..(191): n is a, c, g, or t
  modified_base (200)..(200): a, c, t, g, unknown or other
  misc_feature (200)..(200): n is a, c, g, or t
  modified_base (227)..(227): a, c, t, g, unknown or other
  misc_feature (227)..(227): n is a, c, g, or t
  modified_base (285)..(285): a, c, t, g, unknown or other
  misc_feature (285)..(285): n is a, c, g, or t
tcagcgagagataccacgaccggtgctcgatttagcgtcgatctcagggggaactgctcagttaggacccagacggaaccatggaagcccagcgcagcttctcttcctcctgctactctggctcccagatagcactggagaaatgtgatgacgcagtctccagccacctgtctgtgtctccgaggggaaancgccacctntcctgcagggccagtcatagtgtaggncaacttgcctggtaccagcagaacctgccaggctccgaggcctctcatctagtggtcncactccgaacgtagggcctacgttcggttcccagtccgtaggttcaggtcgctaggtcgggtctagacgactaggtcgtttcacttcgtacaccgtagtaccgaaccggtccttacggtaccgtacggtccgttaggaaacggtttacgttttacggaccgtttaaggttttacgtaacgttcggtacctaaggtccgttaacggttactaacgttaacggtcggtaccgttacggtacgttacgacgtaacggtacgtaggtacgtacgtacgaaacgtgtgtacgctacgcacgtatcgtcgtactacgctcgttcgacg

SEQ ID NO: 292216 - DNA, 592 bp, Homo sapiens
  misc_feature: GYAE6OF01ENDOT.11.10.A10.1.454.CMB.1.raw
  modified_base (194)..(194): a, c, t, g, unknown or other
  misc_feature (194)..(194): n is a, c, g, or t
  modified_base (403)..(403): a, c, t, g, unknown or other
  misc_feature (403)..(403): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccaggggaaanagccaccctctcctgcagggccagtcagagtgttaggagcaacttagcctggtaccagcagaacctggccaggctccaggcctcctcatctatggtgcactcccaccgagggccctacgttcggtttccccagccctaggttcaggtggcaggtgggtctggagacagtagttcactctcaccatccaacggcctgcagtctagaagtntttgctagtttattacgtgtcagctagttataataacgtggacctcgggacgttccggaccgtaagggacctaagggtacggaaacgttaccgaaaacggtaacgttggtacgggaccttacggacccgtaacccgtagttccgttacggttacctttaccgtaacgtttccccgttaccccggtaccc

SEQ ID NO: 292217 - DNA, 507 bp, Homo sapiens
  misc_feature: GYAE6OF01EBQXG.11.10.A10.1.454.CMB.1.raw
  modified_base (193)..(193): a, c, t, g, unknown or other
  misc_feature (193)..(193): n is a, c, g, or t
tcagcgagagataccacgaccggtgctcgatttagcgtcgatctcagggggaactgctcagttaggacccagacggaaccatggaagccccagcgcagcttctcttcctcctgctactctggctcccagatagcactggagaaatagtgatgacgcagtctccagccaccctgtctgtgtctccaggggaaanagccaccctctcctgcagggccagtcagagtgttaggagcaacttagcctggtaccagcagaacctggccaggctcccaggcctcctcatctatggtgcatccaccagggccactggtttcccagccaggttcagtggcagtgggtctgagacaggagttcactctcaccatcaacggcctgcagtctgaagtatttgctagtttattactgtcagcagtataataactgcctagagtacgttcggaccaagggaccaagggtggaagtacaaacgacgtgtggctgcaccactctgtactttcattcgtcccg

SEQ ID NO: 292218 - DNA, 552 bp, Homo sapiens
  misc_feature: GYAE6OF01A5OOU.11.10.A10.1.454.CMB.1.raw
  modified_base (239)..(239): a, c, t, g, unknown or other
  misc_feature (239)..(239): n is a, c, g, or t
tcagcgagagataccacgaccggtgctcgatttagcgtcgatctcaggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgttggagtcgtgggggaggcttggtacagccgtggggggtcnctgagactcacctgtgcagcctctggattcacctttaacaactacgccatgagctgggtccgccaggctccgaggggaagggctgggagtgggtctcgaggtattgggtggtagtgggtggtagcagatacttcgcagactccggtaggaacgggtccgttcaccatcctccagacgacaattaccaaagaaatgaatgtatatgacaaatgaacagacctagagacgaccggaaggaccgacggaccgtatactttcgtaggtgacggaaagacgtcgggatagtatagtcgacctacggaccgtggggtac

SEQ ID NO: 292219 - DNA, 519 bp, Homo sapiens
  misc_feature: GYAE6OF01EGAK5.11.10.A10.1.454.CMB.1.raw
  modified_base (195)..(195): a, c, t, g, unknown or other
  misc_feature (195)..(195): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccgaggggaaangccaccctctcctgcagggccagtcagagtgttaggagcaacttagcctggtaccagcagaaacctggccaggctccaggctcctcatctatggtgcatccacagggccactgttcccagccaggttcagtggcagtgggtctgagacagagttcactctcaccatcaacggcctgcagtctagaagtattttgctagtttattacttgtcagtctagttattgtagaagtcctccgtctacctacgtttccgggcgggtacggggaccgtcgggtggagagtcgaggacgaacgtgtggctcgcacctattccttgtcttacc

SEQ ID NO: 292220 - DNA, 559 bp, Homo sapiens
  misc_feature: GYAE6OF01C1Y0U.11.10.A10.1.454.CMB.1.raw
  modified_base (197)..(197): a, c, t, g, unknown or other
  misc_feature (197)..(197): n is a, c, g, or t
  modified_base (235)..(235): a, c, t, g, unknown or other
  misc_feature (235)..(235): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctatctgtgtctccgaagggggaaanagccaccctctcctgcagggccagtcagagtgtaggancaacttagcctggacagcagaactgccaggctccaggctcctcatctatgtgcatccaccaggccactggttcccagccaggttcagtggcaggtgggtctgagacagagttcactctcacatcgaacgcctgcagtctagaagtattttgactagtttattactgtacagactagtaataataacgtggtaccgtacggtacgttcggacgaacgggaccgtaagggtaggtaaacgtaacgaaaaccgtaacgtaggtcggacgtacgaccgtaacctagttcgttacgttactttacctaacttcccgttcccggtaaccc

SEQ ID NO: 292221 - DNA, 513 bp, Homo sapiens
  misc_feature: GYAE6OF01CIE8Q.11.10.A10.1.454.CMB.1.raw
  modified_base (237)..(237): a, c, t, g, unknown or other
  misc_feature (237)..(237): n is a, c, g, or t
  modified_base (300)..(300): a, c, t, g, unknown or other
  misc_feature (300)..(300): n is a, c, g, or t
  modified_base (364)..(364): a, c, t, g, unknown or other
  misc_feature (364)..(364): n is a, c, g, or t
  modified_base (389)..(389): a, c, t, g, unknown or other
  misc_feature (389)..(389): n is a, c, g, or t
  modified_base (392)..(392): a, c, t, g, unknown or other
  misc_feature (392)..(392): n is a, c, g, or t
  modified_base (420)..(420): a, c, t, g, unknown or other
  misc_feature (420)..(420): n is a, c, g, or t
  modified_base (478)..(478): a, c, t, g, unknown or other
  misc_feature (478)..(478): n is a, c, g, or t
  modified_base (495)..(495): a, c, t, g, unknown or other
  misc_feature (495)..(495): n is a, c, g, or t
tcagcgagagataccacgaccggtgctcgatttagcgtcgatctcaggggagctctgagagaggagcccagccctgggattttcaggtgttttcatttggtgatcaggactgaacagagagaactcaccatggagtttgggctgagctggcttttctgtggctattttaaaaggtgtccagtgtgaggtgcagctgttggagtcgtgggggaggcttggtacagccgtggggggtcncgtgagactcacctgtgcagcctctggattcacctttaacaactacgccatgagctgggtccnccaggctccgagggaaggggctgggagtgggtctcgaggtattggtggtagtggtggtagcagntactgcagctcgtgacggcgtcacntcncagagacattccaaagaatgatgtatangacaatagaacagctagacgagccgaggacacggacgtatagttctgtacgcgaaagngtcgggcagtagtacgngacctacgcgtggggtac

SEQ ID NO: 292222 - DNA, 585 bp, Homo sapiens
  misc_feature: GYAE6OF01BAYL0.11.10.A10.1.454.CMB.1.raw
  modified_base (194)..(194): a, c, t, g, unknown or other
  misc_feature (194)..(194): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccaggggaaanagccaccctctcctgcagggccagtcagagtgttaggagcaacttagcctggtaccagcagaaacctggccaggctcccaggctcctcatctatggtgcatccaccagggccactgtttcccagccaggttcagtggcaggtgggtctgagacagagttcactctcaccatcaacggtcctgcagtctgagtatttgctagtttattactgtcagtctagttataattaacgtcggtacccgttacgggtaccggtttccggaccgtaacggggacccgtaaagggtacgggaaagtaccgtaaaaccggaacgttacgggtcgggtacgttcggaccaacccgtattccgttcgtttcctttacctactttcccgtttccccggtacccg

SEQ ID NO: 292223 - DNA, 519 bp, Homo sapiens
  misc_feature: GYAE6OF01A2765.11.10.A10.1.454.CMB.1.raw
  modified_base (290)..(290): a, c, t, g, unknown or other
  misc_feature (290)..(290): n is a, c, g, or t
  modified_base (484)..(484): a, c, t, g, unknown or other
  misc_feature (484)..(484): n is a, c, g, or t
  modified_base (492)..(492): a, c, t, g, unknown or other
  misc_feature (492)..(492): n is a, c, g, or t
tcagcgagagataccacgaccggtgctcgatttagcgtcgatctcagggggaactgctcagttaggacccagacggaaccatggaagccccagcgcagcttctcttcctcctgctactctggctcccagatagcactggagaaatagtgatgacgcagtctccagccaccctgtctgtgtctccaggggaaagagccaccctctcctgcagggccagtcagagtgttaggagcaacttagcctggtaccagcagaaacctggccaggctccaggctcctcatctatggtncatccacagggccactggttcccagccaggttcagtggcaggtgggtctgagacagtagttcactctcaccatcaacggcctgcagtctagaagtatttgactagtttattactgtcagctagtaataatactggtacctcggtacgttcggaccgaagggaccaaggtcggaagtacaaacgaactggtcggntgcaccgntctgttacttacacttccgttcccgcc

SEQ ID NO: 292224 - DNA, 652 bp, Homo sapiens
  misc_feature: GYAE6OF01CK6NQ.11.10.A10.1.454.CMB.1.raw
  modified_base (202)..(202): a, c, t, g, unknown or other
  misc_feature (202)..(202): n is a, c, g, or t
tcagcgagagataccacgaccggtgctcgatttagcgtcgatctcgagggggggaacgtgctcaggttaggacccagacggaaccatggaagccccagcgcacgcttctcttcctcctgctactctggctcccagatagcacgtggagaaatagtgatgacgcagtctccagccaccctgtctgtgtctccgaaggggaaanacgccaccctctcctgcagggccagtcaggagtgttaggagctaacttgcctggtaccaggcaagaaaccgtggaccaggcctacccgaggtcctcctctacttcgtaagtgggtcgccaacgtcccaaccgagggccctaacgttcgggtttccccaggtcccgtaggttccgagttcggctagggtgggtctagagactaggtagttcacgttctacgacctagtccgaacggtcctgactagtctagtaagttatttcgactttaagtttactacgttcgtatagtactagttaataacgtaacgtgtacccgttacggtacgttccggaacggaacggaacccgtaagggtacggtaaacgtaacgaaacgtagtaggtacggtacgcggtacctaccgtagttacccgttcgttaccttacgtacctttcccgttccccggtaac

SEQ ID NO: 292225 - DNA, 671 bp, Homo sapiens
  misc_feature: GYAE6OF01EA467.11.10.A10.1.454.CMB.1.raw
  modified_base (225)..(225): a, c, t, g, unknown or other
  misc_feature (225)..(225): n is a, c, g, or t
  modified_base (240)..(240): a, c, t, g, unknown or other
  misc_feature (240)..(240): n is a, c, g, or t
  modified_base (255)..(255): a, c, t, g, unknown or other
  misc_feature (255)..(255): n is a, c, g, or t
  modified_base (258)..(258): a, c, t, g, unknown or other
  misc_feature (258)..(258): n is a, c, g, or t
  modified_base (263)..(263): a, c, t, g, unknown or other
  misc_feature (263)..(263): n is a, c, g, or t
tcagcgagagataccacgaccggtgctcgatttagcgtcgatctcaggggagctctgagagaggagcccagccctgggattttcaggttgttttcatttggtgatcaggactgaacagagagaactcaccatggagtttgggctgagcgtgtcgtttctaggtggctaagtttaaaggtgtcagtgtgaggtgcagctgttggagtcgtgggggaggcttggacnggccgttgggggtcncgtgagactcactgngcngcctntggacttctaacctttaacaactacgccagtgagtcgtcgggccgccagggcctccggaaggggaacggggtctagggacggtgggtcctagtaagggtagtttgggtggttaggtgggttacggagcgaggtaacttcgttccgagaagtaccgttccggtaggaacggggttcccgttacaaccgtacttccgtacgaacgaacggtaactaaacttaaccgaaaaggtaaaatgggtaaacttaggtaactttaagtaggaaccttaaaaggtacgaacgtaacgtacgtacgacgacgacgacgaaccgacgtacgttacgttacgttacgtacgtacggtaacgtaaggtaacggtacggtacgtaagtaacgtacgtacgtaccgtaccggtacggtggtag

SEQ ID NO: 292226 - DNA, 504 bp, Homo sapiens
  misc_feature: GYAE6OF01BJ9MD.11.10.A10.1.454.CMB.1.raw
  modified_base (194)..(194): a, c, t, g, unknown or other
  misc_feature (194)..(194): n is a, c, g, or t
  modified_base (496)..(496): a, c, t, g, unknown or other
  misc_feature (496)..(496): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccaggggaaanagccaccctctcctgcagggccagtcatagtgttaggagcaacttagcctggtaccagcagaaacctggccaggctcccaggctcctcatctatggtgcatccaccagggccactggtttcccagccaggttcagtggcaggtgggtctgagacagagttcactctcaccatcaacggcctgcagtctgaagtattttgcttagtttttactgttcagtcagtatagtactggcctccgtacacgttttgcctaggggaccagctagaactcaaacgacgtgtagctgcacatctgtctctntcctcccg

SEQ ID NO: 292227 - DNA, 588 bp, Homo sapiens
  misc_feature: GYAE6OF01B812E.11.10.A10.1.454.CMB.1.raw
  modified_base (194)..(194): a, c, t, g, unknown or other
  misc_feature (194)..(194): n is a, c, g, or t
tcagcgagagataccacgaccggtgctcgatttagcgtcgatctcagggggaactgctcagttaggacccagacggaaccatggaagccccagcgcagcttctcttcctcctgctactctggctcccagatagcactggagaaatagtgatgacgcagtctccagccaccctgtctgtgtctccaggggaaaangccaccctctcctgcagggccagtcagagtgtaggagcaacttgcctggtaccagcagaacctggccaggcctccaggctcctcatctagtgtgcatcccacgagggccacgtcggttcccagccaggttccagtggcaggtgggtctggagacgagtacgttcacctctacaccatccaaccggtcctgcacgtctacgtaagttattttcgacttagtttacttactgtacgatctaagtacttaaactaacgtcggaccttacgggtaccgttacgggacctaacggggacctaagggtacggtaaacgttacgaaacgaacgttaggtcggtacgtacggccaccgtacttccgttacggttactttaccaacttccgttccccggtacc

SEQ ID NO: 292228 - DNA, 594 bp, Homo sapiens
  misc_feature: GYAE6OF01CW1XY.11.10.A10.1.454.CMB.1.raw
  modified_base (294)..(294): a, c, t, g, unknown or other
  misc_feature (294)..(294): n is a, c, g, or t
  modified_base (315)..(315): a, c, t, g, unknown or other
  misc_feature (315)..(315): n is a, c, g, or t
  modified_base (484)..(484): a, c, t, g, unknown or other
  misc_feature (484)..(484): n is a, c, g, or t
tcagcgagagataccacgaccggtgctcgatttagcgtcgatctcagggggagctctgagagaggagcccagccctgggattttcaggtgttttcatttggtgatcaggactgaacagagagaactcaccatggagtttgggctgagcgtggtcttttctggtggcttaattttaaaaggtgtccagtgtgaggtgcagctggttggagtcgtgggggagcttggacaggccgtggggggtcgctgagactcacctgtgcagcctactaggattccaacctttaacaacctacnccaatcgagtcgtgggtcccncaggcctaccgaaggggaacgggctagggagttgggaccttgaaggttattgggtaggtagtgggtcggtaagctaggaatacgttcgcacgactccgtagaacggccgttcacgatctaccagagactaattacaaaagaaatagatagtaatatgtaacaatagaanacgcctagagcgacgacgacgtacgactattattcgtagaggaacgtaaaaggctaacggggactaagttaagtaacgttacgacccttaacggcccgttgggggtaaac

SEQ ID NO: 292229 - DNA, 517 bp, Homo sapiens
  misc_feature: GYAE6OF01CB59F.11.10.A10.1.454.CMB.1.raw
  modified_base (195)..(195): a, c, t, g, unknown or other
  misc_feature (195)..(195): n is a, c, g, or t
  modified_base (233)..(233): a, c, t, g, unknown or other
  misc_feature (233)..(233): n is a, c, g, or t
tcagcgagagataccacgaccggtgctcgatttagcgtcgatctcagggggggaactgctcagttaggacccagacggaaccatggaagccccagcgcagcttctcttcctcctgctactctggctcccagatagcactggagaaatagtgatgacgcagtctccagccaccctgtctgtgtctccaggggaaangccaccctctcctgcagggccagtcagagtgttaggancaacttagcctggtaccagcagaaacctggccaggctccaggctcctcatctatggtgcatccaccagggccactcggtttcccagccaggttcaggtggcaggtgggtctggagacagagttcactctcaccatcacggcctgctagtctagaagtatttgctagttttatacttgtctagctagtataatatcggactcggacgttcggaccgaagggaccaggtcggaagtacgaaacgtactagtggtctgcacatcgtctcttctactcttcccgtacc

SEQ ID NO: 292230 - DNA, 683 bp, Homo sapiens
  misc_feature: GYAE6OF01AQJX3.11.10.A10.1.454.CMB.1.raw
  modified_base (249)..(249): a, c, t, g, unknown or other
  misc_feature (249)..(249): n is a, c, g, or t
  modified_base (343)..(343): a, c, t, g, unknown or other
  misc_feature (343)..(343): n is a, c, g, or t
tcagcgagagataccacgaccggtgctcgatttagcgtcgatctcaggggctgtcgtgatgattgcgtggtgggactctgtcccgctccaaggcacccgctctctgggacgggtcgccccccggggtttttggactccgtgggggtgacttagcagccgtctgcttgcagttggacttcccaggccgacagtggtctggcttctggaggggtcaggccagaagtggtggggtacgtgggagccagcagnggtcatgagaagggcaggacagggccaggacagtcagcttccatgtgacgcccggagacgagaaggtctcgtgggtggtcgttggggtttttgnggggttgaggtagtgggactattcgtgcctatttcgtgtatttactacttaactactactaacagtgggacgttcgtaggggacgaaagggtaccctaacggtcctaccggtacctccgtacgacgtccctaccgaacccgaacggtcccaacgttccggttacccttcccccgtcggacccaccccttacccgacctaacgaccgtaccacccgttcggtacgggggccaaccgacggcccgggcccgtacggggtccctccgggacccgttcgggtaccgtaaacgggtacccgttacccgttacccggttaacttcccgtccgtacccggtcccggg

SEQ ID NO: 292231 - DNA, 590 bp, Homo sapiens
  misc_feature: GYAE6OF01EW2T5.11.10.A10.1.454.CMB.1.raw
  modified_base (194)..(194): a, c, t, g, unknown or other
  misc_feature (194)..(194): n is a, c, g, or t
  modified_base (203)..(203): a, c, t, g, unknown or other
  misc_feature (203)..(203): n is a, c, g, or t
  modified_base (281)..(281): a, c, t, g, unknown or other
  misc_feature (281)..(281): n is a, c, g, or t
  modified_base (284)..(284): a, c, t, g, unknown or other
  misc_feature (284)..(284): n is a, c, g, or t
  modified_base (291)..(291): a, c, t, g, unknown or other
  misc_feature (291)..(291): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccaggggaaangccaccctntcctgcagggccagtcagagtgttaggagcaacttgcctggtaccagcagaacctggccaggctccaggctcctctanacntactgtngcactaccaccacggtccgacctacggttccgtacgacgtacgtacgtacgtaggtcgacgtaggtcggtacgtaggtacgacgtacgtacgtactactacctaccactactaaccgaccgtcgtacgtacgtacgttacgtagtagatttttagtactagtttattactagtactagtacaagttagtaataacgtaggtaccgtcggacggttacggtaccgaacgggtacgaacggtaggaagacgtaacgaacgtagtcggacgtacgacgtacctactactcgttcgttcgtac

SEQ ID NO: 292232 - DNA, 842 bp, Homo sapiens
  misc_feature: GYAE6OF01DK1R6.11.10.A10.1.454.CMB.1.raw
  modified_base (196)..(196): a, c, t, g, unknown or other
  misc_feature (196)..(196): n is a, c, g, or t
  modified_base (232)..(232): a, c, t, g, unknown or other
  misc_feature (232)..(232): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggaagaaatagtgatgacgcagtctccagccaccctgtctgtgtctccgaggggaaancgccaccctctcctgcagggccagtcagagtgtagncaacttgcctggacagcagaaacctggccaggctccaggcctcctcatctatggtgcatccaccgagggcctacgttcggtttcccagtccgtaggttcagtggctaggtgggtctggagacgagtacgttacaccttcgtaccaacctacttaccgaacgggtcccttacggaccgtaacggttccgttaggtaaaacgtttacgttttttacggacgtttaaacggtttttttaacgtttaaccgtttacgggttacccgtaacgggttaaccgtttaaacggtttaaacgtttaaaaccgtttaaacccgggtttcggggttaacccccggttttaacccggggggttaaaccccggggtttttaccccgggggaaaaccccggttaaaaccgggggggttaaaaccccggttaaaggggggtttaaaccggggtaaaaaccggttaaacccgggtaaaaaaacccgggtaaccggtttacggggttaacggggtaccgtttaccggtaacccgtaaaccccgttaaaccgtttcccggtttaacggtttaccccgttttaccgtttaaacccgtttcccccggttttaaccccccggttaaccccg

SEQ ID NO: 292233 - DNA, 634 bp, Homo sapiens
  misc_feature: GYAE6OF01CNTOJ.11.10.A10.1.454.CMB.1.raw
  modified_base (195)..(195): a, c, t, g, unknown or other
  misc_feature (195)..(195): n is a, c, g, or t
  modified_base (225)..(225): a, c, t, g, unknown or other
  misc_feature (225)..(225): n is a, c, g, or t
  modified_base (300)..(300): a, c, t, g, unknown or other
  misc_feature (300)..(300): n is a, c, g, or t
  modified_base (398)..(398): a, c, t, g, unknown or other
  misc_feature (398)..(398): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccgaggggaaanagcccaccctctcctgcagggccagtcagngtgtaggagctaacttagcctggtacagcgaagaaacctggaccaggcctcccaggcctcctcattctagtggtncactcccaccgagggtccacgttcgtttcccagtccgtaggttcgaggttcggctaggttgggtcgtagagacgtaggtacgttcactctacacctancgaacgctgactagtctagtaagttgtttagacttagttttacttacgtcgtactagtactaagttaataacgttaacgtcggtaccgttacgggtaaccgttaccgggaccggtaaacgggtaaccggtaagggtaacgggaaacgttaaccgaaaacggtaacgttagtacgggtctacggtaccaaccttcggttaccttcgttccttaccttaccttccgttccccggtacc

SEQ ID NO: 292234 - DNA, 593 bp, Homo sapiens
  misc_feature: GYAE6OF01B8EBT.11.10.A10.1.454.CMB.1.raw
  modified_base (196)..(196): a, c, t, g, unknown or other
  misc_feature (196)..(196): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagcccaccctgtctgtgtctccgaggggaaancgccaccctctcctgcagggccagtcagagtgttaggagcaacttagcctggtaccagcagaacctggccaggcctcccaggcctcctcatctagtggtgcactcccaccgagggccctacgttcggtttccccagtccctaggttcaggtggctaggtgggtctagagacaggtacgttcactctcacctatccgaaccggctgctagtctagtaagtattttgacttagtttattactgtacgagtactaagttaataacttaacgtcggtacccgttacgggtaccggttaccggaccggtaacgggtaaccgaagggtacggtaacgtaacgaaacggtacgtaggtcggactagtccacgtatcgtcttcttactacttccgttcccgtacc

SEQ ID NO: 292235 - DNA, 634 bp, Homo sapiens
  misc_feature: GYAE6OF01D8DJC.11.10.A10.1.454.CMB.1.raw
  modified_base (242)..(242): a, c, t, g, unknown or other
  misc_feature (242)..(242): n is a, c, g, or t
tcagcgagagataccacgaccggtgctcgatttagcgtcgatctcaggggagctctgagagaggagcccagccctgggattttcaggtgttttcatttggtgatcaggactgaacagagagaactcaccatggagtttgggctgagctggtctttttcttgtggcttattttaaaaggtgtctagtgtgaggtgcagctgttggagtcgtgggggaggcgttggtacagccgtggggggtcncgtgagactcacctgtgcagcctctggattcctacctttaacaactacgccatgagctcgggtccgccgaggcctccgaggggaaggggctgggaggtgggtctcgaggttagttgggtggtagtgggtggtagcagatactcgcagactccggtggaacgggtccgttcacctatcctaccagagactaataccaaagaaatgatgtaatatagactaaatgaacacgacctaggaacggaacgaccggaaggaccgtaaccgggaccgttaagttaacgtttcgttacggtacggaaccggtaaaagggtacggttccggggactaaggttaacgtaacgggttaccggtaaccccgttaaccgggtacccgggttagggggttaaacgg

SEQ ID NO: 292236 - DNA, 651 bp, Homo sapiens
  misc_feature: GYAE6OF01B3V84.11.10.A10.1.454.CMB.1.raw
  modified_base (196)..(196): a, c, t, g, unknown or other
  misc_feature (196)..(196): n is a, c, g, or t
tcagcgagagataccacgaccggtgctcgatttagcgtcgatctcagggggggaactgctcagttaggacccagacggaaccatggaagccccagcgcagcttctcttcctcctgctactctggctcccagatagcactggagaaatagtgatgacgcagtctccagccaccctgtctgtgtctccgaggggaaangcccaccctctcctgcagggccagtcagagtgttaggagcaacttagcctggtaccagcagaaacctggccaggcctcccaggtcctcctcatctatggtgcatcccacgtagggccacgtcggtttacccagcctaggttcaggtggctaggtgggtctaggagacaggtacttccacttctaccaccataccgaaccggtcctgacctagtctaggtaagtagttttagcttagttttacttacttgttacgtagactagttaataaacgtaacgttcggacccgttacgggtaccggtttaccggaccgtaaacggggaaccggtaagggtacggtaaaacgtaccggtaaaaccgtaacggttacggttacgggtagtaccggtaccgtaacccgtacgttccgttacggtttaccctttaccggtactttccccgttcccccgtaacccg

SEQ ID NO: 292237 - DNA, 579 bp, Homo sapiens
  misc_feature: GYAE6OF01BWPKR.11.10.A10.1.454.CMB.1.raw
  modified_base (175)..(175): a, c, t, g, unknown or other
  misc_feature (175)..(175): n is a, c, g, or t
  modified_base (178)..(178): a, c, t, g, unknown or other
  misc_feature (178)..(178): n is a, c, g, or t
  modified_base (181)..(181): a, c, t, g, unknown or other
  misc_feature (181)..(181): n is a, c, g, or t
  modified_base (183)..(183): a, c, t, g, unknown or other
  misc_feature (183)..(183): n is a, c, g, or t
  modified_base (197)..(197): a, c, t, g, unknown or other
  misc_feature (197)..(197): n is a, c, g, or t
  modified_base (204)..(204): a, c, t, g, unknown or other
  misc_feature (204)..(204): n is a, c, g, or t
  modified_base (210)..(210): a, c, t, g, unknown or other
  misc_feature (210)..(210): n is a, c, g, or t
  modified_base (219)..(220): a, c, t, g, unknown or other
  misc_feature (219)..(220): n is a, c, g, or t
  modified_base (222)..(222): a, c, t, g, unknown or other
  misc_feature (222)..(222): n is a, c, g, or t
  modified_base (227)..(227): a, c, t, g, unknown or other
  misc_feature (227)..(227): n is a, c, g, or t
  modified_base (230)..(230): a, c, t, g, unknown or other
  misc_feature (230)..(230): n is a, c, g, or t
  modified_base (233)..(233): a, c, t, g, unknown or other
  misc_feature (233)..(233): n is a, c, g, or t
  modified_base (235)..(235): a, c, t, g, unknown or other
  misc_feature (235)..(235): n is a, c, g, or t
  modified_base (239)..(239): a, c, t, g, unknown or other
  misc_feature (239)..(239): n is a, c, g, or t
  modified_base (260)..(260): a, c, t, g, unknown or other
  misc_feature (260)..(260): n is a, c, g, or t
  modified_base (290)..(290): a, c, t, g, unknown or other
  misc_feature (290)..(290): n is a, c, g, or t
tcagcgagagataccacgaccggtgctcgatttagcgtcgatctcaggggagctctgagagaggagcccagccctgggattttcaggtgttttcatttggtcgatcaggactgaacagagagaactcaccatggagtttgggctgagcggcgtgttctaggcgctatttaaaggntcngtngngtgcagctgtgatntgggagnttgacngctggggcnngnactcnctngcncnctcngtactactactacacacacangagtcgtcggcgcgcgcgacggagggaggngtaggtaggtggtcgtgtagttagttggtggtaggtggtggtagtacgagtagtacgtcgacgtacgtacgtacggtacggtacggtaccggtaccgtaccgtacgtactacgacgacgtaacgtaactaacgtaaacgtaaagtagtagtagtaatatataactaataagacgacgacgagacgacgacggacgacgacgtacgtacttacgttacgtagtacggtaacgtaagtacggtacggtacgtaacgtacgtacgtacgtaccgtacggtacggtaggtacg

SEQ ID NO: 292238 - DNA, 633 bp, Homo sapiens
  misc_feature: GYAE6OF01BYAXK.11.10.A10.1.454.CMB.1.raw
tcagcgagagataccacgaccggtgctcgatttagcgtcgatctcaggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgttggagtcgtgggggagcttggtacagccgtggggggtcgctgagactcacctgtcgcagcctcgtggattccaacctttaacaactacgccatgagctgggtccgccgaggcctccgaggggaacggggcgtgggagtgggtctcgaggttagttgggtggtagtggtggtagcagatacgtcgcagacctccggtggaacgggtcccggttacaccgtatcctaccgaaggaacgaactaaacttacccgaaaagtaaaactgaagttagtaatatagaactaaagtacgaaactacgacccgtagaacgggaaccggaccggtaacggaccggtaccgggtaccgttattacgtttcgtaggtacggacggtaaaggcgtacgggactaagttacgtacggtacgtacccgtacggtaccggtggggtaacg

SEQ ID NO: 292239 - DNA, 751 bp, Homo sapiens
  misc_feature: GYAE6OF01BE1AY.11.10.A10.1.454.CMB.1.raw
  modified_base (195)..(195): a, c, t, g, unknown or other
  misc_feature (195)..(195): n is a, c, g, or t
  modified_base (234)..(234): a, c, t, g, unknown or other
  misc_feature (234)..(234): n is a, c, g, or t
  modified_base (302)..(302): a, c, t, g, unknown or other
  misc_feature (302)..(302): n is a, c, g, or t
tcagcgagagataccacgaccggtgctcgatttagcgtcgatctcaggggggaactgctcagttaggacccagacggaaccatggaagccccagcgcagcttctccttcctcctgctactctggctcccagatagcactggagaaatagtgatgacgcagtctccagccaccctgtctgtgtctcgaggggaaanacgccaccctctcctgcagggccagtcagagtgtagganacaattacgcctaggtaccagcgaagaaaccgtggaccaggcctccgaggcctcctcatctatggtcncactcccacgacgggtccctacgttcggttacccagtccgtaggttcaggtcggacgtaggtcgggtactaggacgtacgaggttacgttccacgttcctaccgaaacctacgtaacccgaaccggtccctaggaccgtacgttacgtaaggttaaagttacgtttttacggaacctttaagtttttaactttacgttacgttacgtaacgtacttaaagtttaaactaaacgttaaccggttcgggtacccgttaccggggttaaccggttacccgggtaacggtaaacggggtaaccgtaaacggggttaacggaaaacgggttaaaccgtaaaaccgggtaaaccgttgggtaccgggtaaccttacggtaaccctaacccggttacttaccgtttaaccggttaccgtttaaccctacccgtttccccgttaccccgttaacccg

SEQ ID NO: 292240 - DNA, 531 bp, Homo sapiens
  misc_feature: GYAE6OF01AX0L3.11.10.A10.1.454.CMB.1.raw
  modified_base (192)..(192): a, c, t, g, unknown or other
  misc_feature (192)..(192): n is a, c, g, or t
  modified_base (361)..(361): a, c, t, g, unknown or other
  misc_feature (361)..(361): n is a, c, g, or t
  modified_base (383)..(383): a, c, t, g, unknown or other
  misc_feature (383)..(383): n is a, c, g, or t
  modified_base (389)..(389): a, c, t, g, unknown or other
  misc_feature (389)..(389): n is a, c, g, or t
tcagcgagagataccacgaccggtgctcgatttagcgtcgatctcagggggaactgctcagttaggacccagacggaaccatggaagccccagcgcagcttctcttcctcctgctactctggctcccagatagcactggagaaatagtgatgacgcagtctccagccaccctgtctgtgtctccaggggaangccaccctctcctgcagggccagtcagagtgttaggagcaacttagcctggtaccagcagaaacctggccaggctacccaggctcctcatctatggtgcatccacgagggccctagtcggtttcccagcctaggttcagtcgcaggtggtctgagacagagttcactcncaccatccaacgctgctagtcngaagtntttgctagtttatactgtcagctagtataatacgtgaccgtacggacgttccggacgtaacgggaccgtaaggtggaacgtacgaaacgtacgtgtcggcttgaccaccgtattcgtcgtacttacgacttccgtccgtacc

SEQ ID NO: 292241 - DNA, 841 bp, Homo sapiens
  misc_feature: GYAE6OF01D85UG.11.10.A10.1.454.CMB.1.raw
  modified_base (194)..(194): a, c, t, g, unknown or other
  misc_feature (194)..(194): n is a, c, g, or t
  modified_base (238)..(238): a, c, t, g, unknown or other
  misc_feature (238)..(238): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctcgaggggaaanacgcccaccctctcctgcgagggccagtcagtagtggttagganacaacttcgccgtaggtaccagacaacgaaaccgtggaccacggcctccgaggccttcctactaagttccttaaggtcggtcgacctaccgttacccgaacccggacggggtacccctaccggttttccgggtttaccccaacggtcccgttaacggggtttactacgggtcgggacgtagggtttcgggggttacctaggaacgaacgtaggtacgtttacctaacccttccgtaccaaccctacgttaccccgacgtacgtaccctaaggaccgtaccgttaaggtaaacggtttacttttaggtacgtttaaacggttttttaacgtttaccgttacggttaaccctaaacggtacggtaccggttaacggcccgtaacgggacccgttaacccggggcccccgtttaacccgggggacccggtttaacccgggtttacccggggaaaccccggtaaacgggggtaaacccggtaaacgggggttacgggtaaaccggtaacggtaaaccgggtaaccgggttaaacggtcgggttaccgggaccgttacgaaccccgttacccttaagttaccgttaccggtttccttaccgttacccg

SEQ ID NO: 292242 - DNA, 672 bp, Homo sapiens
  misc_feature: GYAE6OF01CPB8L.11.10.A10.1.454.CMB.1.raw
  modified_base (195)..(195): a, c, t, g, unknown or other
  misc_feature (195)..(195): n is a, c, g, or t
  modified_base (232)..(232): a, c, t, g, unknown or other
  misc_feature (232)..(232): n is a, c, g, or t
  modified_base (368)..(368): a, c, t, g, unknown or other
  misc_feature (368)..(368): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccgaggggaaanagccaccctctcctgcagggccagtcagagtgtaggngcaacttagcctggtaccagcaagaacctggccaggcctccgaggcctcctcatctagtggtgctactcccaccgagggcctacgttcgggtttaccccagtcccgtaggttccaggtcggcgtaggtcggggtcnggacgacgtagtacgttccacttcgtaccaacccgtattacccgaaccgggtcctacggaccgtacggttccgttaggtaaacgtttacgttttcggactttaggttttacttacgttcggtacaggttacctaaggtttaacttaaacgttaacgttcgggacccgttaccggggtaccgttccgggaaccgtaacgggtaaccgtaggggtacggtaaacgtaccgtaaacggtagtcgggtacggagtacggacctacgtacgttcgttacgttacttactaccttcccgttcccgtaccg

SEQ ID NO: 292243 - DNA, 922 bp, Homo sapiens
  misc_feature: GYAE6OF01DXBT9.11.10.A10.1.454.CMB.1.raw
  modified_base (180)..(180): a, c, t, g, unknown or other
  misc_feature (180)..(180): n is a, c, g, or t
  modified_base (198)..(198): a, c, t, g, unknown or other
  misc_feature (198)..(198): n is a, c, g, or t
  modified_base (245)..(245): a, c, t, g, unknown or other
  misc_feature (245)..(245): n is a, c, g, or t
tcagcgagagataccacgaccggtgctcgatttagcgtcgatctcgagggggaactgggctcagttacggacccagacggaaccatggaacgccccagcgcagcttctctcctcctgctactctggctcccagatagctagtggagaaatgtgtatgacgctagtctcagccacctgtcngtgtctacgaggggaaancgccaccgtctcctgactacgggccaggttcgagtacgtgttacggntcctaacgttagccttggaaccacgtcgaagaaacctggacccaacggtcctacccaggtcctacctactactaccgttagtcgggtacgcctacgtcccgaaccgtacggggccctacgttccgggttttacccgacggttcccgtaagggttccaagggttggacgtacgggttaggggtacctaggtaacggtaaccgtaaggtacggttttacccgaccgtttaccgtacctaaccccgtaacgttaacccggtaacccggggtacccgttaacgggtacccgttaaacgggtttacccgttaaacgggttaaaccgttttacggtttttaacgtaaccgtttaacggttttttaaacctttaacgttaccggtttaaccggtaacgttaaccgttaaaaccggtttaagtttaaaaaccgtttaaccggttaccggggttaaccccggtttaaccggggttaacccggggttttacccgggaaacccggggtaaaaccggggttaacccggtaacgggggttaaacggggtaaaccggttaaaccggtaaaaaccgggtaaaccggttttcggggtaacgggttacgttacccggaaccttaacccggttacgttaccgtttaccggttaccttttaccgttaccgtttccccggtttcccggttaaacccg

SEQ ID NO: 292244 - DNA, 910 bp, Homo sapiens
  misc_feature: GYAE6OF01CHB9K.11.10.A10.1.454.CMB.1.raw
  modified_base (198)..(198): a, c, t, g, unknown or other
  misc_feature (198)..(198): n is a, c, g, or t
  modified_base (338)..(338): a, c, t, g, unknown or other
  misc_feature (338)..(338): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggaagaaatagtgatgacgcagtctccagccaccctgtctgtgtctaccgaaggggaaanacgccaccctctcctgcgaggccagtcagagtgttaggagcaacgttagcctggtaaccaagcaaacggtaaaacccgtggacccgaacgggtcccttacccgaggtcccttccgtactaacgttccttaagtcgggttnccctaactaccccgaaccggtaccggggtcctaaccgtttccggttttaccccgaacggtacccgttaagggtttaccgaagggttcggtaccgtaaggggtttcgggtaccgtagggaacgtaaccgtaaagggttacgtttacctaaccgtttcaacccctaaccgtaaacgttacccgaaaccggggtcccgttaacggaccgtaacggttacctttaagggtaaaacggtttactttttacggtaaacgtttaacggttttttaacgttaacggtttcgttaaccgaacggtttaccgttaaaaggtttaaacgttaaaaaccgtttaacggttccgggtaacccgggtttacccgggtaaacccgggttttaccggggaaaccccgggtaaacggggtaaacccgggttaaaggggttaaacccgggtaaaaccggtttaacccggaaaaacgggttaaaccggttacggggttacgggttaaccctagggtaaacccttaaacccgtattaacccggtttagtttaccccttacgttaaacccgtttccccgttacccggtacccg

SEQ ID NO: 292245 - DNA, 627 bp, Homo sapiens
  misc_feature: GYAE6OF01B19WG.11.10.A10.1.454.CMB.1.raw
  modified_base (195)..(195): a, c, t, g, unknown or other
  misc_feature (195)..(195): n is a, c, g, or t
  modified_base (354)..(354): a, c, t, g, unknown or other
  misc_feature (354)..(354): n is a, c, g, or t
tcagcgagagataccacgaccggtgctcgatttagcgtcgatctcagggggggaactgctcagttaggacccagacggaaccatggaagccccagcgcagcttctcttcctcctgctactctggctcccagatagcactggagaaatagtgatgacgcagtctccagccaccctgtctgtgtctccaggggaaangccaccctctcctgcagggccagtcagagtgttaggagcaacttagcctggtaccagcagaaacctggccaggctcccaggcctcctcatctatggtgcatcccacagggccactggtttcccagcctaggttcaggtggcaggtgggtctgagacagngttcactctcaccatccacggcctgcagtctgagttatttgactagttttattactgtctagctagttaataacgttaacgtcgggtacccgttcgggtaccgtttccgggacccgtaaacggggtacccgtaaggggtacggtaaacggttaaccgaaaaccgggttaaccgttagggtaccgggtaccgttacggaccccgtaacccgtaacgtttcccggttacgtttaccctttaccgtaacctttccccggtttcccccggtaccccg

SEQ ID NO: 292246 - DNA, 736 bp, Homo sapiens
  misc_feature: GYAE6OF01BWXRT.11.10.A10.1.454.CMB.1.raw
  modified_base (199)..(199): a, c, t, g, unknown or other
  misc_feature (199)..(199): n is a, c, g, or t
  modified_base (233)..(233): a, c, t, g, unknown or other
  misc_feature (233)..(233): n is a, c, g, or t
  modified_base (245)..(245): a, c, t, g, unknown or other
  misc_feature (245)..(245): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggaagaaatagtgatgacgcagtctccagcccacctgtctgtgtctaccgaaggggaaacncgcccaccctctccgtgcgagggccagtcaaggngttagttagganactaacgttacgccgtaggtaaccagacaacgaaaccgtggaccgacggtccctccccggtctcctctatccgtagtggtcgcacgtcccgaaccggacgggtccctcgttacgggtccacccccgtaccgtaggtttccgagggtcgggtccggggttcgggtccgtaggggaactacggtttcgtttacccgaaccgtttcctaacccgtaaaccctagttacccgaagtcccgaacggttcccctggaccgttacggttccggttaagtaaagttttacgttttcgaaccgtttaaggtttttactacgttacgtacgaacgtacgttaagttaacgtaaggtaacgtcggccttacgtcgtacggttcgggacgggtacggaacggtagggtcgaagtacgtacggaacggtacgtaagtcgggtacggccgttacgacccgttaacgtacggtttcttaaccggttcccttcgtccgtttcccccg

SEQ ID NO: 292247 - DNA, 547 bp, Homo sapiens
  misc_feature: GYAE6OF01AP866.11.10.A10.1.454.CMB.1.raw
  modified_base (195)..(195): a, c, t, g, unknown or other
  misc_feature (195)..(195): n is a, c, g, or t
  modified_base (364)..(364): a, c, t, g, unknown or other
  misc_feature (364)..(364): n is a, c, g, or t
  modified_base (535)..(535): a, c, t, g, unknown or other
  misc_feature (535)..(535): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccgaggggaaangccaccctctcctgcagggccagtcagagtgtaggagcaacttagcctggtaccagcagaaacctggccaggctcccaggctcctcatctatggtcgcactccaccgagggcccacttcggtttccccagccctagggttccaggttcggcaggtgggtctggacgacnggagttcacttctacaccatccgaacggcctgctagtctgaacgtattttcgacttagtttattacgtgtacagactagtataactaactggaccttcggacgttcggaccgaagggtaccgaggtaggaacgtacaaacgaactggtggctgcaccgatcgtgtcttacnctccgttcccgc

SEQ ID NO: 292248 - DNA, 773 bp, Homo sapiens
  misc_feature: GYAE6OF01CI1E7.11.10.A10.1.454.CMB.1.raw
  modified_base (195)..(195): a, c, t, g, unknown or other
  misc_feature (195)..(195): n is a, c, g, or t
  modified_base (298)..(298): a, c, t, g, unknown or other
  misc_feature (298)..(298): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccgaggggaaanagccaccctctcctgcagggccagtcagagtgttaggagcaacttagcctggtaccagcaagaaacctggaccaggcctccaggcctcctcatctagtggtcncactcccaccgacgggccctacgttcggtttacccagtcctaggttcaggttggcgtaggtgggtctggacgacgtaggtacgtttcaccgttcctaccaaccctaacgtacccgaaccgggtcccttaggaccctaggttaccgttaaggtaaaggttagttttttacggacgtttaaaggtttttacttaacgttcggttaccgaggtaccgtaacggttaccggttaacgttaccgggtaaccgtttacgggtaacctttaccccggtaaccccggttttcccggggaaaccccgtaaacgggggtaccctaaacccgggtaaccgtttaaacgggtaaaaaaccgttttaaaaccgggaacggtttcgggtaaccgggttacccgttacgggacccttaaaccccgttaacgtttcccgttaccggttttaccctttacccgttaaccgtttccccccggtttacccccgg

SEQ ID NO: 292249 - DNA, 740 bp, Homo sapiens
  misc_feature: GYAE6OF01BN8PT.11.10.A10.1.454.CMB.1.raw
  modified_base (269)..(269): a, c, t, g, unknown or other
  misc_feature (269)..(269): n is a, c, g, or t
tcagcgagagataccacgaccggtgctcgatttagcgtcgatctctagggggactgctcaggttacggacccagacggaaccataggaagcccaagcgcagcttctcttcctcctggctactcgtcggcctcccagtagttacgcgacctgggagaaataggtgatgaacggcaggtccaccgagccaccctggtccttggcgtccctcgacggggaaacacgccaccctcgtccgtcgcgtaggggccagtcaagtgtggttaggacnctaacgttagcgtaggtaccagacgacgaacggtggcaggtctaccgaggtcctctacattctaggtggtacgcctactcccaaccgaccggtcccaacgttcgggttacccaggacctaggtcaggtcgacgtaggtggggactacgaacgtacgaaacgttcgttaccaccgttcgaactacctagtaccgaaccggtctacgaccgtagttccgagtaacggttgtttacgacgtttaagtttacgttaagtcggtacgtaagaccgtaagttaacgtaacgttaacggtccgggtaccgttaccggtacgggttaccggtaacggtaaccgggaaccgtaacgggtaaccgggtaacgtaacccgtaaaccgttacgtagggttaaccggcccttacggaaacccgtaccggtacttacccggtttccggtaccctttaccgaccgtttcccggtccccttaaccgg

SEQ ID NO: 292250 - DNA, 711 bp, Homo sapiens
  misc_feature: GYAE6OF01EL9MF.11.10.A10.1.454.CMB.1.raw
  modified_base (240)..(240): a, c, t, g, unknown or other
  misc_feature (240)..(240): n is a, c, g, or t
tcagcgagagataccacgaccggtgctcgatttagcgtcgatctcaggggagctctgagagaggagcccagccctgggattttcaggtgttttcatttggtgatcaggactgaacagagagaactcaccatggagtttgggctgagcgtgtcgttttctgtggctaattttaaaaggtgtccagtgtgaggtgcagctggttggagtcgtgggggagcttggtacagccgtggggggtcncgtgagactcaccgtgtcgcacgcctctggtacttcctaacctttaaacaactaccgccaatcgagtcgtcgggtccgccgtacgggcctaccggaaggggaaggggcgtgggtagtgggtctcgtaggttagttgggtggttaggtgggtaggtagcgagtattacgttcgactacggtaccgtccggtaggaacggggtccggtttacccgaacctactaccctaccgaacggtaacgtaaacgtaaaacttacccgaaaaagtaaaacgttggtaattaggttaaattagtaacgtaactaaaagtcgaaacgtacgtaccgtaggaaggtaccggaccggaacggaacccgaacccgggtacgttaattacgtttaccgtggtaacgggaccgtaaaaggtcggttacgggacttaagttaacggtacggtccgacccggttaaccggtaccgggttggggttaacg

SEQ ID NO: 292251 - DNA, 757 bp, Homo sapiens
  misc_feature: GYAE6OF01DCDC0.11.10.A10.1.454.CMB.1.raw
  modified_base (196)..(196): a, c, t, g, unknown or other
  misc_feature (196)..(196): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggaagaaatagtgatgacgcagtctccagccaccctgtctgtgtctccgaggggaaanagccaccctctcctgcagggccagtcagagtgttaggagactaacttagcctggtaccagcaagaaacctggccaggcctccgaggcctcctcacttctagtggtcgccactcccgaccgacggggccctacgttcggtttcccagtccctaggttcaggtcggcgtagggttcggggtactaggagacgtaggtacgtttacacttcctacacctactaccgaaccgggtccctagtaccgtaggtccgttagtaaacggtttcgtttttacggaccgtttaaggtttttaacgtttaccgttagtaccgtaaggttacgtaaagtttaacttaaacgttaccgttaccgggtaccccgttacgggttacccgggtttacccgggaaccccgggtaaacgggggtaacccggtaagggggttacgggtaaaaccggttaaaccggaaaaccggttaaaccggttgggttaacccgggtacgttacccggtacccgtaacccttagttcccggttacgtttaccctttaccgttaaccttcccccgtttaccccgtacccg

SEQ ID NO: 292252 - DNA, 669 bp, Homo sapiens
  misc_feature: GYAE6OF01BKEI7.11.10.A10.1.454.CMB.1.raw
  modified_base (191)..(191): a, c, t, g, unknown or other
  misc_feature (191)..(191): n is a, c, g, or t
  modified_base (207)..(207): a, c, t, g, unknown or other
  misc_feature (207)..(207): n is a, c, g, or t
  modified_base (292)..(292): a, c, t, g, unknown or other
  misc_feature (292)..(292): n is a, c, g, or t
tcagcgagagataccacgaccggtgctcgatttagcgtcgatctcaggggggaactgctcagttaggacccagacggaaccatggaagccccagcgcagcttctcttcctctgctactctggctcccagatagcactggagaaatagtgatgacgcagtctccagccacctgtctgtgtctcgagggaagngcccacctctcctgcngggccagtcaggagttgtaggatactaacttagcctaggtaccagcaacgtaaacctggccaacgggtcctcccgaggcctcctnactcttagtcggtcgacctactcccgaaccgtacgggccctacgttcggtttacccaggtcccgtagggtttccaggtcggacgtaggttcgggtctaggaacgacgtaggtactttcccgacttacctccaaacctacgtaccggaaccggtcctcggactagttcgtaagtaagttacgttttggaacgtttagttttacgttacgttacgtacgtacgtaactaagttaactaacgttacgtcggtaaccgttccggtacgggttccggaaccggaagggtaccggaaggtacggtaacgtaacgaaacgtacgtggtacgtagtacgacctacgtaactcgttacgttcttactacctttcccgtcccgtacg

SEQ ID NO: 292253 - DNA, 631 bp, Homo sapiens
  misc_feature: GYAE6OF01ARWSY.11.10.A10.1.454.CMB.1.raw
  modified_base (194)..(194): a, c, t, g, unknown or other
  misc_feature (194)..(194): n is a, c, g, or t
  modified_base (232)..(232): a, c, t, g, unknown or other
  misc_feature (232)..(232): n is a, c, g, or t
  modified_base (301)..(301): a, c, t, g, unknown or other
  misc_feature (301)..(301): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccacctgtctgtgtctccgaggggaaancgccaccctctcctgcgagggccagtcagagtgtaggngcaacttagcctggtaccagacaagaaacctggccaggtcctcccgaggtcctcctcatctagtggtcncatcccaccgacgggcctacgttcggttcccagccgtaggttcaggtcggcgtaggtgggtctaggacgacgtaggtacgtttccacttccgtaccaacctagtccgaaaccggtcctaggacctacgtcgtagaagttatttcgacgttagtttacttacgtgtacagtactaagttataacgtaacgtcggtaccgtacggtacgttccggaaccgtaacgggaccgtagggtaacggtaacgtaccgaaaacgtacgttggtacggtctacggccgacctacgttccgttacggttaccttaccgtactttcccgttccccgtaccg

SEQ ID NO: 292254 - DNA, 815 bp, Homo sapiens
  misc_feature: GYAE6OF01DQZHL.11.10.A10.1.454.CMB.1.raw
  modified_base (237)..(237): a, c, t, g, unknown or other
  misc_feature (237)..(237): n is a, c, g, or t
  modified_base (310)..(310): a, c, t, g, unknown or other
  misc_feature (310)..(310): n is a, c, g, or t
tcagcgagagataccacgaccggtgctcgatttagcgtcgatctcgagggggggaactgctcagttaggacccagacggaaccatggaagccccagcgcagcttctcttcctcctgctactctggctcccagatagcactggagaaatagtgatgacgcagtctccagccacctgtctgtgtctccgaggggaaagcgcccaccctctccgtgcgagggccagtcagagtgtagganacaacgttgccgtaggtaccagacaagaacctggaccaggcctccgaggccctcctactatctagtgggtacncactacccgaccggtacgggaccctacgttcggtttacccgaggtaccctagggttcaggtcggtacgtagggttcggggtactagggtaacgaacggtaacggtaccgtttcaaccttacccgtaccaaacccgtaacgtacccggtaaaccggggtcccttaggaccgttaacggttacgttaaggtaaacgttttacgtttttccggaaattttaacggttttttaacttaacgttccgggtaacttacggtaaccttaaaggtttaaatttaaacgttaccggttccgggttaacccgggttaccggggtttaaccccgggttacggggaaaacccggtaaaccgggggttaacggtaacggggttaccgggtaaaacggttaaacccgtaaaaaccgggtaccgggtttagggtcggtaacccgtacggtacccccgttaacgtacgtttacccgttcgtttacccgttaaccttaacccggttcccgttaccccgtacg

SEQ ID NO: 292255 - DNA, 642 bp, Homo sapiens
  misc_feature: GYAE6OF01D3286.11.10.A10.1.454.CMB.1.raw
  modified_base (195)..(195): a, c, t, g, unknown or other
  misc_feature (195)..(195): n is a, c, g, or t
  modified_base (235)..(235): a, c, t, g, unknown or other
  misc_feature (235)..(235): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccgaggggaaancgccaccctctcctgcagggccagtcagagtgttacggancaacttagcctaggtaccagcagaaacctggccaggctccaggcctctcatctatggtgcatccaccgaggccacgttcggttccagcctaggttcagtggctaggtggtctagacgagagtagttcactcgtaccaactactaccgaacgggtccctgcctagtcgttagaacgttattttcgaacgttagttttaattacttcgttacacggtctaaggttaacttaagttaaccgtcgggtacccttacggggtaaccggtttcggaaccgggtaaacgggtaaccggtaacgggtaggtaaacgtaacggtaaaaccgtaacggttggtaccgggtacgtacggtacccaaccgttattaccgttcgtttaccgttacctaaccgttcccgttccccggtaac

SEQ ID NO: 292256 - DNA, 798 bp, Homo sapiens
  misc_feature: GYAE6OF01EL3MG.11.10.A10.1.454.CMB.1.raw
  modified_base (142)..(142): a, c, t, g, unknown or other
  misc_feature (142)..(142): n is a, c, g, or t
  modified_base (196)..(196): a, c, t, g, unknown or other
  misc_feature (196)..(196): n is a, c, g, or t
  modified_base (235)..(235): a, c, t, g, unknown or other
  misc_feature (235)..(235): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactgganaaatagtgatgacgcagtctccagcccaccctgtctgtgtctccgaggggaaancgcccaccctctcctgcagggccagtcagagtgttagancaacttagcctggaccagcagaacctggccaggcctacccaggcctcctacattctagtggtgacacgtcccaccgacgggccctacgttcggtttccccagtcccgtaggttcaggttcggcgtaggttggggtctaggaacgaccgtaggtacgtttccgaccttacctaccgaaaccctagttacccgaaacccgggtcctacggtaccgtaacggttcctaaggtaaacggtttacgttttacgggtacctttaaagggtttttaacctttaaccggttacgttaacctaacgtaaccgttaaaggtttaaactttaaaacggttaaccggttaccggggtaccccgtttaacccggggtaaccggttttacccggggaaacccggtaaacgggggtaaccccggttaaaggggttaaccgggtaaacgggttaaacccgtaaaaaccgggttaacgttggggtaaccggtacgttaacggaccccgttaacctaacggtttaccgttaccggtttacccttaaccccgttacgtttacccccgttcccccggtaaccg

SEQ ID NO: 292257 - DNA, 798 bp, Homo sapiens
  misc_feature: GYAE6OF01A80HP.11.10.A10.1.454.CMB.1.raw
  modified_base (240)..(240): a, c, t, g, unknown or other
  misc_feature (240)..(240): n is a, c, g, or t
  modified_base (291)..(291): a, c, t, g, unknown or other
  misc_feature (291)..(291): n is a, c, g, or t
  modified_base (302)..(302): a, c, t, g, unknown or other
  misc_feature (302)..(302): n is a, c, g, or t
tcagcgagagataccacgaccggtgctcgatttagcgtcgatctcaggggggaactgctcagttaggacccagacggaaccatggaagccccagcgcagcttctcttcctcctgctactctggcctccagatagcactggaagaaatagtgatgacgcagtctccagccaccctgtctgtgtcctccgaaggggaaagcgcccaccctctcctgcgacgggccagtcagagtgttagganctaacttacgcctggtaccagcaagaacctggccaggcctccaggctcctnatctagtggtnacactcccacgacgggcctacgtggtactcccagccgtaggttccaggtcggacgtagggttcggggtacgtacggggaactaggtacggttaccaccgttctaccaacctagtacgaacgccaccggtccttacggacgtacggttacgtaaggtaacgttacgtttttacggtacgtttttaacggttttttaacttcggttaccgtaggtaacgttaaggttaaccgtttaacggttaaccggttccgggttacccccgtttaaccgggtttaacccgtttaccgggttttttacccggggaaccccgggtttaaaccggggggtaaacccgtaaaacggttaaccgggtttaaaaacggtaaaaaccggtttaaacccggtaaaaaccggttaaaccgggtttacgggtaacccgggttaaccgttaccggtaacccgtaaacccgttacggttaacctttaccggttttcccgttaaccgtttaaccccgg

SEQ ID NO: 292258 - DNA, 689 bp, Homo sapiens
  misc_feature: GYAE6OF01AR5QR.11.10.A10.1.454.CMB.1.raw
  modified_base (195)..(195): a, c, t, g, unknown or other
  misc_feature (195)..(195): n is a, c, g, or t
  modified_base (376)..(376): a, c, t, g, unknown or other
  misc_feature (376)..(376): n is a, c, g, or t
  modified_base (384)..(384): a, c, t, g, unknown or other
  misc_feature (384)..(384): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccgaggggaaanacgccaccctctcctgcagggccagtcagagtgttaggagctaacttagcctggtaccagcaagaaaccgtggaccaggtcctcccgaggtcctcctcactctagtcggtcgtcacttcccgaccacggggcctacgttcggtttccccagtccctaggttcaggtcggctaggtgggtcnggagacgngtacgttcactctacacctataccgaacgtcctgactagttacgtagtaagttacgttttcgactttaagttttactacgttaggtactacgtacgtaacgtttaacttaaacgttacggtacggtacccggttacgggtacccggtttaccgggaacccggtaaaacggggtacccgtaaggggtaacgggtaaacggtaaccgaaaaccggttacggttacggtcggttaccgtacgaacccgtaacccgttagttcccgttaggttccgtttaacctacgttccccggtttacccggtaccc

SEQ ID NO: 292259 - DNA, 695 bp, Homo sapiens
  misc_feature: GYAE6OF01C18HA.11.10.A10.1.454.CMB.1.raw
  modified_base (245)..(245): a, c, t, g, unknown or other
  misc_feature (245)..(245): n is a, c, g, or t
  modified_base (491)..(491): a, c, t, g, unknown or other
  misc_feature (491)..(491): n is a, c, g, or t
  modified_base (682)..(682): a, c, t, g, unknown or other
  misc_feature (682)..(682): n is a, c, g, or t
tcagcgagagataccacgaccggtgctcgatttagcgtcgatctcaggggagctctgagagaggagcccagccctgggtattttcaggttgttttctatttggtgatcaggactgaacagagagaactcaccatggagtttggctgagctggtcttttcttgtgtacttatttaaaggtgtccagtgtgaggtgcagctgttggagtcggtgggggagtcgttggtacaggccggtggggggtcncgtgacgacctcacctgtgcacgtcctcgtggtacttacctaaccctttaaacaacctaccgaccaagtcgacgtccggtcggggtcccaccgaggccgtaccggaagggggacggggtcgtggggaggttcggggtctacggtaagggtttagttggggtagggttaggttggggtaggtaagacgtagtaacttaccgtcgacgtacggtaccgtccggtaggaacgggtcccgttacaacctntccctacgaagaactactaaacttacgaaaagtaactgtaatagttaatgtaagaacaaagtcgaactcgccgtagaacggacggaccggacggaaccgaccggtaccgtttaaattcgttcggtaggtacgaacggtaaaggtcggtaccgggattaagttacgttaccggtaaccgtacctaaccgggngggtggggttaac

SEQ ID NO: 292260 - DNA, 690 bp, Homo sapiens
  misc_feature: GYAE6OF01A2O7B.11.10.A10.1.454.CMB.1.raw
  modified_base (194)..(194): a, c, t, g, unknown or other
  misc_feature (194)..(194): n is a, c, g, or t
tcagcgagagataccacgaccggtgctcgatttagcgtcgatctcaggggggaactgctcagttaggacccagacggaaccatggaagccccagcgcagcttctcttcctcctgctactctggctccagatagcactggagaaatagtgatgacgcagtctccagccaccctgtctgtgtctccgaggggaaangcccaccctctcctgcagggccagtcagagtgttaggagcaattagcctaggtaccagcagaacctggccaggcctccaggctcctcatctagtgtgtcactccacgacggacctacgtcggttcccaggtcctaggttcaggtcgacgtaggtgggtctggaacgtacgaggtacttcacctcttaccaacctacgtactaaccgggccttaggacctagtctaggtaaacgttagttttaccggatttaggtttacttacgttacggttactaagtacctaagttaacttaaacgtaaccgttcggtaacccgttccgggtaacgtttacccggggaaccgaaaccgggggtaaccgtaaggggtaacggtaaacggttaacggaaaaacccgtaggttacgggtacgggtaccgttacggaacccgaaaccccgtttagttcccgttaacggttccctttaaccgtaaccgtttcccctaaccccgggttacc

SEQ ID NO: 292261 - DNA, 727 bp, Homo sapiens
  misc_feature: GYAE6OF01DPEWY.11.10.A10.1.454.CMB.1.raw
tcagcgagagataccacgaccggtgctcgatttagcgtcgatctcagggggagctctgagagaggagccccagccctgggattttcaggttgttttcatttggtgatcaggactgaacagagagaactcacatggagtttgggctgagcgtggtcttttcttggtggcttaatttaaaggtgtcagtgtgaggtgcagctggtggagtcggtggggggtacggtcgttaggtacgacggtccgggtggggggtcgcgtgacgtacctccaccgtgtcgacacgtccctcgtggtactttaccctaaacctttaaaccaacctaccgcctagtcggacgtccgtcgggggtcccgccgacgggaccgtaccgggaaggggggaacggggtcggtagggtacgggttgggtctcggtagggtttgttgggtaggggttaggtgggtaggtacggacgtaaggttacttaccgttcggacgtacggtaccgttccgggtagggaaaccgggggtcccggttaaccaccgtactcccgtaccgaagacgtaactaaacgttaaccaaagtaaatgtaattagtaatatacgaataaacgtagaacctggaccgtaggaacgacggaccggaacggtaccgacgggtaccttattacgttcgtagtacggaacgtaaggtacggtccggattaatacgttacggtccgtaccgtaccggtacggtagggtag

SEQ ID NO: 292262 - DNA, 687 bp, Homo sapiens
  misc_feature: GYAE6OF01DF1TM.11.10.A10.1.454.CMB.1.raw
  modified_base (240)..(240): a, c, t, g, unknown or other
  misc_feature (240)..(240): n is a, c, g, or t
  modified_base (319)..(319): a, c, t, g, unknown or other
  misc_feature (319)..(319): n is a, c, g, or t
tcagcgagagataccacgaccggtgctcgatttagcgtcgatctcaggggagctctgagagaggagcccagccctgggattttcaggtgttttcatttggtgatcaggactgaacagagagaactcaccatggagtttgggctgagctggtctttttctgtggcttaattttaaaggtgtccagtgtgaggtgcagctgttggagtcgtgggggagcttggtacaggccgtggggggtcnctgagactcacctgtgcagcctcgtggtacttcctaaccctttaaacaacctacgcctaatgacgtcgtcggggtcccnccgaggcctaccggaagggggacgggctgggaggttgggtctcggtaagggttagttgggtggttaggttgggtaggtaacgcgtaaggtacttaccgttcggacaggtaccgtcccggtaggaaacggggtccccgttacaaccctatcccgtaccgaggaacaactaactaacccgaaaagtaaactaggaattacgtaagtagtacggtaaaccaaagttacgaaacgacgacccgttaaggaacgtacggacccggaacggtaccgaccgggtacccgttaattacgtttcgtgtacgggaacgaaaggtacgttaccgggataagtacgtacgtaccggtacctaaccggtcggttggggtac

SEQ ID NO: 292263 - DNA, 658 bp, Homo sapiens
  misc_feature: GYAE6OF01BIYEH.11.10.A10.1.454.CMB.1.raw
  modified_base (196)..(196): a, c, t, g, unknown or other
  misc_feature (196)..(196): n is a, c, g, or t
  modified_base (235)..(235): a, c, t, g, unknown or other
  misc_feature (235)..(235): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagcccaccctgtctgtgtctccgaggggaaancgcccaccctctcctgcagggccagtcagagtgtaggancaacgttgcctggtaccagcaagaacctggccaggcctccaggctcctcatctatggtgcactcccaccgagggtcctaccgttcgggtttaccccagtcccgtaagggtttccaggtcgggactagggttcgggtctggacgacgtagtacgttccactcgtacaccctataccgaacggtcctggcctacgtctaggtaagttattttcgacttagtttacttacgttgtacagtacctagttaacttaagtaaccgttcggtacccgtacggggttaccgttccggggaaccgtaaacggggaccgtaagggtacggtaaacggtaccggtaaaacgtacggttaggtacgggtacgtacggtcccaacccgttattcccgttacgtccctttactacccgtttcccgtccccggtaccg

SEQ ID NO: 292264 - DNA, 867 bp, Homo sapiens
  misc_feature: GYAE6OF01DR7R7.11.10.A10.1.454.CMB.1.raw
  modified_base (239)..(239): a, c, t, g, unknown or other
  misc_feature (239)..(239): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggaagaaatagtgatgacgcagtctccagccaccctgtctgtcgtctccgaaggggaagacgcccaccctctcctgcagggccagtcagagtggttaggancaactagcctggacagacaacgaaccgtggaccgacggcctacccgaggtcctccctctacttcgtagtggtcgacctactcccgaaccggacgggtccctacgttccggtttaccccgacgtcccgtagggttccaggtcgggtcgtagggttcgggttccgtaggaacgacgtaacggtacgtttaccgaccgttccctaaccaaccctacgttaacccggtaacccgggcccgttacggaccttaacgggtttaccgttaagggtaaacgttttagtttttacgttaacgttttaacgttttttaacgttaccgtttacggttaaccgtaaggtacctttaaaaggtttaacgtttaaaacgtttaacccgggttaccgggttaccccggttaccgggggtttaacccggggtttaacccgggaaacccggggtaaaccggggtaaaccggttaaacgggggtaacggggttaaaacccggttaaaaccggaaaacccgggtttaacgttacccggggttaacggtacccgggttaacgtaccccggtaacccgttacgtttacccggtttacccggtttacctttaaccccgtacccgtttccccgttacccccggttaacccg

SEQ ID NO: 292265 - DNA, 690 bp, Homo sapiens
  misc_feature: GYAE6OF01CNHT4.11.10.A10.1.454.CMB.1.raw
  modified_base (196)..(196): a, c, t, g, unknown or other
  misc_feature (196)..(196): n is a, c, g, or t
  modified_base (237)..(237): a, c, t, g, unknown or other
  misc_feature (237)..(237): n is a, c, g, or t
  modified_base (307)..(307): a, c, t, g, unknown or other
  misc_feature (307)..(307): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggaagaaatagtgatgacgcagtctccagccaccctgtctgtgtctccgaggggaaanacgccaccctctcctgcgacgggccagtcatagtgtagganacaacttacgcctaggaccagcaacgaaacctcggaccaggcctcccgaggcctcctcatctagtcggtncactcccaccgacgggcctacgttcggttccccagtccgtaggttcgaggtcggcgtagggtcgggtctaggacgacgaggtcgttaccacttcctaccaaccctacgtaccgaaccgggtcctggaccgttagttcgtaagtaacgtttagttttacgaaccgttttaagtttttacttaccgttgtaccgtagtaccgtaggtacgttacgttacggacgttaggtacctaccccgttaccggttccgggaacccgaagggacctaaccggtaaggttaacggtaaaaacgttaaccggtaaggtcggtacgggtccttaacggtacctaacccgttacgttccgttacgtttccttaccttcccgtttccccgtaccccg

SEQ ID NO: 292266 - DNA, 631 bp, Homo sapiens
  misc_feature: GYAE6OF01CYUBP.11.10.A10.1.454.CMB.1.raw
  modified_base (198)..(198): a, c, t, g, unknown or other
  misc_feature (198)..(198): n is a, c, g, or t
  modified_base (227)..(227): a, c, t, g, unknown or other
  misc_feature (227)..(227): n is a, c, g, or t
  modified_base (299)..(299): a, c, t, g, unknown or other
  misc_feature (299)..(299): n is a, c, g, or t
tcagcgagagataccacgaccggtgctcgatttagcgtcgatctcagggggggaactgctcagttaggacccagacggaaccatggaagccccagcgcagcttctcttcctcctgctactctggctcccagatagcactggagaaatagtgatgacgcagtctccagccaccctgtctgtgtctccgaagggggaaangcccaccctctcctgcagggccagtcagngtgttaggagctaacttagcctggaccagcaagaaaccgtggccaggcctcccgagcctcctcatctagtgngcactccaccgagggccacgttcggttcccagcctaggttcaggtcgcgaggttgggtctggagacaggtacgtttacaccttcaccacctaacgtccgaacggtccctagcgtacgttacgtaggtaaagtttattttacgacgtttagttttacttaacgtgttaccgagtaccgttaagttaactaaacttaacggtcgggtacccgttccgggtaacggttaccggacgtaaacgggaaccgtagggtaacggaacgtaacgaaacgtacgtacggtcgactagcccgaactagttcttacgttcttacaccttcccgttcccgtacc

SEQ ID NO: 292267 - DNA, 618 bp, Homo sapiens
  misc_feature: GYAE6OF01D5XFY.11.10.A10.1.454.CMB.1.raw
  modified_base (195)..(195): a, c, t, g, unknown or other
  misc_feature (195)..(195): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccgaggggaaanacgccaccctctcctgcagggccagtcgagtagtgtaggagcaacttagcctggtaccagacaaaaccgtggccaggcctcccggctcctacatctagtggtgcacgtccgaccgacgggccgtcgtggtccgtacccaccgtaggttcgaggtcgggcggtcgggtcgtgggactggttcgttccgacttcctacacctagtcagccacgtcctagctagtcgtagtaagttagttttagtacttaagtttattacgtgtacagtactagtatagtacgtcgcctctacgtacggttcgggacggtaacgggaccgtaaggggtcgaacgtacgtacgaaggtaaccgttacgtggttacggacgtcggaccctacctagtttcccgttacgttacctttacgtccgtttcccgttaccccg

SEQ ID NO: 292268 - DNA, 629 bp, Homo sapiens
  misc_feature: GYAE6OF01BAY8V.11.10.A10.1.454.CMB.1.raw
  modified_base (314)..(314): a, c, t, g, unknown or other
  misc_feature (314)..(314): n is a, c, g, or t
tcagcgagagataccacgaccggtgctcgatttagcgtcgatctcaggggagctcgtgagagaggagcccagccctgggattttcaggtgttttcactttggtgatcaggactgaacagagagaactcaccatggagtttgggctgagcgtggcttttctgtggctattttaaaggtgtccagtgtgaggtgcaggctgttggagtccgtgggggacggtcgttggtacgacggcccgtggggggtcgcgtggagactcacctgtgcagcctctggattcacctttaacactaccgccatgagcgtcgggtccnctaggcctccgaggggaacggggcgtgggagtggggtctacgacgggttagttgggtggttacggtgggtgggtagcgtaggtacttacgttcgacacgtacctccggtaggaacgggtcccgttacacctactcctaccgaagacggaactaaacttaccgaaaagaaaattgaattagtatatgacaatgaacagacctggacgacgacccggaaggaccgtacgggacccgttaagttactttcgtgggttacgaacggtaagtacggtcgggactagtacgtacgtcgaccctacggtaccgttggggtac

SEQ ID NO: 292269 - DNA, 756 bp, Homo sapiens
  misc_feature: GYAE6OF01EFKBZ.11.10.A10.1.454.CMB.1.raw
  modified_base (194)..(194): a, c, t, g, unknown or other
  misc_feature (194)..(194): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccgaggggaancgcccaccctctcctgccgagggccagtcagagtgttaggagacaacgttagcctaggtaaccagacaacgaaaccgtcggacccaagggcctccgaggcctcctcattctagtcggtcgactacctcccgaccgaaccggggtccttaccgttccggtttaccccaggtaccttacgggttccaagggtcggtacgtagggttcggggtcgtaggaacgtaccgtaaggtacgtttccaaccgttcctaccaacctacgtaccgaacggtcctcggaccgtagttcgtaagttaacgttagttttacgtaacgtttacgttttaactttccgtacggttactaacggtacgttaaacgtttaacttaaacgttaccggttacgggtacccgttaccgggtaccggttaccgggaaccggaaacgggtaaccggtaacggggttaacggaaaccggtaaaccgaaccgggtaaacgtcggtaccgggtacttaccgaccgtaacccttaagttcccgtttacgttaaccctttccgtaccttttccccggtccccgtaaccg

SEQ ID NO: 292270 - DNA, 654 bp, Homo sapiens
  misc_feature: GYAE6OF01DEJRQ.11.10.A10.1.454.CMB.1.raw
  modified_base (194)..(194): a, c, t, g, unknown or other
  misc_feature (194)..(194): n is a, c, g, or t
  modified_base (298)..(298): a, c, t, g, unknown or other
  misc_feature (298)..(298): n is a, c, g, or t
  modified_base (303)..(303): a, c, t, g, unknown or other
  misc_feature (303)..(303): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtttctccgaggggaangccaccctctcctgcagggccagtcatagtgtaggagctaacttagcctggtaccagcaagaaaccgtggaccaggtcctccgagtcctcctcatctagtggtnctacnccaccgaggcctacgttcggttcccacgccgtaggttccaaggtcggacgtaggttgggtctaggacgtacgagtacgtttccacgttccgtacacccgtaataccgaaccgggtctcggactacgtacgtagtaacgttagttttacgacgtttaagttttacttacgttgtaccgtaagtactaaggttaaattaacgtacgttcggaccgttacgggtaccggttacgggtaccgaaacgggactaagggttaggaaacgttaaccgtaaacgtacggttagtcgggtacctgaccctaacgtacgttccgtcgtttaccttactacgtttcccttcccgcccttaag

SEQ ID NO: 292271 - DNA, 645 bp, Homo sapiens
  misc_feature: GYAE6OF01B5ZWD.11.10.A10.1.454.CMB.1.raw
  modified_base (198)..(198): a, c, t, g, unknown or other
  misc_feature (198)..(198): n is a, c, g, or t
tcagcgagagataccacgaccggtgctcgatttagcgtcgatctcgaggggggaactgctcagttaggacccagacggaaccatggaagccccagcgcagcttctcttcctcctgctactctggctcccagatagcactggagaaatagtgatgacgcagtctccagccaccctgtctgtgtctaccgagggggaaanacgcccaccctctcctgcagggccagtcagagtgtaggatctaacgtgcctggtacagcaagtaacctggacccaggcctccgaggtcctcctcatcgtatggtgcagtcccacgcgggccacgttcggttcccagtccgtaggtcaggtgcaggtggctaggagcagtagttcactcacaccagtacgaaccggtctgacgtacgtcgtagtaacgttgtttagtacgtttagtttaacttcgttagtctagtacgtaaagtaagttaacttaaccggttcgggtaccccgttacggttacccgggttaccgggtaacccggaaagggtaacccggtagggttaacgggaaacgtacggaaaacccggtaagttacgggtacgggaccgttacggacgtaaccgtgtaccgtttacgttccttactacctttccggtacccctacg

SEQ ID NO: 292272 - DNA, 690 bp, Homo sapiens
  misc_feature: GYAE6OF01AEG2C.11.10.A10.1.454.CMB.1.raw
  modified_base (195)..(195): a, c, t, g, unknown or other
  misc_feature (195)..(195): n is a, c, g, or t
  modified_base (235)..(235): a, c, t, g, unknown or other
  misc_feature (235)..(235): n is a, c, g, or t
  modified_base (291)..(291): a, c, t, g, unknown or other
  misc_feature (291)..(291): n is a, c, g, or t
  modified_base (301)..(301): a, c, t, g, unknown or other
  misc_feature (301)..(301): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccgaggggaaanagccaccctctcctgcagggccagtcagagtggttagganacaacgttagcctggtaccgagacacgaaacctggccaggcctccaggcctcctcntctatggtcncactccaccggacgggccctacgttcggtttacccacgtcctaggttcaggttcggcgtaggttggggtctggacgacgtacgtagttccactccgtacaccctacgtaccgaaccggtcctagaccgtacgtacctagggtaaacgtttagttttaggtaccgtttaaagttttacttaccgttagtaccgtagttacgtaacgttaacttaaacgtaacggttcggtacccggttaccgggtacgttaccccgggaacggtaaacggggtaccggaagggttacgggtaaacgttaccgaaaaccgggttacgtagggtaccggtacgtacggaccgaaccgttagttccgtcgttaccttactaccgtttcccccgtacgtacccg

SEQ ID NO: 292273 - DNA, 627 bp, Homo sapiens
  misc_feature: GYAE6OF01D9AAL.11.10.A10.1.454.CMB.1.raw
  modified_base (193)..(193): a, c, t, g, unknown or other
  misc_feature (193)..(193): n is a, c, g, or t
  modified_base (234)..(234): a, c, t, g, unknown or other
  misc_feature (234)..(234): n is a, c, g, or t
tcagcgagagataccacgaccggtgctcgatttagcgtcgatctcgaggggggaactgctcagttaggacccagacggaaccatggaagcccagcgcagcttctcttcctctgctactctggctcccagatagcactggagaaatagtgatgacgcagtctcagccaccctgtctgtgtctccgaggggaaanacgccaccctctcctgcagggccagtcagagtgttaggacnctaacttagcctaggtaccagcaacggtaaacctggacccaggccctaccgagtcctcctagtacttctagtcggtacgacctactacccgaccgacgggtccctacgttcggttaccccgagtcccgtaggttcaggttcggacgtagggtcggtacctaggagtaacgtaaggtcgttacgaccttccgtacaacctacgtaccgaacggtctacggactacgtcgtaagtaagtttcgtttacgacgtttagttttactacgtcgtactagtactaagtaacttacgtacgtcggtccgtacggtaccgttacgaaccgtaaggacgtaggtagaacgtacgaagtgtgtcgatcgacctactgtcttcttactactcttcccgtccacg

SEQ ID NO: 292274 - DNA, 672 bp, Homo sapiens
  misc_feature: GYAE6OF01AWGLD.11.10.A10.1.454.CMB.1.raw
  modified_base (145)..(145): a, c, t, g, unknown or other
  misc_feature (145)..(145): n is a, c, g, or t
  modified_base (339)..(339): a, c, t, g, unknown or other
  misc_feature (339)..(339): n is a, c, g, or t
tcagcgagagataccacgaccggtgctcgatttagcgtcgatctcaggggctgtcgtgatgattgcgtggtgggactctgtcccgctccaaggcacccgctctctgggacgggtgcccccggggtttttggactccgtgggggtnacttagcagccgtctgcttgcagttggacttcccaggccgacagtggtctggcttctggagggtcaggccagagtgtggggtacgtgggagccagcaggaggttccatgagaggcaggacagggccacggacagtcagcttccatgtcgacgcccggagacagaaggtctcgtgggtgtcgttgggttttaggnggggtagaggtagtggactattcgtgcctagttggagttacttacgtactaactactactactagtaggacgtcggtaggggtaccaaacggggtaccgtaacgggtccgtaacccggttcttaccccgtacgaccgtcccgttaccccgaaccgaacggggtccccctaagttccccggttaccccgtttccccgcgggtacccctaccccttacccggtacccgaaacgtacccgcgttaaccccgtcgggtaccggggaccaccgtacggccgtcccggtggcctacggcctacggtcgaaacgtccttaccgtcgtactctcgtcgacg

SEQ ID NO: 292275 - DNA, 804 bp, Homo sapiens
  misc_feature: GYAE6OF01A4AL0.11.10.A10.1.454.CMB.1.raw
  modified_base (177)..(177): a, c, t, g, unknown or other
  misc_feature (177)..(177): n is a, c, g, or t
  modified_base (234)..(234): a, c, t, g, unknown or other
  misc_feature (234)..(234): n is a, c, g, or t
tcagcgagagataccacgaccggtgctcgatttagcgtcgatctcaggggagctctgagagaggagcccagccctgggattttcaggtgttttcatttggtgatcaggactgaacagagagaactcaccatggagtttgggctgagcgtgtcttttctagtgcttaatttaaaggtntccagtgtgaggtgcagctgtggatcgtggggagcttggtacagccgtggggggtcncgtgagactcaccgtgtcgcacgtcctcgtggtacttcctaaccttttaaacaaccttaccgacctagtcggaacgtcgtacggggtcccgaccgaggtcctaccggaagggggtaacggggtcttaggggagggtttcgggtaccgttcgtaagggttaacgttttgggtcggggtttaaggtggggtttacgggaaggtcgtaacgtaaacgtttacccgtttcggacgaaccggtaccgttaccccggtaggtaaaccgggggttaccccggtttaccgtaaccgtaccgttacccgttcccgaaggtaaccgaactaaaccgtttaacccgaaaagttaaaacgtgtaaacttaggtaacgttacttaggaaccttaaagtaaccgggaaacctaacggtacccgtaagggaagaaccccgggttaccggaaaccggtaacgtacccggtaacgtacgtttaactttccgtaggttaacggaaccggttaaacgtcggtaaccgggtaactaaggttaactaaggttacccggtacccggtaaacgtcccggggttagggttaacg

SEQ ID NO: 292276 - DNA, 742 bp, Homo sapiens
  misc_feature: GYAE6OF01BMKAM.11.10.A10.1.454.CMB.1.raw
  modified_base (196)..(196): a, c, t, g, unknown or other
  misc_feature (196)..(196): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatgtgatgacgcagtctccagcccaccctgtctgtgtctccgaaggggaaanacgcccaccctctcctgcagggccagtcagagtgtaggagacacttagcctgtaccagcaagaacctggccacggcctcccgaggctccctcactcgtagtcggtcgaccactcccaccgacggggtccctaccggtttccgggtttaccccacgggtcccgtagggtttaccgacggtcggtacccgtagggttcgggttcgtacggaagtaaccgtacggttaacgttcctacccgttacgtacccgaaaccgtacgttacccggaacccgggtccgttacgtaccggtacgttccgttaaggttaaacggtttactttttacggacgtttaacggtttttacttaccgtttaggtaccgtaacgtctaaggttaacttaagtaccggttacggtcccgttaaccggggtaccggttaccggaaccggtaacgggtaaccggtacgggttacggaaacgtaaccgtaaacggtaacgttcggtaggccttacggacctacgtacgttcgtacgttacctacctccgttcccgtaccccgtaccg

SEQ ID NO: 292277 - DNA, 778 bp, Homo sapiens
  misc_feature: GYAE6OF01BLNBC.11.10.A10.1.454.CMB.1.raw
  modified_base (194)..(194): a, c, t, g, unknown or other
  misc_feature (194)..(194): n is a, c, g, or t
  modified_base (255)..(255): a, c, t, g, unknown or other
  misc_feature (255)..(255): n is a, c, g, or t
tcagcgagagataccacgaccggtgctcgatttagcgtcgatctcgaggggggaactgctcagttaggacccagacggaaccatggaagccccagcgcagcttctcttcctcctgctactctggctcccagatagcactggagaaatagtgatgacgcagtctccagccacctgtctgtgtctcgaggggaacncgccaccctctcctgcgacgggccagtcagtagtggtaggatactaactgcctggtaccancgaacgaacctcggccgaggtcctccgacggcctccgtactatacttagtcggtacgctacctccgaccgaccggtaccctacgttcggtttacccgacggtaccgtacgggttacgtacggtcgggtacggtagggttcggggttcgtacggtaacggtaacgtacggttagttaccgtaccttacccgtacctaaccctacgttaacccggaaccgggttccacggtaccgtaacggtacgttaacgggttaacgtttacgttttcggtaacgttttaacgttttaactttaacgttggttaaccgtaagtaccgttaaacgtttaaacgttaaacgtaaccggttacgggtacccggtttacgggtaccggttaacccgggtacccggtaaacggggtaacccggtaacgggtaaggtaaaccggtaaaccggtaaaccggtaacgttacggtcggtacgcggtaaccacgttccgttacttcggttaccttaccgtaccgtttcccgtacccgttaccg

SEQ ID NO: 292278 - DNA, 888 bp, Homo sapiens
  misc_feature: GYAE6OF01EZKFL.11.10.A10.1.454.CMB.1.raw
tcagcgagagataccacgaccggtgctcgatttagcgtcgatctcaggggagctctgagagaggagcccagccctgggattttcaggtgttttcatttggtgatcaggactgaacagagagaactcaccatggagtttgggctgagctggtctttttctgtggtcttaattttaaaaggtgtccagtgtgaggtgcagctgttggagtcggtggggagtcgttggtacaggtccggtggggggtcgcgtggacgacctcaccgtgtgcagccctgtggtattacctaacctttaaacaactaccgaccagtcgagtcgtcggggtcccgacccgtacgggccgtaccggaagggggaacggggtccggtaggggtaggttcggggttacgtacggtaaggggtttaggtttggggttagggttaggttaggggttggggtagtacggaaggtacgttaccgtttccggacgtaaccggtcccggttaccgggtaacgggtaaccgggggtaccccggtttaccgaacccgtacgttccccgtaccgaaggaacgtaaaccctaaaacgttaacccgaaaaagtaaaacgttggtaaactttagttaaacgttaagtacggtaaaactaaagttaacggaaaccgtaacggtaccccgttaagggaaaccgggaccgggtaaacccggggaaccgggtaaacccgggtaacccggggtaacccgtttaaacgttttaaccgttttaccggttaacgggttaaccgggaaaccgggttaaaacgggttacgggtacccgggggtaaacttaacgggttaaaacggtttccgggtaacccggttaacccccggtttaaaccgggtaacccgggtttaaggggggtttaacg

SEQ ID NO: 292279 - DNA, 802 bp, Homo sapiens
  misc_feature: GYAE6OF01C4UU4.11.10.A10.1.454.CMB.1.raw
  modified_base (520)..(520): a, c, t, g, unknown or other
  misc_feature (520)..(520): n is a, c, g, or t
tcagcgagagataccacgaccggtgctcgatttagcgtcgatctcgaggggggaactgctcagttaggacccagacggaaccatggaacgccccagcgcagcttctcttcctcctgctactctggcctcccagatagcacgtggaagtaaatagtgatgaccgactacgtcctccgacgccctacccgtgtccgtgtcgtccgtaccggaaaggggaaacgtaccgacccctacccttccgtccgttcggaccggtacggggacctaacggtaccgaaggttaggttacggttaaggaaccgtaccgtaaacgttcgccgttaggccgaccagaccgaacgaaccgtcgaccgaacggtccctaccggcgtacccgtcctacgtacgttacgtaggttcggcgacctaccgtacccggacggtacggtaccctaccggtttcccggttacccgacgtaccggttacggtcgtacgggtcggtacggttaggggtcgttacgacggaagtacgtacggttntacccttacgcctaacgaccgtacgtacccgacggtctaccgtagtacgtacgtagtaacgttagttacgtacttagtttacttaacgtcgagtaccgttaataacgttaacgttaaccgttacggtaccggttaccggtaccggttacccggacggtaacccggtaacggtaccgtaagggtaccgtaaaccgacggtaaaacgtcggtacgggtactacggtacctacccgttaagtccgtttaccgttcttaaccgttcccgtcgtttccccgtacccg

SEQ ID NO: 292280 - DNA, 639 bp, Homo sapiens
  misc_feature: GYAE6OF01BLG7J.11.10.A10.1.454.CMB.1.raw
  modified_base (196)..(196): a, c, t, g, unknown or other
  misc_feature (196)..(196): n is a, c, g, or t
  modified_base (297)..(297): a, c, t, g, unknown or other
  misc_feature (297)..(297): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccgaggggaaagngccaccctctcctgcagggccagtcagagtgttaggagcaacttagcctggtaccagacagaacctggccaggcctcccgaggcctcctcatctatggtcncactcccaccgacgggccctacgttcggtttccccaggtcccgtaggtttcaggtcgggtctagggtgggtcgtggaacgacgtaggtacgttccacttcctaccgaaccctacttaccgaacccggtccgttcgacctaggtcgttaagaaggtttacgttttcgtacgtttaagtttttactttaccgtgttacaggtactaagttaataacttacggcggttaccgtcgggtaccggttaccggaccggtaaacgggaccgtaagggtacggaacgtacgaaaccgtaagtggtcggctacgcaccgtattacgtcttaccttatctccgttcccgtac

SEQ ID NO: 292281 - DNA, 692 bp, Homo sapiens
  misc_feature: GYAE6OF01A6VNB.11.10.A10.1.454.CMB.1.raw
  modified_base (195)..(195): a, c, t, g, unknown or other
  misc_feature (195)..(195): n is a, c, g, or t
  modified_base (505)..(505): a, c, t, g, unknown or other
  misc_feature (505)..(505): n is a, c, g, or t
tcagcgagagataccacgaccggtgctcgatttagcgtcgatctcgaggggggaactgctcagttaggacccagacggaaccatggaagcccagcgcagcttctcttcctctgctactctggcctcccagatagcactggagaaatagtgatgacgcagtctccagccacctgtctgtgtctacgaagggaaacncgccacctctcctgcgacggccagtcgagtacgttgtacggactacgtaacgttacggccgtacggtaaccagacgaaacggtaaccgtggaccgacggcctaccgaggtcctcctactacttcgtaagtcggtcgacctaccgtacccgaccggacggtaccctacgtttccggttacccgagtccgtaggtttcgacgggtcgacgtacggtcggtactaggacgtaacacgtacgttaccacgtccttaccgaacctagtacccggaacgtccgtacgactaggtacttaagtaacgtttcgtttanacgtttactttagtactgggtacattacgaagtttaactaacgtcggttcggtaccgttacgggaccgttaaccggaacggttaaacgggaccgttaagggaacggaacctaaacggtaacgacgttgggacgtactacggtacaccgttagttccttcgtaccttatcccgttaacccgctaaccg

SEQ ID NO: 292282 - DNA, 827 bp, Homo sapiens
  misc_feature: GYAE6OF01CC4F3.11.10.A10.1.454.CMB.1.raw
  modified_base (198)..(198): a, c, t, g, unknown or other
  misc_feature (198)..(198): n is a, c, g, or t
tcagcgagagataccacgaccggtgctcgatttagcgtcgatctcagggggggaactgctcagttaggacccagacggaaccatggaagcccagcgcagcttctcttcctcctgctactctggctccagatagcactggaagaaatagtgatgacgcagtcctccacgccaccctgtctgtgtctacgaaggggaaanacgccctaccctctcctagcgacgggtccaggttacaggaggttaggttaagggacgtactaaacgttacgccgttacggtaacacgaccgtaaagaaacccgtcgggacccgaacggtcctacccggaaggcccttacctactacttcctaaggtcggtcgccactacccgaaccggacgggtccctacgttccggtttacccacggtaccgtacgggttcaacggtgggtaccgtagggttcgggtactaggaacgtacgagtacgtctacttaccgacaaccgtctaccggtaccggtcctagtacgtacggttactaggttaaacgttacgttttaggtaacgtttagtttttaacttacggttacgttacgtacggtaacttaagtaaacgttaaccgttaacggtacgggttccgttaaccggggttaccgggttcccgggtaaaaccgggtaaaccggggtaaccggttaacggggtaaacgggtaaaaccgttaaccgggtaaaaacgttaccgggttaaggggtccgggttaacctaacgggttacccgtaaccggttaacttcccgggtttattttaccccttaaccgttccgtttacccccgtttcccggttaacccg

SEQ ID NO: 292283 - DNA, 846 bp, Homo sapiens
  misc_feature: GYAE6OF01BPX6I.11.10.A10.1.454.CMB.1.raw
tcagcgagagataccacgaccggtgctcgatttagcgtcgatctcaggggagctctgagagaggagcccagccctgggattttcaggtgttttcatttggtgatcaggactgaacagagagaactcaccatggagtttgggctgagctggtctttttcttgtggtcttaattttaaaaggtgtccagtgtgaggtgcagctggttgggagtcggtggggggaggtcttgggtacgaggccggtggggggtcgcgtgacgtactcaccgtgtcgcagcctcgtggactttacctaacccttttaaacaacctaccgaccctagtgacggtccgttcggggtcccgaccggacgggtcccgtaccgggaagggggtaacggggggtccgtagggggtaacgggttcggggttctacggtaagggtttaggttttggggttagggggttaagggtttgggggttaggggtaacggtacggtaaggtaactttaccggtttaccggaccgtaaaccggttaccgttaccggggtaacggggtaacccgggggttacccgggtttaccccaaccccgttacgttaccccgtaacccggtaacggtaaaccggtaaaccgtaaaacgttaacccgaaaaaagtaaaaacgttacggtaaagttaacgtttaacgttaagtaacggtaactaaaaggtaacgtaaaccgaacgtcccgtaagggaacggtaacgggaaccggtaacggaacccggaaccggtaccgttaagtttacttcggtggtaacggtaacggaagtaggcggtaactagtaacgttacggacgtacccggtacggtacggtgggttacg

SEQ ID NO: 292284 - DNA, 815 bp, Homo sapiens
  misc_feature: GYAE6OF01AVN48.11.10.A10.1.454.CMB.1.raw
tcagcgagagataccacgaccggtgctcgatttagcgtcgatctcaggggagctctgagagaggagcccagccctgggattttcaggttgttttctatttggtgatcaggactgaacagagagaactcaccatggagtttgggctgagctggtctttttcttgtggtcttaatttaaaaggtgtccagtgtgaggtgcagctgttggagtcgtgggggaggtcttggtacaggtccggtgggggggtcgcgtggacgacctccaccgtgtcgcacgtccctcgtggtacttacctaacctttaaacaacctaccgcctatgacgtcgtcgggtccgccgacggcctccggaaggggaacggggcgtgggtaggtgggtctacggtagggttagttgggtggtaggttgggtagggtagcgtaagtacttacgttcgactacgacccgttccggtagggtaaccggggtcccggtttaccaacccgtacgttccccgtaccggaaaggtaaccgtaaacccgtaaaacctttaacccgaaaaaaggtaaaaacgttggtaaagtttacggttaaatttaagtaacggtaaacctaaaagttaacccggaaaacgtacggtacccggtaagggaacgggaaccggtaacccggggaacgggtaacccggtaacccggttaaccgtttaacgttttaacgtttccggttaaggggtaaccggtaaacggtaaaacgggtaccggttacggggacttaaagttaacggttaccgtacccggtaaccccggttaacccgggttacgggtaggggttaacg

SEQ ID NO: 292285 - DNA, 775 bp, Homo sapiens
  misc_feature: GYAE6OF01D3NEG.11.10.A10.1.454.CMB.1.raw
  modified_base (201)..(201): a, c, t, g, unknown or other
  misc_feature (201)..(201): n is a, c, g, or t
  modified_base (743)..(743): a, c, t, g, unknown or other
  misc_feature (743)..(743): n is a, c, g, or t
tcagcgagagataccacgaccggtgctcgatttagcgtcgatctcgagggggggaactgctcaggttaggacccagacggaaccatggaagccccagcgcagcttctcttcctcctgctactctggcctcccgagactagcactggaagaatagtgatgacgcagtctccagccacctgtctgtgtctaccgaaggggaancgcccaccctctccgtaggccgtagggcccagttccgaaggtagttaggttaaggacgactaaacgtttacggcccttagggtaacccagtccaaacggtaaaaccctgggaccgaacgggcccttacccgaagggtcccttccctacgtacttaccgtagtcgggtacgtacctacgttcccgaaacccggacggggtaccctaaccgtttcggggttttaacccccaacgggtaccccggttaacggggtttacctaagggtccggtaccgtaagggggttcggggttacggtacggaacgtaacgtaacggtaccggtttaccaccgttcctaccgaaccctacgtaccgaacgggtcccctagtcccgtaacgttcccgtaaggtaacgttacgtttcgacttaagtttactacgtcgtactacggtactaagttaactaacgtaacgtccggtaccggtaccggtacgttccggaacggtaacggaacggtaggtaacgtaactaacgaaacgtagtggtacgtagacgcctacgtntacgttcgttacctattccgttcgtccgtacg

SEQ ID NO: 292286 - DNA, 672 bp, Homo sapiens
  misc_feature: GYAE6OF01APLSX.11.10.A10.1.454.CMB.1.raw
  modified_base (196)..(196): a, c, t, g, unknown or other
  misc_feature (196)..(196): n is a, c, g, or t
  modified_base (233)..(233): a, c, t, g, unknown or other
  misc_feature (233)..(233): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcaccggagaaattgtgttgacacagtctccagccaccctgtctttgtctccgagggggaaancgccaccctctcctgcagggccagtcagagtgtaacngctacttacgcctaggtaccaacacgaaaccgtggccagacctcccaggcctcctcatctatgatcgcactccaacgacggtccacgtcggacccaccccagccgtaggttcaggtcgggacgtaggggtcgggtcgtaggggacacggtaccttccacccgtcaccactacgacgaccgacgtaccgtacggtacgtccgtaggtacggttagttttacgtaccgttagttttaaccgttacttacggttacgacgtcgacggttacgttacgtacggtacctaggtaccgtccgtaacccggttaccgggacccgaacgggtaccgaacgtaacggtaacggtaaacgttaaaccgtacggtacggtacggtacgtcgtaccgtacctcgttccgttagttccgtaccttacttcccttaccccgtcctcgttaccg

SEQ ID NO: 292287 - DNA, 687 bp, Homo sapiens
  misc_feature: GYAE6OF01AMP6N.11.10.A10.1.454.CMB.1.raw
  modified_base (180)..(180): a, c, t, g, unknown or other
  misc_feature (180)..(180): n is a, c, g, or t
  modified_base (194)..(194): a, c, t, g, unknown or other
  misc_feature (194)..(194): n is a, c, g, or t
  modified_base (198)..(198): a, c, t, g, unknown or other
  misc_feature (198)..(198): n is a, c, g, or t
  modified_base (205)..(205): a, c, t, g, unknown or other
  misc_feature (205)..(205): n is a, c, g, or t
  modified_base (228)..(228): a, c, t, g, unknown or other
  misc_feature (228)..(228): n is a, c, g, or t
  modified_base (528)..(528): a, c, t, g, unknown or other
  misc_feature (528)..(528): n is a, c, g, or t
tcagcgagagataccacgaccggtgctcgatttagcgtcgatctcaggggagctctgagagaggagcccagccctgggtattttcaggtgttttcatttggtgatcaggactgaacagagagaactcaccatgggagtttgggctgagcgtgtcgtttctaggtggactaatttaaaggntcgagtgtgaggtncagntagtggngtcgtggggagtcgttggtacgnggccggtggggggtcacgtgagtacctccacgtgtggccacgccgttacgtggtacttaccttaacctttaaaccaaccgttacgacctaatcggacgtcggtaccgggtacccgaccgacggcctaccgggaaggggaaccggggtctaggggaggtcgggtaccgtacgtaggtttaggttacgggtggtaggttcggtaggtagccgtagtaacgttctcgacgagtaccgtcggtcggaaccggggcccgtaccgtacaattccgaaccgagaccgataacgtaacaaaagtaacngtaattcgtatatacggactaagtcgaacgtcgtacgaggacggtaccgacgtacggacccgtaacggtaccgttagttacctttgacggttacggaacgaaagtcggtccgggtataacgttaacgtccgtaccgacgtaaccggtcggtagggtacg

SEQ ID NO: 292288 - DNA, 646 bp, Homo sapiens
  misc_feature: GYAE6OF01B8NKZ.11.10.A10.1.454.CMB.1.raw
  modified_base (177)..(177): a, c, t, g, unknown or other
  misc_feature (177)..(177): n is a, c, g, or t
  modified_base (189)..(190): a, c, t, g, unknown or other
  misc_feature (189)..(190): n is a, c, g, or t
  modified_base (194)..(194): a, c, t, g, unknown or other
  misc_feature (194)..(194): n is a, c, g, or t
  modified_base (199)..(199): a, c, t, g, unknown or other
  misc_feature (199)..(199): n is a, c, g, or t
  modified_base (205)..(205): a, c, t, g, unknown or other
  misc_feature (205)..(205): n is a, c, g, or t
  modified_base (218)..(218): a, c, t, g, unknown or other
  misc_feature (218)..(218): n is a, c, g, or t
  modified_base (228)..(228): a, c, t, g, unknown or other
  misc_feature (228)..(228): n is a, c, g, or t
  modified_base (233)..(233): a, c, t, g, unknown or other
  misc_feature (233)..(233): n is a, c, g, or t
  modified_base (240)..(240): a, c, t, g, unknown or other
  misc_feature (240)..(240): n is a, c, g, or t
  modified_base (243)..(243): a, c, t, g, unknown or other
  misc_feature (243)..(243): n is a, c, g, or t
  modified_base (247)..(247): a, c, t, g, unknown or other
  misc_feature (247)..(247): n is a, c, g, or t
  modified_base (274)..(274): a, c, t, g, unknown or other
  misc_feature (274)..(274): n is a, c, g, or t
  modified_base (284)..(284): a, c, t, g, unknown or other
  misc_feature (284)..(284): n is a, c, g, or t
  modified_base (333)..(333): a, c, t, g, unknown or other
  misc_feature (333)..(333): n is a, c, g, or t
  modified_base (496)..(496): a, c, t, g, unknown or other
  misc_feature (496)..(496): n is a, c, g, or t
tcagcgagagataccacgaccggtgctcgatttagcgtcgatctcaggggagctctgagagaggagcccagccctgggattttcaggtgttttcatttggtgatcaggactgaacagagagaactcaccatggagtttgggctgagcggtgtgtttctaggtcgctaatttaaaggngtcagtgtgagnngagntgtgngtcggngggagtcgtgacngcgtggggancaggnacacgcngtnacgnccttgtagtactacctaacctttaaanaccagtaccngtagaacgtcgacgtccggacctaggcctacggaaggccgggactgggngtacggtctacgtaggttgtaggtagtagtcggtaggtacgacgtagtacgtacgtcgacgtaacgtaccgtacggtagggaaaccggtccgttaaccgaacgtactccaaccgtagaacgtactaaacgtacgtaaaagtaactggtaattagaataacganaataacacgaaacgcgtacgtaggtacggacgtaccggtaacgaaccgtacgttaatacgtttacgggtagttacggtaagaacggtaaggacggtaacggtacttaacggaagtttacggacccgtaacgtaacggtcggtggttaacg

SEQ ID NO: 292289 - DNA, 648 bp, Homo sapiens
  misc_feature: GYAE6OF01AF618.11.10.A10.1.454.CMB.1.raw
  modified_base (179)..(179): a, c, t, g, unknown or other
  misc_feature (179)..(179): n is a, c, g, or t
  modified_base (192)..(192): a, c, t, g, unknown or other
  misc_feature (192)..(192): n is a, c, g, or t
  modified_base (194)..(194): a, c, t, g, unknown or other
  misc_feature (194)..(194): n is a, c, g, or t
  modified_base (201)..(201): a, c, t, g, unknown or other
  misc_feature (201)..(201): n is a, c, g, or t
  modified_base (227)..(227): a, c, t, g, unknown or other
  misc_feature (227)..(227): n is a, c, g, or t
tcagcgagagataccacgaccggtgctcgatttagcgtcgatctcagggggaacgtgctcagttaggacccagacggaaccatggaagccccagcgcagcttctcttcctcctgctactctggctcccagatagcactaggagaaatgtgatgacgcagtctcccagcccacctgctgntctcgagggaaancnccacctntccgcaggccagtcagagtgtaggancaattagccttaggaccagcgaacgaacctggcccaaggcctcccgaggcctcctacactctagtggtacgcactcccacgtaacggccctaccttcggtttaccccgagtaccccgtaggtttaccgaggttccggacggtacgtaggggtttcagaacgacgtaggacgtttcgacctctaccacctagtcgaaccgtccgtagcctagtacgtacgtaacggttaattttcgatttaacgtttagttacttacggtaccagtactaacggtattaacgtactggtacccgtcggtacgttacggctaacgggaaccgaggtacggaacgtcgtaaaacgcgttacggacgttacgtaacggccctaaccgtacgttacgtaccggtcttaaccgttaccctgtttcccccgtaacccg

SEQ ID NO: 292290 - DNA, 603 bp, Homo sapiens
  misc_feature: GYAE6OF01AQH1G.11.10.A10.1.454.CMB.1.raw
  modified_base (278)..(278): a, c, t, g, unknown or other
  misc_feature (278)..(278): n is a, c, g, or t
  modified_base (368)..(368): a, c, t, g, unknown or other
  misc_feature (368)..(368): n is a, c, g, or t
  modified_base (372)..(372): a, c, t, g, unknown or other
  misc_feature (372)..(372): n is a, c, g, or t
  modified_base (384)..(384): a, c, t, g, unknown or other
  misc_feature (384)..(384): n is a, c, g, or t
  modified_base (447)..(447): a, c, t, g, unknown or other
  misc_feature (447)..(447): n is a, c, g, or t
  modified_base (590)..(590): a, c, t, g, unknown or other
  misc_feature (590)..(590): n is a, c, g, or t
tcagcgagagataccacgaccggtgctcgatttagcgtcgatctcagggggggaactgctcagttaggacccagacggaaccatggaagccccagcgcagcttctcttcctcctgctactctggctcccagataccaccggagaaattgtgttgacacagtctccggccaccctgtctgcgtctccgtggggaaacagtcaccctctcctgcagggccagtacaaaatattaacactattagcctagtccaacagaacctggacaggctcccagctcncatctatgatgactagtttagggacggaccacgtaggcacgtcccaccgaggttccaggtcggctaggtgggtcgtgggacagtcttcgnttcncaccacgtccgnactccgagacgctagaagttatttcgacttagttttattacgtgttaacaacggtagtcgtanacgagcgaccggtccgtccggacggtaccggttacggaccgaacgggacgtaacgggacgggtaagtaccgaaggaccgaacggttgtccgggactacggaccacgtcttcgtcgttacctcgttcctacccgttccctaccncttacgtggtacg

SEQ ID NO: 292291 - DNA, 827 bp, Homo sapiens
  misc_feature: GYAE6OF01BBWVY.11.10.A10.1.454.CMB.1.raw
tcagcgagagataccacgaccggtgctcgatttagcgtcgatctcagggggctgtcgtgatgattgcggtggtgggactctgtcccgctccgaaggccacccgctctcgtcgggacgggtcgtccccccggggtttttgaccttccgtcggggtcacttagcagccgtctgcttgctaggttcggacctttcccgagggtcccgacgtaggttgggtcctcggcctttccgtcgggacgggggttccacgggtcccaaggaagttcgggtacgggggttaccggtggggaacggcccaggcgtaggtacgggttccaggtaggaggaacgggcaaggaccgacggggacccacggactacgtcgacgtcttccagtggtacgaccggccccggagaaccgaggtaacggttcgtacggttgggtacggtacgttttaggggtttttacggtggggtgaagggtagttagggtactagttcgtcggtacctaggttcggtagtatttacctacgttacctaccttaacctacgtacggtacgggaccgttcggtacgggggacctaaacgggtacctacgggtacctaccgttaccgtaccgtacgacgtccccaaccgtacggaaaccggccgtaccgttccggttacccttccccggtcggttacccttaaccccgtccgttaaccgtaacgtccggtaaccctacccgtcgggtaccgggtcaaaccggtcgggtccccggcgtttaccgggtcgtacccgtccggttacgggtaccgaacggttaccgttacccgttcgtactccggttccgcccgtaaccggg

SEQ ID NO: 292292 - DNA, 766 bp, Homo sapiens
  misc_feature: GYAE6OF01CT61D.11.10.A10.1.454.CMB.1.raw
tcagcgagagataccacgaccggtgctcgatttagcgtcgatctcaggggagctctgagagaggagcccagccctgggattttcaggtgttttcatttggtgatcaggactgaacagagagaactcaccatggtagtttggctgagctggtctttttcttgtggtcttaattttaaaaggtgtccagtgtgaggtgcagctggttggaggtcggtgggggacggtccgttgggtacgacggtccggttgggggggtccgacgtggacggaccttccacccgttgtcgccgacgtccctcgtacgggtactttaccctaacccttttaaaccaaccgtaccgccctaagtcggacgtcggtacggggtcccgaccgacggccgtacccggagggggacggggtcgtgggaggtgggtctacggagggttgttgggtggtaggttggggtaggtagctaagtacttacgtcgacacgtaccgtacggagggtaaccgggtccgttacaaccctactccgtacgaaggtaactaaaccgttaaacgttaaacccgaaaagtaaacgttggaagtttacgtaatagtaacgaacgtaaatacggaactacgggaccgttaggaacgggaccggaccgggaaacggtacccgtaccgggtaacctttagtttacgttcggtacgggaggaaacccggtaagggtaccggtcgggaatttaacgttaggttacggtaccctaccggttacggtaaaccggtggggtttaaac

SEQ ID NO: 292293 - DNA, 826 bp, Homo sapiens
  misc_feature: GYAE6OF01C4JJX.11.10.A10.1.454.CMB.1.raw
  modified_base (227)..(227): a, c, t, g, unknown or other
  misc_feature (227)..(227): n is a, c, g, or t
tcagcgagagataccacgaccggtgctcgatttagcgtcgatctcgagggggggaactgctcagttaggacccagacggaaccatggaagcccagcgcagcttctcttcctcctgctactctggctcccagatagcactggaagaaataggtgatgaacgcagtcctccagccctaccctgttctgtacgttctaccggaagggggaaacacgcccaccctcgtccnggacgacgggccagtcaaggagttgtaacgaccaaaactaacttaggccttagggtaaccaacggacaaacggtaaaacccgtggacccgacggtacctacccgaaggtcctacctcattctagtggtcaccactcccgaacgacgggtccacgtagtacctccaggaccgtagtcaggtcggactagggtcgggtctagggaactaggtacttcacttctaccacgtataccgagacgtacgccgtagtacgtacgtacgtaaggtaacgttttaagttttacgttacgttttaacggttttttaaccgtacggtttaaccgtaacggttaacgttaaacgttaaacgtttaaccgttaaaaccggttacccgggttaaccccgttttaacccggttaacgtttaaccgggtttttaccggggaaacccggtaaccgggggtaaacccgtaaaacggttaaacccgtaaaacgtaaaacccgttaaaccggtaaaaaacccggttaacggttacggggttaacggtacccgttaacggaaaccccgttaacccgttaaacggttccttttaaccgggtcctttaacccgttaaacccg

SEQ ID NO: 292294 - DNA, 714 bp, Homo sapiens
  misc_feature: GYAE6OF01CPSTV.11.10.A10.1.454.CMB.1.raw
  modified_base (150)..(150): a, c, t, g, unknown or other
  misc_feature (150)..(150): n is a, c, g, or t
  modified_base (374)..(374): a, c, t, g, unknown or other
  misc_feature (374)..(374): n is a, c, g, or t
  modified_base (383)..(383): a, c, t, g, unknown or other
  misc_feature (383)..(383): n is a, c, g, or t
tcagcgagagataccacgaccggtgctcgatttagcgtcgatctcaggggcgtgtcgtgatgattgcgtggtgggactctgtcccgctccaaggccacccgctctctgggacgggtcgtccccccggggtttttggactccgtgggggtnacttagcagccgtctgcttgcagttcggacttcccgaggccgacagtggtctggctttcgtggagggtcaggcctaggaagtggtggggtacgtggggagccagcgaggacgggtccagtggagaagggcaggacagggccacggacgagtcgagtccttaccagtcggacgaccggaccccggagaccgaggaggtctcgtgggtgtcggtttgggttttggngggtgaggntggactagttcgtcgcctagttgtagtattactactacttactactacagtcggacgtcgtagggacaacggtccacgtacaccgtctccgtcgaccgtccctaccgaaccggtacggtacccctaggttaccccgttcccttcccccgtacgtacccctaccccgttaccctaccgaacgtaccgtacccgtacccgttacgggtccggggaccctaccggtaccgggtcccgggtacccggttcggggacccgttccgggacccggttagggtaacccgtaaaccggttacccttaccgttaccccttagtcccgtcgtaccggtccgg

SEQ ID NO: 292295 - DNA, 638 bp, Homo sapiens
  misc_feature: GYAE6OF01DGPYP.11.10.A10.1.454.CMB.1.raw
  modified_base (144)..(144): a, c, t, g, unknown or other
  misc_feature (144)..(144): n is a, c, g, or t
  modified_base (198)..(198): a, c, t, g, unknown or other
  misc_feature (198)..(198): n is a, c, g, or t
  modified_base (271)..(271): a, c, t, g, unknown or other
  misc_feature (271)..(271): n is a, c, g, or t
  modified_base (297)..(297): a, c, t, g, unknown or other
  misc_feature (297)..(297): n is a, c, g, or t
  modified_base (494)..(494): a, c, t, g, unknown or other
  misc_feature (494)..(494): n is a, c, g, or t
  modified_base (605)..(605): a, c, t, g, unknown or other
  misc_feature (605)..(605): n is a, c, g, or t
tcagcgagagataccacgaccggtgctcgatttagcgtcgatctcgaggggggaactgctcagttaggacccagacggaaccatggaagccccagcgcagcttctcttcctcctgctactctggctcccagatagcactggaanaaatagtgatgacgcagtctccagccaccctgtctgtgtctccgaaggggaaanacgcccaccctctcctgacgacgggccagtcagtagtggtagagctaacgtagcctggaccagcaagtaaccnggaccaggccctaccgagtcctcctntactctagtcggtgccactacccacggcggaccctacgttcggttccccagcccgtagggttcgagtcggcgtagggttcgggtctaggacgtaacgacggtacgtttacactttcccaactaacctagtaccgaaccggtctacggcgtacgtactagggtaattacgttttagactttagtttacgttacgttanacgtagtactaagttactaaacgtttacgtcgtccgttaacggtcgttacggacgaacggtaccggtaagggcggtaacgtaggaaaccgtagtgggtacgtcgagtaccnctacgtctacgttctacgtctcccgttcctacg

SEQ ID NO: 292296 - DNA, 995 bp, Homo sapiens
  misc_feature: GYAE6OF01A4R5Q.11.10.A10.1.454.CMB.1.raw
tcagcgagagataccacgaccggtgctcgatttagcgtcgatctcgagggagctctgagagaggacgcccacgcccgtgggtattttcgtaggttgttttctagtttggtgatcgaggactagaacgagagagaacctcacgtagtggtaggttggcgtgagtcgttcggtttctttttcgttgtacggtactttaaagttttaaaggtcgtaccgtaggttggtggtaggtcgcgtacggtcgttggttagggtacggttcggggtgggggtacggttcggtttacgggtaccggtacgggtccggggttcgggggtccgtacggtacggtaaccgtacccgttaccgtaccgttggtccgtaccgtaccggtacccgttcggttacgttaaccctttaacccgttaaaacccgtttaaaccgaaaccgttacccgtaacgtacggtacggtaccggttcccgggttaccccgggtaccccgacccggtacccgggtaccggtaaccgggggaacgggggtaacgggtcgggttacgggtacgggttccgggttaccgttacgggttaagggtttacgggtttcgggttaggggttagggttcgggttacggtaaccggtacgtaacggttaaccgttaccggttaccggaaccggttacccgggtaccggttaccgggtaaccgggtacccgggttcccgttaccaccgttaaccgttacccgaaccgtaacggtaaaccgtaaacccgtttaaaccgtaaaaccgtaaaaggttaaacgtagttaacgttaagtaacgtacgtaacgaaacgtaaacgtaacgaaccgtacgtaaccggtaggaaaccggtaccgggaaccggacccggtaacccggaccggtaccgttaacgtttactttacggttaccgtacggtaacggtaaacgaccggtcggtaacccgtagtaacgttaccgtaccggtacccgtaccggtaacggttacggtagg

SEQ ID NO: 292297 - DNA, 776 bp, Homo sapiens
  misc_feature: GYAE6OF01C5VT6.11.10.A10.1.454.CMB.1.raw
  modified_base (222)..(222): a, c, t, g, unknown or other
  misc_feature (222)..(222): n is a, c, g, or t
tcagcgagagataccacgaccggtgctcgatttagcgtcgatctcgaggggggaactgctcagttaggacccagacggaaccatggaacgccccagcgcagcttctccttcctcctgctactctggcctccagatagcacgtaggaagaaatagtagatgacgcagtctcacgccacctgtctgtcgtcgtacggaaggggaaacgcgcccaccctctccgngaccggacgggaccagtacgaaggtaggtaggttaggaactacgtaacgttacgtccgtacggaaccgacgacgtaacggaaccgtcggacccgacggtccctacccggacgtcccttccgtactacgttactaaggtggtaccacctaacccgttcccggaacccgggtaccgggtacccttaaccggtttcccgggttaccccgacggtaccggtacgggttaccgaagggtccgggacgttaggggtcggttagaccggaagtaaccggtggtaacgttccgacctacccgtaacaaccctacgtaaccgggtaccgtccgttaacgaacgttacggttaacggtagtaaaccgtttttgttaaggtacgtttaaagtttctaacggttcaacgtagtaaccgtagttaagtaacgttacgtccgtacggtccggtacgtaccggaaggaacggtaaccgaagggtaacgaaacgtaacgaacccgttaggtcgacggtaccgcgtacctaacgttccgtcgttcttaacgtccctccttcccgtctaccg

SEQ ID NO: 292298 - DNA, 848 bp, Homo sapiens
  misc_feature: GYAE6OF01CNOPF.11.10.A10.1.454.CMB.1.raw
  modified_base (367)..(367): a, c, t, g, unknown or other
  misc_feature (367)..(367): n is a, c, g, or t
  modified_base (595)..(595): a, c, t, g, unknown or other
  misc_feature (595)..(595): n is a, c, g, or t
tcagcgagagataccacgaccggtgctcgatttagcgtcgatctcaggggggaactgctcagttaggacccagacggaaccatggaagccccagcgcagcttctcttcctcctgctactctggcctccagatacgcacgtggaacgaaatggtgactcggacgcgtagtcctaccgacgccctacccttggtctacggtcgtaccgtaccgggaaaggggaaactccgaccccgtacctccgtaccgtaggccggacggggaccctagtacgtaacggttaggtacgtaaggacgtacctaacgtcgaccgtacggaaccagaccaacgacccgtgaccgtacgtcccctacgacgtccttaccgtntaagtcgtagtcggtccacgtaccgacccgacggtaccggtacctaccggttccgtacccgtacggaccggttagttccggaaggtcggacggttcgggtacggttacacgaacggtacgttggtaccttccaacgttccgactaccgtcgaaccggtccggtcacggtacttcggtacttaggtaacgttttcggttctaacgtttaaggttctaaccgtagtaccncgttaattaaacgttacctaaacggttaccgggttcggtacccggttacggggttaacccggtaaaccggaaccgtaacggggttaacccgtaagggggttaaaccccgaacttaaaccgggttacccggaaacggggtttcggaaccttacccggttaaacccgttaccgtacgggtttccccttttaaggtttaaccccccgtttcaaccccgggttttaccccttaaacccccgggttcttaaacccggg

SEQ ID NO: 292299 - DNA, 625 bp, Homo sapiens
  misc_feature: GYAE6OF01EJ8G2.11.10.A10.1.454.CMB.1.raw
  modified_base (198)..(198): a, c, t, g, unknown or other
  misc_feature (198)..(198): n is a, c, g, or t
  modified_base (430)..(430): a, c, t, g, unknown or other
  misc_feature (430)..(430): n is a, c, g, or t
  modified_base (472)..(472): a, c, t, g, unknown or other
  misc_feature (472)..(472): n is a, c, g, or t
  modified_base (611)..(611): a, c, t, g, unknown or other
  misc_feature (611)..(611): n is a, c, g, or t
tcagcgagagataccacgaccggtgctcgatttagcgtcgatctcagggggggaactgctcagttaggacccagacggaaccatggaagcccagcgcagcttctcttcctcctgctactctggcctcccagatagcactggagaaatagtgatgacgcagtcctccagccaccctgtctgtgtctaccgaaggggaancgcccaccctctcctgcgacgggccaggtcgagtaggtgttaaggagactaacgttagcctaggtaccagacgaacgaaaccgtcggaccacggcctccgagtcctacctctattcgtagtggtcgcactccgacgacggcctacgtcgtttcccgacgtccgtacggttcgaggtcggacgtggtggtcaggacgactacggtagtacacctctacactataccgacgtcnctcgtagtctaagattagttcgtagtttagtttactacgttntacgagtactaagtttaactaacgtacggtcggtaccgtacgggttaccggttaacggaccggtaagggtaaccggtaagggacgtaaggtaaccaaaggtacgtacggcgtacgactcaccgtatcgttcttcttacncttcccgtactacg

SEQ ID NO: 292300 - DNA, 737 bp, Homo sapiens
  misc_feature: GYAE6OF01C15GB.11.10.A10.1.454.CMB.1.raw
  modified_base (329)..(329): a, c, t, g, unknown or other
  misc_feature (329)..(329): n is a, c, g, or t
  modified_base (360)..(360): a, c, t, g, unknown or other
  misc_feature (360)..(360): n is a, c, g, or t
  modified_base (418)..(418): a, c, t, g, unknown or other
  misc_feature (418)..(418): n is a, c, g, or t
  modified_base (664)..(664): a, c, t, g, unknown or other
  misc_feature (664)..(664): n is a, c, g, or t
tcagcgagagataccacgaccggtgctcgatttagcgtcgatctcgagggggggaactgctcagttaggacccagacggaaccatggaacgcccagcgcagcttctcttcctctgctactctggcctccagatagcacgtggaagtaaatgtgaactggaacgcagtccaccgagaccctccgtgtctgtcgtcctaccggaaggggaaacacgccctacccttcgccgtgacgacgggcctaggtacgaaggtaggttggtaaggactactaacgttacggccttacggaacagacgaaacgtaaccgtgaccgaaggtccctaccgnggaccttccgtactagtctacggttaggtcnccaccgtaccgaaccggacggtacctacggttcgttacccgagtccggtaaggttcgnggtcggacggtagggtcggttacgaggaacggtaacgtacgtacgttcccacgttaccaaccgtaactacgtaccggaacgtcctaggcgtacgttagtacgtaagtttcgtttacgactttaagtttacgttcgtacgttagacgttaattaacgttaataaacgttaccggacgttaccgggttaaccgggtaacgttccggggaacgtaaaaccggggtgtaacgggtagtaaacccggtaanaaccggtagttcgggatccgtaacggctaccgttacgtcttaccggttactacttaccgtcccgtacgtaacg

SEQ ID NO: 292301 - DNA, 770 bp, Homo sapiens
  misc_feature: GYAE6OF01BUM59.11.10.A10.1.454.CMB.1.raw
  modified_base (156)..(156): a, c, t, g, unknown or other
  misc_feature (156)..(156): n is a, c, g, or t
  modified_base (199)..(199): a, c, t, g, unknown or other
  misc_feature (199)..(199): n is a, c, g, or t
  modified_base (716)..(716): a, c, t, g, unknown or other
  misc_feature (716)..(716): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacncagtctccagcccaccctgtctgtcgtctaccgaaggggaaancgccctaccctctccgtgcgacgggcctagtcaaggtaggttcggttaaggacgtactaaacgttcgccgttacggaacccagtacgaaacgtaaacccgttcgggacccgtacggtccctacccgaggtcctccgtactaacttcgtaggtcggtcacgtaccgttacccgaaccggtaccggtccctacggtttcccgtttacccgaacggtccggtagggttcctaagggtcggaccttaggggtcggttactacggaacggtaactacgggttaccttccgtaaccgttacctacccgtaaccgaaccggttccaaccgggtccgtagacggtaacgtttcgtaaaggttaacgttttagttaccgttaacgtttaacgtttacttaccgtcgaacgtagtaccgtttaaagtaaccttaaggtacgtcggtaccggttacgggtacggttaaccggaaccgggtaacgaacggtaggtacgtaacgtaacgtaacggtaagtcgggtacgtntaccggacccgtaacttacgtctttactccgttattacccttccgtacccgtac

SEQ ID NO: 292302 - DNA, 918 bp, Homo sapiens
  misc_feature: GYAE6OF01DIYDU.11.10.A10.1.454.CMB.1.raw
  modified_base (196)..(196): a, c, t, g, unknown or other
  misc_feature (196)..(196): n is a, c, g, or t
  modified_base (207)..(207): a, c, t, g, unknown or other
  misc_feature (207)..(207): n is a, c, g, or t
  modified_base (236)..(236): a, c, t, g, unknown or other
  misc_feature (236)..(236): n is a, c, g, or t
tcagcgagagataccacgaccggtgctcgatttagcgtcgatctcagggggaactgctcagttaggacccagacggaaccatggaagccccagcgcagcttctcttcctcctgctactctggctcccagatagcactggaagaaatagtgatgacgcagtctcagcccacctgtctgtgtctaccgaggggaaacncgccaccctcnccgtgcgacgggccagtcagagtgtaagnctaacttgcctggacagcaacgtaaccgtcggaccacggtacctcccgacggtcctccgtacactttacgtagtgggtacaccaccgttcccgaaccggtaccggccttaccggtttccgtttacccgaggtccgttaacgggttccgtaggtcggtacgttagggtcggttacgtacgaaggtaacgtaacggttcgttacctaacccgtttacgtacccgaaaccgttacgaaacccggtaacccggggttccctacggtaccgtaaaaccgggtttcccgttaaaggttaaacggttttaccgtttttaaccggtacgtttttaaaccggttttttaacgttttaaaccggttccggtttaacgtaaccggttaaaccggttaaacgttttaaacgtttaaacccgttttaaccggggtaacccggttaaccccggggtttaacccccggggtaaacgggttttttaacccccggggaaccgggttaaaaccgggggttaaacccggttaaaccggggggttaaacgggtaaaacccgggtttaaaacccggaaaaaccgggttaccggtttaacggggaccggtaacgtttaccgggtaccctaacccgttaggtttacccctttcgggttaaccccttttaacgcccccggttttttaccccgccccgtttaaaccg

SEQ ID NO: 292303 - DNA, 872 bp, Homo sapiens
  misc_feature: GYAE6OF01ALRLE.11.10.A10.1.454.CMB.1.raw
  modified_base (143)..(143): a, c, t, g, unknown or other
  misc_feature (143)..(143): n is a, c, g, or t
tcagcgagagataccacgaccggtgctcgatttagcgtcgatctcaggggggaactgctcagttacggacccagacggaaccatggaagccccagcgcagcttctcttcctcctgctactctggctcccagatagcactgganaaatagtgatgacgcagtctccagccacctgtctgtgtctcgaaggggaacacgcccaccctctccgtgaccgacgggccagtcgagtacgtggttacgagcctaaacgttacgccttagggtacccaagaccgaacgtaaacccgtcggaccgtaacggtcccgtcccgaggtccctcccgtacctacgttccttacggtggtaccgtacctaccgtaccccggaaccggtaccggggacccttaccggtttcccggtttaccccgacgttaccgtagggtttacgacggttcggaccgtggtacggttacgaggtaacgtaacgtacgttacgttacctacccttaccttaaccgaaccgtaccggttaccggtaaacccggtcccggtacggtaacgttaccgggttaccgttaacggttaacgtttaacgtttttacgggaaccctttttaaggttttaccgttttaccggtacggtaaccgtttaacgtaaccggtttaaagtttaaccgttaaaccgtttaccgggttacccggtaacccgggttttaccggggtaacccgggtttaccggggaaaccccggttaacggggtaaaccgtaaggggtaacggtaaaccggtacccgtaaaacgggttccgtacgggttccgggtaccaaccggtccctaacggttcctcggttaccggttacccttacgtcccggttaccccgtttccgaaccg

SEQ ID NO: 292304 - DNA, 762 bp, Homo sapiens
  misc_feature: GYAE6OF01BBERX.11.10.A10.1.454.CMB.1.raw
tcagcgagagataccacgaccggtgctcgatttagcgtcgatctcaggggggaactggctcagttaggacccagacggaaccatggaacgcccagcgcagcttctcttcctctgctactctggctccagatagcactggagaaatagtgatgacgcagtctccagcccacctgtctgtgtctccgagggaagcgccaccctctccgtgcgacgggccagtcgagtagtcgttaggacgtactaacgttagccttacggtaccagaccgaaacgtaaccgtcggaccaacggcctacccgaggtacctccgtactacgttacttaggtcggtactaccgtaccgttaacccggaccggtaaccggggtcccttaaccgggttacccgggtttccccacgggttacccggttaaggttacccggaacgggtcggtacggtacgggtttcgggtaacgtacggaacgtacgtacggttaccttaccacccgttacctacgaacccttacgaccggaccgtctcgacgttacgtagttaagtacgtttactttcgtacgtttaaatttcgttcgtagtacgtacggttaataacgttaacttaaccgtacggtccgttacccggttaccgggttaccgtaccgggaaaccggtaacggggtaaccggtaagtaacgggtaacctaacggtaacgtaacgttggtacggtctacccggtactacttacgttaccgtttacgtactttcctcccgttactcccgttag

SEQ ID NO: 292305 - DNA, 835 bp, Homo sapiens
  misc_feature: GYAE6OF01A3Y0B.11.10.A10.1.454.CMB.1.raw
  modified_base (158)..(158): a, c, t, g, unknown or other
  misc_feature (158)..(158): n is a, c, g, or t
tcagcgagagataccacgaccggtgctcgatttagcgtcgatctcagggctgtcgtgatgattgcgtggtgggactctgtcccgctccaaggcacccgctctctgggacgggtcgcccccgggtttttgactcgtggggtgacttagcagccgttctncttgctagttggaccttccaggtccgactaggtggtctggtcttcgtggtacgggtcaggaccagtaagtggtgggtacgtgggacgccagacaggtagggttccagtagagggaaggcaagggtacacgggacacggactggtacacgtcttaccgaatcggaggtacccggccgggaaacgtaccgaaggtaacggtccgtcggttacggggtacgttcgggttttggggtttttacgggtagggggtacggtaagggtacggttagggtaaccgttactttaccgttacggtaccttacggtttaggttacggttaactttaaccgttaacgtaaccttaacttaaaccttacgtacggttacgggtaccggttacgggttacgggggaacgtaaaccggggtaccggttaaccgggttccgaacccgttccgtacccgacgtacccggtaccctacccggaaccggtaaccggcccgttaacgtccccggtttacccgttccccggtacgacccgttacccccgtaccgtaccgaacggtcccgacgtacccgttcggaccggggaacctacggaccggtccccgggaccgttcggccggttaccggtaccgttacggtaccgaaaccggttccctttaaccggtcccgttagtcccgtagttcccggacggg

SEQ ID NO: 292306 - DNA, 683 bp, Homo sapiens
  misc_feature: GYAE6OF01BD3Z3.11.10.A10.1.454.CMB.1.raw
  modified_base (197)..(197): a, c, t, g, unknown or other
  misc_feature (197)..(197): n is a, c, g, or t
  modified_base (293)..(293): a, c, t, g, unknown or other
  misc_feature (293)..(293): n is a, c, g, or t
tcagcgagagataccacgaccggtgctcgatttagcgtcgatctcgagggggaactgctcagttaggacccagacggaaccatggaagccccagcgcagcttctcttcctcctgctactctggctcccagatagcactggagaaatagtgatgacgcagtctccgagccaccctatcctgtgtctccgaggggaaancgccaccctctcctgcagggccagtcagagtgtagagcactagctgtacagcagaacctggccaggcctccgagcctcctcaactcgtatcggtcncactaccaccgacgggtcctacgttcggttcccaggtcccgtaggttcaggtcggcgtaggtcggtactagacggacgtagtacggttccaacttcccgtactaacccgtacttcccggaacccggtccctaggtacccgtaacggtccgtaagtaacgttaacgttttcgaacgtttaaggttttactttaccgtacggttacgtaagtaccgtaaggtttaacttaaacgttaacgttccgggtaccgttaaccgggtaccggtttaccgggtaccggaaacgggtacccgtaaggggtacgtaacggtaacgtaaacgtaacgtcggtacggtaccttacggacctaccgtagtccgttacgtactactaccgttccgtccccgtac

SEQ ID NO: 292307 - DNA, 828 bp, Homo sapiens
  misc_feature: GYAE6OF01ECHIP.11.10.A10.1.454.CMB.1.raw
  modified_base (61)..(61): a, c, t, g, unknown or other
  misc_feature (61)..(61): n is a, c, g, or t
tcagcgagagataccacgaccggtgctcgatttagcgtcgatctcgaggggggaactgctnagttaggacccagacggaaccatggaacgccccagcgcagcttctcttcctctgctactctggcctccagatagctacgtggaagaaatagtgatgacgcagtcctccacgccctaccctgttcgtgtcgtccgtaccggaaggggaaacaccgccctaccctcgtccctggaccgacgggccaagtcgaggtagttgttaagggatactacgttagccgtaggtaaccagacaacgaaccgtcggacccgaggtccctccgaggtccctaccgtcgaactttctaggttcgggtaccgtacaccgtacccgaccggtaccgggtcccttaaccgttcgggttacccacggtccgtacggttacgaggtggacgtgggtcggtacgtggaacgcgtagtccgttacaccttactaccgtaaccgtatacccggtaacgtccggtctacggtaaacgtttcgtaagggtttacgtttagtttacgtaacgttttacgtttaacgtttcgttcggttaaccgtagttaacgttaaacgtttaacttaaccgttaaccggtcccgggtttaccgggtaaccgggtttaccggggttaacccgggaaccgggtaaaacgggttaaccgggtaaggggttaaaccgggaaacgtttaaacccggaaaccgggtttaaacggttgggttacccgggtaagtaccgtaacctaccggtttaacgttcgttttacccgttaacttacccctttacggttcccgtttacccgtacg

SEQ ID NO: 292308 - DNA, 763 bp, Homo sapiens
  misc_feature: GYAE6OF01CY0JU.11.10.A10.1.454.CMB.1.raw
  modified_base (201)..(201): a, c, t, g, unknown or other
  misc_feature (201)..(201): n is a, c, g, or t
  modified_base (240)..(240): a, c, t, g, unknown or other
  misc_feature (240)..(240): n is a, c, g, or t
  modified_base (264)..(264): a, c, t, g, unknown or other
  misc_feature (264)..(264): n is a, c, g, or t
  modified_base (296)..(296): a, c, t, g, unknown or other
  misc_feature (296)..(296): n is a, c, g, or t
tcagcgagagataccacgaccggtgctcgatttagcgtcgatctcagggggggaactgctcagttaggacccagacggaaccatggaagccccagcgcagctttctcttcctcctgctactctggctcccagatagcaactggaagaaatagtgatgacgcagtctccagccaccctgtctgtgtctaccgaaggggaaancgcccaccctctccgtgcagggccagtcagagtgtaggnacaactgctggacagcaagaaccngccagcctccgagcctcgcatcgtagtcggtncactcccgaaccgtacggcctaccgttcggtttacccacggtacctacgggttcaggtcggcgtaaggttcgggtctgaagtacgtagtacgttaccacgttcctaccgaacctagtaaccgtaaccggccgttacggacgttaacgttacgtaaggttaaacgtttacgttttacgtaacgtttaacggttttttaacgttaacgttacggtttaaccgaaggttacgtttaaagttaaacggttaaaaccgtttaacgggttacccgggttacccgtttaccggggttaaccgggtttacccgggaaccgggttaaaccggggtaaaccggtaacggggttacggtaaaacccggtaaccgtaaaaaaccggttacggtacggttaccggtacgttaacgacccgtaacccgtacttaccggtttcttaccttacccgttacccgtttcccgttaccccggaccc

SEQ ID NO: 292309 - DNA, 773 bp, Homo sapiens
  misc_feature: GYAE6OF01BPWDI.11.10.A10.1.454.CMB.1.raw
  modified_base (195)..(195): a, c, t, g, unknown or other
  misc_feature (195)..(195): n is a, c, g, or t
tcagcgagagataccacgaccggtgctcgatttagcgtcgatctcagggggggaactgctcagttaggacccagacggaaccatggaagccccagcgcagcttctcttcctcctgctactctggctcccagatagcactggagaaatgtgatgacgcagtctcagcccaccctgtctgtgtctcgaaggggaaancgccaccctctcctgccgagggccagtcagagtgttaggagctaacgttcgccgttggtaccagacaaggtaaacccgtggacccgaggtccctacccgacggccttaccctcaacttccgtagttcggggtcgtccgtaacctaccccggaaccgacggggtccctaacggttcccggttttaccccaaggtcccgttaaggtttccgaggttcggacgtaggttcgggtcctaggacgtacgtaggttacgttccctaacgttcctaccaccctagttaccccgaacgggtcctagtacccgtagttaccttaggtaaacggttttcttttacggtactttaacgtttttacgttacttacggtacgtacggtacttaagttaaacttaacgttaacgtcggtacccgttcgggaacgtttcccgggaacgttaaaccggggaacgtagggtaaccggtaaacgtaaaccgtaaaccggtaaccggtttaggtaggttacccctagggaccccttaacccgtaccgtttggttaccctttacccggttacttaccctttcccgacccccgttaacg

SEQ ID NO: 292310 - DNA, 737 bp, Homo sapiens
  misc_feature: GYAE6OF01DDT0C.11.10.A10.1.454.CMB.1.raw
tcagcgagagataccacgaccggtgctcgatttagcgtcgatctcaggggggaactgctcagttaggacccagacggaaccatggaagccccagcgcagcttctcttcctcctgctactctggctcccagatagcatggaagaaagtagtgatgacgcagtcctaccagcccacctgtctgtcgtcctacgaaggggaaacacgtccctacccttctccgtgccgagggtacccagtcgaagtaggttaggttaggcgaccgttaaacgttacggccgtagggtaaccaaggaccaacgtaaacccgtcgggaacccaggtccccttaccgacggtccttacctctacttctaaggtcggttacaccgtaaccgtcccgaaaccggtcggggtaccctacggttttacccggttccccaacggtccctacgggtttcacgggtacgtaccgtaaggttcgggtactaggaaccgtacgtacggtcttaccgacttcaaccaccgtaagtaccggacggtcctacggtactacggttaccgtagtaaacgtttgttacgttaacgttagtttaactacgttcgtacgacgtactaacgttaacttaacgtacgtcggttacctaccgggtacgttaccggaacgtacggaacgttagggaggaaacgtacgaaacgtcgtaggtacggtacgtacgccgtacgtagttctcgttacgttactacggttccctcgtacc

SEQ ID NO: 292311 - DNA, 718 bp, Homo sapiens
  misc_feature: GYAE6OF01ERW9A.11.10.A10.1.454.CMB.1.raw
  modified_base (224)..(224): a, c, t, g, unknown or other
  misc_feature (224)..(224): n is a, c, g, or t
tcagcgagagataccacgaccggtgctcgatttagcgtcgatctcgagggggggaactgctcagttaggacccagacggaaccatggaagccccagcgcagcttctcttcctctgctactctggcctccagatagctacgtgggaagtaaattaggtgagtggaccgtcgaacgttcctccacgccctaccgtgttctggttcgtcgtacggaaggggtaaacncgccctacctctccgtgcgacggccagtcgaggtagttagtaggacgtactacgttcgccgacggtacagacgaacgtacgtcggccgaacgtccgtaccgacggtcctcctagctacgtgtggtctacgtctaccgaccgtacgtcccttcgttacgtacccgacgtacgtacggtagtcggtcgtacggtggtacgtcgtaaggtctaacggtacggttatacccgtctacctacgaacttagacccgtagtcgtcgtactacggttactaggttaattcgttacgtaacgtttattacttacgtgactagtaacttagtaatacgtacgtcggtacccgttagggtacccgttgggaaaccgtggggtaactagggttaaaccggtaaagtaaacccgggtaacgtagggtcgttccggaagtacccgtaacgtaacgttccgttaggtttacccgagtttaccccgttacttaacccccggtgtaacccg

SEQ ID NO: 292312 - DNA, 771 bp, Homo sapiens
  misc_feature: GYAE6OF01BCTYJ.11.10.A10.1.454.CMB.1.raw
  modified_base (264)..(264): a, c, t, g, unknown or other
  misc_feature (264)..(264): n is a, c, g, or t
  modified_base (356)..(356): a, c, t, g, unknown or other
  misc_feature (356)..(356): n is a, c, g, or t
  modified_base (732)..(732): a, c, t, g, unknown or other
  misc_feature (732)..(732): n is a, c, g, or t
tcagcgagagataccacgaccggtgctcgatttagcgtcgatctcgaggggggaactgctcagttaggacccagacggaaccagtggaacgcccagcgcagtcttctcttcctcctgctactcgtgcctccagatacgcacgtaggaagaaagtagtagaagtcggaccgacgtacgttccaccgaaccgtcccgtaccgttggttcgttggttcgtacccgtaacgggaaaggggaaacctccgacccctacccttcgtccgngaccggaacgggccagtcgaggtagttcggtaaggactactacgttacgccgtacggtaccagtacgaacggtaccgcgaccgtacggtccnccggtacgtcctccgtactcgttacgtaggtcggtctactacccgacccgaccggtaccggttaccgttacccggttccgtaaccgcggttacccggttaggttacccggagggtacggtcggtaggttaccggtaggtacgaacggtacgtaggtaccgtcaccgtctaactaccgtaccgtaccggtaccgtcgtacgtacgtaaccgttagtaacgttaggttacgtttacgttacgtttaagtttacgtacgttgtacgttacgtagttacgtaaacttacggtaacggtcggtacggtacggaccggtaaccggaacgtaacggaccggtaaggtaacgtacgaacggtacgtacgtacggtacacgtacncgtactcgttacttcgtctaacttccgtaccctcgtacg

SEQ ID NO: 292313 - DNA, 744 bp, Homo sapiens
  misc_feature: GYAE6OF01CCVZ1.11.10.A10.1.454.CMB.1.raw
  modified_base (162)..(162): a, c, t, g, unknown or other
  misc_feature (162)..(162): n is a, c, g, or t
  modified_base (184)..(184): a, c, t, g, unknown or other
  misc_feature (184)..(184): n is a, c, g, or t
  modified_base (197)..(197): a, c, t, g, unknown or other
  misc_feature (197)..(197): n is a, c, g, or t
  modified_base (249)..(249): a, c, t, g, unknown or other
  misc_feature (249)..(249): n is a, c, g, or t
tcagcgagagataccacgaccggtgctcgatttagcgtcgatctcaggggagctctgagagaggagcccagccctgggtattttcgaggttgttttcatttggtgatcaggactgaacagagagaactcaccatggtagttgggctgagcttggtctttttntgtgtacttaattttaaaggtntcagtgtgagtgnagtctgtggagtcgtggggagtcgttggtacgacggcccggttggggggtcncgtaggaacgtacctccgtaccgttggtcgccgtacgtccttcgtaggttacttacctaaacctttaaacaaccgttaaccgactagtcggtaacgtcgttccgggggtcctaccgacggtccgtaccggaaggggacgggtcgtagggtaggtcgggtctacgtaggtttaggtgggttacgttgggttggtaggtagacgtaggtacttaccgttcgacgagttaccgtcggtaaacgggtacgggtcccggttaccaaccgtacgttccctaaccgaagaacgtaactaacgtaacgaaaagtaaagtagtacttagttaagtacttaacgaacgtaaacgaacgaacgacgtaccgtaggacggtacggaccgaacgggacgtaaccggtacgtttacgttacgtttccgacggttaacgaacggtaaacggttggtacccggtataacttagtccggtacgtacccttaccgggtacggtagggttacgg

SEQ ID NO: 292314 - DNA, 757 bp, Homo sapiens
  misc_feature: GYAE6OF01DUBW1.11.10.A10.1.454.CMB.1.raw
  modified_base (197)..(197): a, c, t, g, unknown or other
  misc_feature (197)..(197): n is a, c, g, or t
  modified_base (306)..(306): a, c, t, g, unknown or other
  misc_feature (306)..(306): n is a, c, g, or t
tcagcgagagataccacgaccggtgctcgatttagcgtcgatctcagggggggaactgctcagttaggacccagacggaaccatggaagccccagcgcagcttctcttcctcctgctactctggctcccagatagcactggaagaaatagtgatgacgcagtctccagccaccctgtctgtgtctccgaggggaaanacgccaccctctcctgcagggccagtcagagtgttaggagctacttagcctggtaccagcaacgaaccgtggaccaggcctaccgaggtcctcctcatctagtcggtcnctactcccgaccgacgggcctacgttcggtttcccaggtccgtagggtttcagggtcggacgtagggttcgggtcgtacggacggtaacgaaggtacgttcaccttcctaccgaacctacgtacccgaaccgggtccctacggaccgtacggttacgttaacggtaaacgtttagttttacgtaacgtttaaggtttttaacttaccggttcggtaccgtaaggttactaaacggtttaaactttaaacgttaaccggttcgggtaaccccggttaccgggggtaacccgggtttaccgggaaacccgggtaaacggggtaacccggtaaggggtaacggtaaaccggttaacgaaaccggtaagttcgggtacggtaccgtacggaaccctaccgtacggtttaccgttcgtttacccttacctaaccgtttccccgtacccggtacccg

SEQ ID NO: 292315 - DNA, 937 bp, Homo sapiens
  misc_feature: GYAE6OF01BHN70.11.10.A10.1.454.CMB.1.raw
  modified_base (928)..(928): a, c, t, g, unknown or other
  misc_feature (928)..(928): n is a, c, g, or t
tcagcgagagataccacgaccggtgctcgatttagcgtcgatctcaggggggaactgctcagttaggacccagacggaaccatggaagccccagcgcagcctttctccttcctcctgctactctggctcccagatagcacgtggaagaatagtgatgacgcgagtcctaccacgcccacccttgtctcgtgtacctaccggaaggggaaacaccgtccccacccgttcctccgtcggaccgtacggggacccaaggttcgtaaggtaggttaggttaacggacgtaccgtaaacgtttacggtacccgttacgggtaaccaacggtaacccgaaaacgggtaaaccccgttcggggaccccgtaaccgggttaccccgtaccccggtaacgggttccccttaaccccgttaccggtaaacctttcccggtttaaggtttccgggtaccggtaacccttacccgtaccccggaaacccggttacccggggtacccctttaaccgtttcccggggttttacccccaacgggttaccccggtaaggtttttacggaaccgggttaccgggtaccggttaagggtttcccggggttaacggtacggtaacgggttaacgaacggtttaaccgttccctaccggttacctacccgtacccgtaaccgtacgaccggtccgtaccggacttaccggtactaaggttaacgtttacgtttacgaacgttttagtttaccgtttacgtacggtaacgtaacgtacgtttaagttaaacgttaaccgttaccggtaccggttccggtaaccggttaccgggtaaccgaccgggtaaacggtacggtaacgggtaacgtaaaccgtaacgggtaacgtaacggtcggtacgcgttaccgactacgtacgttacgttcgtacccttagtacctttcccncccggttac

SEQ ID NO: 292316 - DNA, 810 bp, Homo sapiens
  misc_feature: GYAE6OF01CP1K5.11.10.A10.1.454.CMB.1.raw
  modified_base (376)..(376): a, c, t, g, unknown or other
  misc_feature (376)..(376): n is a, c, g, or t
  modified_base (511)..(511): a, c, t, g, unknown or other
  misc_feature (511)..(511): n is a, c, g, or t
tcagcgagagataccacgaccggtgctcgatttagcgtcgatctcgaggggggaactgctcagttacggacccagacggaaccagtggaacgccccagcgcagcctttctccttcctcctcgctaccttctcggcctcccagagtagcaacgtgggaataaagttaggttgaagtggacgactacgtcctaccaccgccctacccgttggtcttggtcgtaccgtaccggaaggggaaacacgcccctacccttcctccgtcgacggaccggcacggtcgaagtggtaggtagactactaacgtcgtacgtacggacacgacaacgacggtcgcgaccgtaccgccgacgtcctcctgtacctacgttgccggtanacccgtaccgtacccgaaccggccggtacccttacggtttcccggttacccgtacggtaccggtcgggtacgtacgggacggtacgtagggttcgtcggaaaggtcgaaccgttaggtactttcccgaccttacncctaaccgaccgttaaccgccgggttctacgtcgtacgttcggttaagtagtttttacgttacgtacgtttacgttttacgtgttaacgccgtagttaacgttaagtttaacacgtttaccggtacggttccccggtaacggggttaccgtacccggggtaccgggtaaaaggtccggaacggggttaacaaaccggtttaacgacccgggtttaaggcggttacggtaaccgtcgacccgttacgtaagtttccgttacccgttcggttaacctttccccgtttcccgtcgtttaccc

SEQ ID NO: 292317 - DNA, 553 bp, Homo sapiens
  misc_feature: GYAE6OF02FZDLJ.11.10.A10.1.454.CMB.1.raw
  modified_base (235)..(235): a, c, t, g, unknown or other
  misc_feature (235)..(235): n is a, c, g, or t
  modified_base (298)..(298): a, c, t, g, unknown or other
  misc_feature (298)..(298): n is a, c, g, or t
tcagcgagagataccacgaccggtgctcgatttagcgtcgatctcaggggagctctgagagaggagcccagccctgggattttcaggtgttttcatttggtgatcaggactgaacagagagaactcaccatggagtttgggctgagcggtgtgtttctaggtcggctatttaaaggtgtcagtgtgagtgcagctgttggagtcgtgggggagcttggtacagcctggggggtcnctgagactcacctgtgcagcctctggattcaccttttaacaactacgccatgagctgggtccnccgaggctccgagggaaggggctgggagtggtctgaggtattgggtggtagtgggtggtacgcgagatacttcgcagacgtccgtggaacgggtccggtcgtaccactctccacgagacaactacaagaaatagtatagtatatagtacaatagaacgagactgagagacgacggacgacgacgtacgtagtttacttgtagtacgaagagtacggtacgtagtagtagtacgtacgtaccgtaccgtgggtagg

SEQ ID NO: 292318 - DNA, 624 bp, Homo sapiens
  misc_feature: GYAE6OF02HN3GL.11.10.A10.1.454.CMB.1.raw
tcagcgagagataccacgaccggtgctcgatttagcgtcgatctcagggggaactgctcagttaggacccagacggaaccatggaagccccagcgcagcttctcttcctcctgctactctggctcccagatagcactggagaaatagtgatgacgcagtctccagccaccctgtctgtgtctccgaaggggaagacgccaccctctcctgcgagggccagtcagagtgttaggagctaacttagccgtggtaccagcaacgaaacctggccaggcctcccgaggcctcctcatctagtggtgcactccaccgagggccacgttcggttcccagcctaggttcaggtggcaggtgggtctgagacagtagttcactctcaccatccgaacggcctgcagtctagaagttatttgcttaggttttattacgtgttacagtctaagttaattaattaacgtcggtaccttacgggtaccgtttccggaccgtaaacggggaacccgtaaagggtacgggtaaacgtaccgaaaacggtaacgttgggtacgggtaccttacggaccgtaacccgtaagtttccgttacggttacctttaccgtaactttcccgttaccccggtaacc

SEQ ID NO: 292319 - DNA, 519 bp, Homo sapiens
  misc_feature: GYAE6OF02H0BFT.11.10.A10.1.454.CMB.1.raw
  modified_base (232)..(232): a, c, t, g, unknown or other
  misc_feature (232)..(232): n is a, c, g, or t
  modified_base (253)..(253): a, c, t, g, unknown or other
  misc_feature (253)..(253): n is a, c, g, or t
  modified_base (292)..(292): a, c, t, g, unknown or other
  misc_feature (292)..(292): n is a, c, g, or t
  modified_base (379)..(379): a, c, t, g, unknown or other
  misc_feature (379)..(379): n is a, c, g, or t
  modified_base (430)..(430): a, c, t, g, unknown or other
  misc_feature (430)..(430): n is a, c, g, or t
tcagcgagagataccacgaccggtgctcgatttagcgtcgatctcaggggagctctgagagaggagcccagccctgggattttcaggtgttttcatttggtgatcaggactgaacagagagaactcaccatggagtttgggctgagcgtgtgtttctaggtggctatttaaaggtgtcagtgtgaggtgcagctgttggagtctgggggagcttggtacagcctgggggtcnctgagctcactgtgcagcctntggattcacctttaacaactacgccatgagctgggtccncaggctccagggagggctggagtgggtctcgaggtattggtggtagtggtgtagcagatactcgcagactccgtgaacgggccgttnaccatctccagagacaattccaaagaaactgatgtatactgcaaatgaacngacctgagagcgagacgacggcgtatattctgtacgagtaagagtcgggactaagtagtacggtcgacccgtaacggaccgtaggggta

SEQ ID NO: 292320 - DNA, 633 bp, Homo sapiens
  misc_feature: GYAE6OF02IBA7Z.11.10.A10.1.454.CMB.1.raw
  modified_base (180)..(180): a, c, t, g, unknown or other
  misc_feature (180)..(180): n is a, c, g, or t
  modified_base (243)..(243): a, c, t, g, unknown or other
  misc_feature (243)..(243): n is a, c, g, or t
  modified_base (266)..(266): a, c, t, g, unknown or other
  misc_feature (266)..(266): n is a, c, g, or t
  modified_base (293)..(293): a, c, t, g, unknown or other
  misc_feature (293)..(293): n is a, c, g, or t
  modified_base (367)..(367): a, c, t, g, unknown or other
  misc_feature (367)..(367): n is a, c, g, or t
tcagcgagagataccacgaccggtgctcgatttagcgtcgatctcaggggagctctgagagaggagcccagccctgggattttcaggtgttttcatttggtgatcaggactgaacagagagaactcaccatggagtttgggctgagcggtgtcgtttctaggtggctaattttaaaaggngtccagtgtgaggtgcagctgttggagtcgtgggggaggcttgggtacagccgtggggggtcnctgaagctcacctgtgcagcctntggattcactttacactacgccatganctgggccgccagggctcccgaggggaagggctgggaggtgggtcgtcgaggtgttggtggtggtggtggtaggngagtagtacgtcgtcgacgacgtcgtacggacgggtccggtccgtaccgtactctaccgacgacgactaactaacaaagaaatagtaagtagtatatagtacaaataagaacgaacgacgtacgaggacggacggaacggaaccggaccggtaccggtaacgttacgtttacgttacggttacggtaacggtaaacggtaacggtacgggtacgtaagttaagttacggtaccggtacccggtaaccggtaccggtacgggtacgg

SEQ ID NO: 292321 - DNA, 511 bp, Homo sapiens
  misc_feature: GYAE6OF02IG15Z.11.10.A10.1.454.CMB.1.raw
  modified_base (194)..(194): a, c, t, g, unknown or other
  misc_feature (194)..(194): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccaggggaaanagccaccctctcctgcagggccagtcagagtgttaggagcaacttagcctggtaccagcagaaacctggccaggctcccaggctcctcatctatggtgcatccaccagggccactggtttcccagccaggttcagtggcagtgggtctgagacagagttcactctcaccatcaacggcctgcagtctgaagtattttgctagttttattacttgtcagcagtataataactggacctcggacgttcggaccgaagggaccaaggtgaagtacaacgacgtgtggctagcaccatctgtcttcacttcctcccgtacc

SEQ ID NO: 292322 - DNA, 500 bp, Homo sapiens
  misc_feature: GYAE6OF02GU7M1.11.10.A10.1.454.CMB.1.raw
  modified_base (193)..(193): a, c, t, g, unknown or other
  misc_feature (193)..(193): n is a, c, g, or t
  modified_base (353)..(353): a, c, t, g, unknown or other
  misc_feature (353)..(353): n is a, c, g, or t
  modified_base (387)..(387): a, c, t, g, unknown or other
  misc_feature (387)..(387): n is a, c, g, or t
tcagcgagagataccacgaccggtgctcgatttagcgtcgatctcagggggaactgctcagttaggacccagacggaaccatggaagccccagcgcagcttctcttcctcctgctactctggctcccagatagcactggagaaatagtgatgacgcagtctccagccaccctgtctgtgtctccaggggaaanagccaccctctcctgcagggccagtcagagtgttaggagcaacttagcctggtaccagcagaaacctggccaggctcccaggctcctcatctatggtgcatccaccagggccactggtttcccagccaggttcagtggcagtgggtctgggacagacttnattctcaccatccgcagcctagacgcctgaagtnttttgctagtttattactgttcaacagcgtagcagcaggcctccggcgacggttcggccgaagggaccaaggtggaagtcaagcgaactgtggctgcacatctgtcttcatcc

SEQ ID NO: 292323 - DNA, 503 bp, Homo sapiens
  misc_feature: GYAE6OF02IDGGW.11.10.A10.1.454.CMB.1.raw
  modified_base (194)..(194): a, c, t, g, unknown or other
  misc_feature (194)..(194): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccaggggaaanagccaccctctcctgcagggcccagtcagagtgttaggagcaacttagcctggtaccagcagaaacctggccaggctcccaggctcctcatctatggtgcatccacagggccactggtttcccagccaggttcagtggcagtgggtctgagacagagttcactctcaccatcaacggcctgcagtctgaagtatttgctagttttattactgtcagctagtataataactggacctggacttcggacaaggacaaggtagaagtacgaacgacgtagtggctagccacatctgtcttcatcctccgtcc

SEQ ID NO: 292324 - DNA, 603 bp, Homo sapiens
  misc_feature: GYAE6OF02GWKJ0.11.10.A10.1.454.CMB.1.raw
  modified_base (196)..(196): a, c, t, g, unknown or other
  misc_feature (196)..(196): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagcccaccctgtctgtgtctccaggggaaagngcccaccctctcctgcagggccagtcagagtgttaggagcaacttagcctggtaccagcagaaacctggccaggctccaggctcctcatctatggtgcatccaccagggccactggttcccagccaggttcagtggcagtggtctgagacagagttcactctacaccgatcgaacggcctgctagtctagaagtatttgactagtttattacgttgtacagtctaagtaataataacgtggtacccgttacgggtaccggtttccggacccgtaaaggggaacccgtaaagggtacgggtaaacgttaaccgaaaccggtaacggttaggtacggtacgtacggtaccgtaacccgtagttccgttacgttacccgtttaccgactttacccgttccccgtaacccg

SEQ ID NO: 292325 - DNA, 511 bp, Homo sapiens
  misc_feature: GYAE6OF02H18ZO.11.10.A10.1.454.CMB.1.raw
  modified_base (194)..(194): a, c, t, g, unknown or other
  misc_feature (194)..(194): n is a, c, g, or t
  modified_base (204)..(204): a, c, t, g, unknown or other
  misc_feature (204)..(204): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccaggggaaanagccaccctntcctgcagggccagtcagagtgttaggagcaacttgcctggtaccagcagaaacctggccaggctcccaggctcctcatctatggtgcatccaccagggccactggtttcccagccaggttcagtggcagtgggtctgagacagagttcactctcaccatcacggctgcagtctgaagtatttgctagtttattacttgtcagctagtataatactggtaccctgggtaccgttcggaccgaagggtaaccgaggtaggaagtacaacggaactggtggctgcacatctgtcttcactccttccgcc

SEQ ID NO: 292326 - DNA, 544 bp, Homo sapiens
  misc_feature: GYAE6OF02GZNCG.11.10.A10.1.454.CMB.1.raw
  modified_base (239)..(239): a, c, t, g, unknown or other
  misc_feature (239)..(239): n is a, c, g, or t
  modified_base (263)..(263): a, c, t, g, unknown or other
  misc_feature (263)..(263): n is a, c, g, or t
  modified_base (336)..(336): a, c, t, g, unknown or other
  misc_feature (336)..(336): n is a, c, g, or t
  modified_base (348)..(348): a, c, t, g, unknown or other
  misc_feature (348)..(348): n is a, c, g, or t
  modified_base (430)..(430): a, c, t, g, unknown or other
  misc_feature (430)..(430): n is a, c, g, or t
  modified_base (435)..(435): a, c, t, g, unknown or other
  misc_feature (435)..(435): n is a, c, g, or t
  modified_base (438)..(438): a, c, t, g, unknown or other
  misc_feature (438)..(438): n is a, c, g, or t
  modified_base (440)..(440): a, c, t, g, unknown or other
  misc_feature (440)..(440): n is a, c, g, or t
  modified_base (449)..(449): a, c, t, g, unknown or other
  misc_feature (449)..(449): n is a, c, g, or t
tcagcgagagataccacgaccggtgctcgatttagcgtcgatctcaggggagctctgagagaggagcccagccctgggattttcaggtgttttcatttggtgatcaggactgaacagagagaactcaccatggagtttgggctgagcgtgtcgtttctaggtggctaatttaaaggtgtcagtgtgaggtgcagctgttggagtcgtgggggaggcttgggtacagccgtggggggtcncgtgagactcacctgtgcagcctntgattcacctttaacaactacgccatgagctgggtccgccaggcctccgagggaaggggctgggagtgggtcngtaggtattggnggtagtggtgtagcagatctcgcagctcgtgaggccggtcacgatctccagacgacaattaccaagtaaaatgaatgtatanacganaananaacacgacngagacgacgacgacgacgacgtagttattcgtagtcgtacgaacgtacggtacggacgtagttagtacgtacgtaccgtacgtaccggtaggtag

SEQ ID NO: 292327 - DNA, 547 bp, Homo sapiens
  misc_feature: GYAE6OF02I4UQI.11.10.A10.1.454.CMB.1.raw
  modified_base (178)..(178): a, c, t, g, unknown or other
  misc_feature (178)..(178): n is a, c, g, or t
  modified_base (261)..(261): a, c, t, g, unknown or other
  misc_feature (261)..(261): n is a, c, g, or t
  modified_base (345)..(345): a, c, t, g, unknown or other
  misc_feature (345)..(345): n is a, c, g, or t
  modified_base (351)..(351): a, c, t, g, unknown or other
  misc_feature (351)..(351): n is a, c, g, or t
  modified_base (369)..(369): a, c, t, g, unknown or other
  misc_feature (369)..(369): n is a, c, g, or t
  modified_base (389)..(389): a, c, t, g, unknown or other
  misc_feature (389)..(389): n is a, c, g, or t
  modified_base (401)..(401): a, c, t, g, unknown or other
  misc_feature (401)..(401): n is a, c, g, or t
tcagcgagagataccacgaccggtgctcgatttagcgtcgatctcaggggagctctgagagaggagcccagccctgggattttcaggtgttttcatttggtgatcaggactgaacagagagaactcacatggagtttgggctgagcggtgtgtttctaggtcggctaatttaaaggtntcagtgtgaggtgcagctgttggagtcgtgggggagcttgggtacagccgtggggggtcgctgagactcacctgtgcagcctntggatttcaaccttttaacaactacgccatgagctgggtccgccagggctccgagggaaggggctgggagtgggtctcgaggtnttgggnggtagtgggtggtacgcnggtatacttcgcagcttcgngacgggtccgtnacatctacagagacaaattccaaagaaatagtagtagtatattagacaatagaacagacctgagagacgacggaacgacggacgtatattctgtgtacgaagaagtcggacgagtagttagtcgtacgtaccgtacggtcggtagg

SEQ ID NO: 292328 - DNA, 580 bp, Homo sapiens
  misc_feature: GYAE6OF02F488W.11.10.A10.1.454.CMB.1.raw
  modified_base (194)..(194): a, c, t, g, unknown or other
  misc_feature (194)..(194): n is a, c, g, or t
  modified_base (233)..(233): a, c, t, g, unknown or other
  misc_feature (233)..(233): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccaggggaaanagccaccctctcctgcagggccagtcagagtgttaggancaacttagcctggtaccagcagaacctggccaggcctccgaggcctcctcatctatggtgcactccacgacgggccacgtcggtttcccagcctaggttcaggtggctaggtcgggtctggagacaggtagttcactctcacctatacgacgcctgcagtctagaagtatttgactagtttattactgtcagtctagttataactacgtcggtaccgtacggtacgttcggaccgtaagggaaccgtaagggtacggaacgtaccgtaaacggtacgtagggtcggtaccgtacggacctaccgtacgttcgttcgttccttacctacgttcccgttccccgtaccg

SEQ ID NO: 292329 - DNA, 543 bp, Homo sapiens
  misc_feature: GYAE6OF02JAP7O.11.10.A10.1.454.CMB.1.raw
  modified_base (395)..(395): a, c, t, g, unknown or other
  misc_feature (395)..(395): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccaggggaaagagccaccctctcctgcagggccagtcagagtgttaggagcaacttagcctggtaccagcagaaacctggccaggctcccaggctcctcatctatggtgcatccaccagggccacgtcggtttcccagccaggttcaggtcggcaggtggtctgagacaggagttcacttctccaccatcaacggcctgcagtctagaagtntttgctagtttattacttgtcagtcagttacggtattcgatcctcgaccgtttcggaccgtaacgggaccaagggtagaaataccgaacgacgtaggtcggactgacctaccattcgttcttaccttacacttcccttacccgtaccc

SEQ ID NO: 292330 - DNA, 532 bp, Homo sapiens
  misc_feature: GYAE6OF02H9E1M.11.10.A10.1.454.CMB.1.raw
  modified_base (236)..(236): a, c, t, g, unknown or other
  misc_feature (236)..(236): n is a, c, g, or t
  modified_base (259)..(259): a, c, t, g, unknown or other
  misc_feature (259)..(259): n is a, c, g, or t
  modified_base (301)..(301): a, c, t, g, unknown or other
  misc_feature (301)..(301): n is a, c, g, or t
  modified_base (360)..(360): a, c, t, g, unknown or other
  misc_feature (360)..(360): n is a, c, g, or t
  modified_base (394)..(394): a, c, t, g, unknown or other
  misc_feature (394)..(394): n is a, c, g, or t
  modified_base (446)..(446): a, c, t, g, unknown or other
  misc_feature (446)..(446): n is a, c, g, or t
tcagcgagagataccacgaccggtgctcgatttagcgtcgatctcaggggagctctgagagaggagcccagccctgggattttcaggtgttttcatttggtgatcaggactgaacagagagaactcaccatggagtttgggctgagcgtgtgtttctaggtggctaatttaaaggtgtcagtgtgaggtgcagctgttggagtcgtgggggagcttggtacagccgtggggggtcncgtgagctcacctgtgcagcctntaggattcaacctttaacaactacgccatgagctggggtccncaggctccgaggggagggctggagtgggtctcgaggtattgggtggtagtggtcggtancagatacttcgcagactcgtgaacgggtccgttnaccatcctcagagacaataccaaagaaatgaattgtatatgactaaatgaanagacctgagagccgaagacacggccgtatattcgtgtgtacgaaagcgtacggctagtatacgtcgaccctaggaccgtgggtaac

SEQ ID NO: 292331 - DNA, 600 bp, Homo sapiens
  misc_feature: GYAE6OF02INY2M.11.10.A10.1.454.CMB.1.raw
  modified_base (238)..(238): a, c, t, g, unknown or other
  misc_feature (238)..(238): n is a, c, g, or t
  modified_base (466)..(466): a, c, t, g, unknown or other
  misc_feature (466)..(466): n is a, c, g, or t
tcagcgagagataccacgaccggtgctcgatttagcgtcgatctcaggggagctctgagagaggagcccagccctgggattttcaggtgttttcatttggtgatcaggactgaacagagagaactcaccatggagtttgggctgagcgtgtcgtttctaggtggctattttaaaaggtgtccagtgtgaggtgcagctgttggagtcgtgggggagcttggtacagcctggggggtcncgtgagactcaccgtgtgcagcctctggattcacctttaacaactacgccatgagctgggtccgcgaggctccgagggaagggctggagtggtctcgaggtattggtggtagtggtgtagcagtatacgttcgcagactccgtaggaacgggtccgttacacctattcctccaagacgactaaacttaccaaagtaaatgaattaggtatatgactaaagtcgaaacngaccgtagacgacggccgaaggaaccggaccggtaccgttaagttagttttccgtaggtacggaacgtaaaaggcgttaccgggactaagttacgtaggttccgacccgttaaccggacccggttagggtaacg

SEQ ID NO: 292332 - DNA, 563 bp, Homo sapiens
  misc_feature: GYAE6OF02HKZ3C.11.10.A10.1.454.CMB.1.raw
  modified_base (194)..(194): a, c, t, g, unknown or other
  misc_feature (194)..(194): n is a, c, g, or t
  modified_base (233)..(233): a, c, t, g, unknown or other
  misc_feature (233)..(233): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccaggggaaanagccaccctctcctgcagggccagtcatagtgttaggancaacttgcctggtaccagcagaacctggccaggctcccaggctcctcatctatggtgcatcccaccgagggccacgttcggtttcccagccaggttcaggtggcaggtgggtctggagacagtagttcactctcaccatcgaacggcctgcagtctagaagtatttgacttagtttattacttgtacagtctaagtataagtacgtcggtaccgttacggtacgttacggaccgtaacgggaaccgtagggtaggtaacgtacgaacgtacgtaggtacggtacgtgacctaccgtagttcttcgtccttactacttccgttcccgtacc

SEQ ID NO: 292333 - DNA, 606 bp, Homo sapiens
  misc_feature: GYAE6OF02II3ZK.11.10.A10.1.454.CMB.1.raw
  modified_base (194)..(194): a, c, t, g, unknown or other
  misc_feature (194)..(194): n is a, c, g, or t
  modified_base (231)..(231): a, c, t, g, unknown or other
  misc_feature (231)..(231): n is a, c, g, or t
  modified_base (304)..(304): a, c, t, g, unknown or other
  misc_feature (304)..(304): n is a, c, g, or t
  modified_base (386)..(386): a, c, t, g, unknown or other
  misc_feature (386)..(386): n is a, c, g, or t
  modified_base (419)..(419): a, c, t, g, unknown or other
  misc_feature (419)..(419): n is a, c, g, or t
tcagcgagagataccacgaccggtgctcgatttagcgtcgatctcagggggaactgctcagttaggacccagacggaaccatggaagccccagcgcagcttctcttcctcctgctactctggctcccagatagcactggagaaatagtgatgacgcagtctccagcccaccctgtctgtgtctccaggggaaangcccacctctcctgcagggccagtcagagtgtaggancaacttgcctggtaccagcaagaaacctggaccaggcctacccgagggccttccctcaattcctagtgggtanacctatacccacgacgggccctaacttcgggttcccaagtccctagggttcaggtcggctaggtcgggtctgaacgacgagngttccactctcactagtcgaacgcctgcagtcngtaatcgtttgctagtttatacgtgttacagtctagttaataagtaactggtacctcggtacgtcggtaccgaacgggtaaccgaaggtaacggaacgtacaaaacggtacttacgggacggtaccgtaggaaccctaccgaagttcgtcggtttactaccgtttaaccttccgttacccccgtacg

SEQ ID NO: 292334 - DNA, 506 bp, Homo sapiens
  misc_feature: GYAE6OF02H0SB8.11.10.A10.1.454.CMB.1.raw
  modified_base (194)..(194): a, c, t, g, unknown or other
  misc_feature (194)..(194): n is a, c, g, or t
  modified_base (204)..(204): a, c, t, g, unknown or other
  misc_feature (204)..(204): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccaggggaaanagtcaccctntcctgcagggccagtcagagtgttaggagcaacttagcctggtaccagcagaaacctggccaggctcccaggctcctcatctatggtgcatccaccagggccactggtttcccagccaggttcagtggcagtgggtctgagacagagttcactctcaccatcaacggcctgcagtctgaagtattttgctagttttattactgtcagcagtataataactggcctcggacgttcggaccaagggccaagggtgaagtacgaacgactggtaggctgcaccatctgtcttcactcctccgtcc

SEQ ID NO: 292335 - DNA, 578 bp, Homo sapiens
  misc_feature: GYAE6OF02H83M8.11.10.A10.1.454.CMB.1.raw
  modified_base (199)..(199): a, c, t, g, unknown or other
  misc_feature (199)..(199): n is a, c, g, or t
  modified_base (240)..(240): a, c, t, g, unknown or other
  misc_feature (240)..(240): n is a, c, g, or t
  modified_base (288)..(288): a, c, t, g, unknown or other
  misc_feature (288)..(288): n is a, c, g, or t
  modified_base (297)..(297): a, c, t, g, unknown or other
  misc_feature (297)..(297): n is a, c, g, or t
  modified_base (373)..(373): a, c, t, g, unknown or other
  misc_feature (373)..(373): n is a, c, g, or t
  modified_base (405)..(405): a, c, t, g, unknown or other
  misc_feature (405)..(405): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctaccgaagggggaaaangccctaccctctcctgcagggccaggtcagagtgttaggancaacttagcctggaccagcagaaacctggccaggcctccaggcctccnatctatggncatcccacagggccacttcggttcccagcctaggttcacgtggcaggtgggtcagacggacagagttccaacttcncaccatccgaacggcctagcagttcagaagtntttgcttagtttatcttgtcagtctaagtataaatactggccgttacggtacgttcggaccgaacgggtaaccggaaacggtagggaaacgttacgaaacgtaacgtaggtacggtcgtagacccgaataccgttctacggttccgttactaccgtttcccttacccgtaccg

SEQ ID NO: 292336 - DNA, 258 bp, Homo sapiens
  misc_feature: GYAE6OF02HDLSW.11.10.A10.1.454.CMB.1.raw
  modified_base (258)..(258): a, c, t, g, unknown or other
  misc_feature (258)..(258): n is a, c, g, or t
tcagcgagagataccacgaccggtgctcgatttagcgtcgatctcagggctgtcgtgatgattgcgtggtgggactctgtcccgctccaaggcacccgctctctgggacgggtgcccccggggtttttggactcctggggtgacttagcagccgtctgcttgcagttggacttcccaggccgacagtggtctggcttctgaggggtcaggccagaatgtgggtacgtgggaggccgagcagagggttccatgaggaan

SEQ ID NO: 292337 - DNA, 926 bp, Homo sapiens
  misc_feature: GYAE6OF02HJDWL.11.10.A10.1.454.CMB.1.raw
tcagcgagagataccacgaccggtgctcgatttagcgtcgatctcgtaggggggtaacgtgctacaaagttaacggacccagtaccggaaccataggaagccccaggcgcagcttctctcctcctgctacgtctggcctcccgaggggtacccacgggtagacgagtagtgctgacgcaggtctccagccaccgtgcgttggtgtctaccaggggacgagagccgtaccctcgtcctcggcggaccgggtccaaggttccgaaggtaccttacgttaaggttaaccaaccgttttacggtcccttaggggttaaccctaacggaacccttaaaaaaaccccgttcggaacctaacggggtaccttacccccgggaccttcccggttaccgtacttacccgttaacggtcgggttcggtaccgaacctaccccgaacccgtaacgggggacccgtcggttacgggttccggttacccccgaacccgggtaacgggtttaaccccgaaacgggttacggggtccgggggtttcggggtccgttacgggggaaacccgttaagggtttccggtttaccgtaaacccgttcccgtttacccgaacccggtaacgttaccgaacggttacccgaacggtcccgttacggaccgtaacggttccgttaacgtaaaacgttaacgttttacgaccgttaacgtttacttacgttcggtacgtaggacgtaacgttactaggtaacgtcggtccgtacgtacgttaccggtttaccgggcgggtaacgggtaaccgtaagggttcgaacgggtacgtaccgtacggtaacccggtaacgtgggtcgggtaaccgtcggtaacccgtaccgtaacgttccgttaccggttcctttaccggtaaccgtttccccgttcccgggtaccgtaaccggg

SEQ ID NO: 292338 - DNA, 514 bp, Homo sapiens
  misc_feature: GYAE6OF02G1ZKU.11.10.A10.1.454.CMB.1.raw
  modified_base (194)..(194): a, c, t, g, unknown or other
  misc_feature (194)..(194): n is a, c, g, or t
  modified_base (395)..(395): a, c, t, g, unknown or other
  misc_feature (395)..(395): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccaggggaaangccaccctctcctgcagggccagtcagagtgttaggagcaacttagcctggtaccagcagaacctggccaggctcccaggctcctcatctatggtgcatcccaccagggcccacgttcggtttcccagccctaggttcaggtggcaggtgggtctggagacaggagttcactctcaccatcaacgcctgcagtctgaagtntttgctagtttattactgtcagctagtataatacgtggcctcggacgttcggaccgaagggaccaaggtgaacgtacgaacgacgtggtggctgcacatctgtcttcacttcctcccgc

SEQ ID NO: 292339 - DNA, 524 bp, Homo sapiens
  misc_feature: GYAE6OF02GDC4B.11.10.A10.1.454.CMB.1.raw
  modified_base (194)..(194): a, c, t, g, unknown or other
  misc_feature (194)..(194): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccaggggaaanagccaccctctcctgcagggccagtcagagtgttaggagcaacttagcctggtaccagcagaaacctggccaggctcccaggctcctcatctatggtgcatccacagggccactggtttcccagccaggttcagtggcaggtgggtctgagacagagttcactctcaccatcaacggcctgcagtctgaagtattttgctagtttattactgtcagctagtataataacgtggccttacggacgttccggaccgaagggaccaaggtggaacgtacgaacgacgtggtggactgacaccgtatctcgttcttcacttccgtcccgtaccc

SEQ ID NO: 292340 - DNA, 760 bp, Homo sapiens
  misc_feature: GYAE6OF02G8DKJ.11.10.A10.1.454.CMB.1.raw
  modified_base (188)..(188): a, c, t, g, unknown or other
  misc_feature (188)..(188): n is a, c, g, or t
  modified_base (368)..(368): a, c, t, g, unknown or other
  misc_feature (368)..(368): n is a, c, g, or t
tcagcgagagataccacgaccggtgctcgatttagcgtcgatctctaggggggtaacgtgactcagttaggaccctaggaccggaaccagtacggaagccccgaagcccgcgacgcttctcctttcccttcccttcgcctactcctggcctcccgacgactagcacctagggagaaatagtgatgacncagtctccagccaccctgtcttgtcgtctcggaacggggaagacgccctaccctcctcctcgcggaccgggaccacgtcgagtagtacgttacggagtacaccttacgcctacggtaaccaacgcgaacgaaccgtcggtcccacggccctccaggtccttacctcactctatcggtacnccacgtcccaccgtacgggcctacgttccggttccacgtacccgtaggtcacgggtggcgtagggtcggtcgtagacggtactagtacgttcacctcctacaccactcgaaccggacctcgacgtacgtacgttaaggtaagtttagtttactacgtttaacgttttacttacgttacgtacctaaggtccgtaacgttaacgtaacgtaaccgttaccgggggtaccctttaccgggtaccggttcccgggaaccggtaaacgggtaaccgtaagggtaaccggaacgttaaccgaaacggtaccgtaggggtccggacgttaccggacctacccgttagttacccgtttcgtttacccgttacttacccgtttccccgtcccgtaacccg

SEQ ID NO: 292341 - DNA, 512 bp, Homo sapiens
  misc_feature: GYAE6OF02HC1MM.11.10.A10.1.454.CMB.1.raw
  modified_base (194)..(194): a, c, t, g, unknown or other
  misc_feature (194)..(194): n is a, c, g, or t
  modified_base (294)..(294): a, c, t, g, unknown or other
  misc_feature (294)..(294): n is a, c, g, or t
  modified_base (403)..(403): a, c, t, g, unknown or other
  misc_feature (403)..(403): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccaggggaaanagccaccctctcctgcagggccagtcagagtgttaggagcaacttagcctggtaccagcagaaacctggccaggcctcccaggcctcctcatctatggtncactcccaccgagggccacgttcggtttcccagcctaggttcaggtggctaggtcggggtctggagacagagttcactctcaccatccgaacgctgctagtctagagtntttgcttagtttattactgtcagctagtataatactgacctggacgtcgacgaacggacaaggtgagtacgaacgacgtggtcgctgcacatctgtctctactctcctc

SEQ ID NO: 292342 - DNA, 506 bp, Homo sapiens
  misc_feature: GYAE6OF02G2LCP.11.10.A10.1.454.CMB.1.raw
  modified_base (194)..(194): a, c, t, g, unknown or other
  misc_feature (194)..(194): n is a, c, g, or t
  modified_base (378)..(378): a, c, t, g, unknown or other
  misc_feature (378)..(378): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccaggggaaanagccaccctctcctgcagggccagtcagagtgttaacagctacttagcctggtaccaacagaaacctggccagactcccaggctcctcatctatgatgcatccaacagggccactggcaccccagccaggttcagtggcagtgggtctgggacagacttcactctcaccatcagcacgcctagngcctgagtatttgctagtttattactgtcagcagctatcgacgtgactctaccgttcgaccgaaggacacgacgtaggaaattaacgaacgttgtggactagaccacacttcttgtacttcacttccc

SEQ ID NO: 292343 - DNA, 517 bp, Homo sapiens
  misc_feature: GYAE6OF02IDC92.11.10.A10.1.454.CMB.1.raw
  modified_base (195)..(195): a, c, t, g, unknown or other
  misc_feature (195)..(195): n is a, c, g, or t
  modified_base (362)..(362): a, c, t, g, unknown or other
  misc_feature (362)..(362): n is a, c, g, or t
  modified_base (390)..(390): a, c, t, g, unknown or other
  misc_feature (390)..(390): n is a, c, g, or t
  modified_base (428)..(428): a, c, t, g, unknown or other
  misc_feature (428)..(428): n is a, c, g, or t
tcagcgagagataccacgaccggtgctcgatttagcgtcgatctcagggggggaactgctcagttaggacccagacggaaccatggaagccccagcgcagcttctcttcctcctgctactctggctcccagatagcactggagaaatagtgatgacgcagtctccagccaccctgtctgtgtctccaggggaaanagccaccctctcctgcagggccagtcagagtgttaggagcaacttagcctggtaccagcaaaaacctggccaggctccccggctcctcatctatggtgcatccaccgagggccgctggtcgtcccaccaggttcaggtggcggtgggtctgggacagtgttcactcncaccatcagcagcctgcagtctgaagtntttgctagtttatactgtcagcagtatagtagtgccgntcacgtttcggcggaggacctaaggtggagagtcagacgtacgtggtggctgaccacgtattcgtcgttcttctacttccgttaccccg

SEQ ID NO: 292344 - DNA, 548 bp, Homo sapiens
  misc_feature: GYAE6OF02HI2YW.11.10.A10.1.454.CMB.1.raw
  modified_base (193)..(193): a, c, t, g, unknown or other
  misc_feature (193)..(193): n is a, c, g, or t
  modified_base (405)..(405): a, c, t, g, unknown or other
  misc_feature (405)..(405): n is a, c, g, or t
tcagcgagagataccacgaccggtgctcgatttagcgtcgatctcagggggaactgctcagttaggacccagacggaaccatggaagccccagcgcagcttctcttcctcctgctactctggctcccagatagcactggagaaatagtgatgacgcagtctccagccaccctgtctgtgtctccaggggaaanagccaccctctcctgcagggccagtcagagtgttaggagcaacttagcctggtaccagcagaaacctggccaggctcccaggctcctcatctagtggtgcatcccaccgagggccacgttcggttcccagcctaggttcaggtggctaggtgggtctggacgacagtacgttcactctaccacctatccgaacggcctgcagtctagaagtntttgcttagtttattacttgtcagtcagttataatacgtcggtaccttcggtacgttccggacgtaacgggaccgtaaggtaggaacgtacgaacgtacgtggtaggctagcctacatcgtcgtcttcacttccgttcccgtc

SEQ ID NO: 292345 - DNA, 572 bp, Homo sapiens
  misc_feature: GYAE6OF02GFXI4.11.10.A10.1.454.CMB.1.raw
  modified_base (340)..(340): a, c, t, g, unknown or other
  misc_feature (340)..(340): n is a, c, g, or t
  modified_base (507)..(507): a, c, t, g, unknown or other
  misc_feature (507)..(507): n is a, c, g, or t
tcagcgagagataccacgaccggtgctcgatttagcgtcgatctcaggggctgtcgtgatgattgcgtggtgggactctgtcccgctccaaggcacccgctctctgggacgggtgccccccggggtttttggactcctgggggtgacttagcagccgtctgcttgcagttggacttcccaggccgacagtggtctggcttctgaggggtcaggccagaatggtggggtacgtgggaggccagcaggagggttccatgagaagggcagggacagggccacggacagtcagcttccatgtgacgcccggagacagaaggtctctgggtggctgggtttttgnggggtgaggatgggacagttctgccattgtgattactactactactactacatggacgtctggggcaaagggaccacggtcaccgtctcctcacgcctccaccaacgggcccagtccggtctcccctggccaccctccgtccaacgacgcacctcgtcggggcacgnggccggcccgtgggctcggcccgtgggtaccaaggtacttaccgttccgtatccgttctcgtccg

SEQ ID NO: 292346 - DNA, 524 bp, Homo sapiens
  misc_feature: GYAE6OF02JI5BG.11.10.A10.1.454.CMB.1.raw
  modified_base (194)..(194): a, c, t, g, unknown or other
  misc_feature (194)..(194): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccaggggaaanagccaccctctcctgcagggccagtcagagtgttaggagcaacttagcctggtaccagcagaaacctggccaggctcccaggctcctcatctatggtgcatccaccagggccactggtttcccagccaggttcagtggcagtgggtctgagacagagttcactctcaccatcaacggcctgcagtctgaagtatttgctagtttattactgtcagcagtataattactggtacctcggtacgttcggaccgaacgggaccaaggtaggaacgtacgaacgtaacgtggtcggactgcaccagtcgtcgtcttcgtacttccttcccgtac

SEQ ID NO: 292347 - DNA, 591 bp, Homo sapiens
  misc_feature: GYAE6OF02HJ7TM.11.10.A10.1.454.CMB.1.raw
  modified_base (197)..(197): a, c, t, g, unknown or other
  misc_feature (197)..(197): n is a, c, g, or t
  modified_base (294)..(294): a, c, t, g, unknown or other
  misc_feature (294)..(294): n is a, c, g, or t
  modified_base (373)..(373): a, c, t, g, unknown or other
  misc_feature (373)..(373): n is a, c, g, or t
  modified_base (403)..(403): a, c, t, g, unknown or other
  misc_feature (403)..(403): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagcccaccctgtctgtgtctccgaaggggaaancgccaccctctcctgcagggccagtcatagtgttaggagactaacttgcctaggtaccagcagaaacctggccaggcctccaggctcctcatctagnggtgcatccacgagggccacgtcggtttcccagtccaggttcagtggcaggtgggtctgacgacagtacgttcacttcncacctatcaacggctgctagtctggaagtntttcgcttagttttactacgttgtcagtctaagtaataattaacgtcggtaccttacggtacgttccggaccgtaaacgggaccgtaagggtacgaacgtacgaaacgtacgttgggtaacggtcgtacgactaaccgtagttcgttacggttcctttaccgtaacgtttcccgttaccccgtaaccg

SEQ ID NO: 292348 - DNA, 564 bp, Homo sapiens
  misc_feature: GYAE6OF02JLZ9G.11.10.A10.1.454.CMB.1.raw
  modified_base (193)..(193): a, c, t, g, unknown or other
  misc_feature (193)..(193): n is a, c, g, or t
  modified_base (395)..(395): a, c, t, g, unknown or other
  misc_feature (395)..(395): n is a, c, g, or t
tcagcgagagataccacgaccggtgctcgatttagcgtcgatctcagggggaactgctcagttaggacccagacggaaccatggaagccccagcgcagcttctcttcctcctgctactctggctcccagatagcactggagaaatagtgatgacgcagtctccagccaccctgtctgtgtctccaggggaaangccacctctcctgcagggccagtcagagtgttaggagcaacttagcctggtaccagcaagaacctggccaggctccaggctcctcatctatggtgcatccaccgacgggccacgttggtttcccagcctaggttcagtcggcaggtgggtctgagacagtagttcactctacactatccgaacgctgctagtctagtaagtntttgactagtttattacttgtactagctaagtataacgttaacgtcggtaccgtacggtacgttcggaccgtaacgggtaccgtaaggtacggaacgtaccgaacgtaacgtggtcggtactagtaccgaccgtagtcgttacgtccttactacgttccgtcccgtacc

SEQ ID NO: 292349 - DNA, 640 bp, Homo sapiens
  misc_feature: GYAE6OF02HVXVS.11.10.A10.1.454.CMB.1.raw
  modified_base (196)..(196): a, c, t, g, unknown or other
  misc_feature (196)..(196): n is a, c, g, or t
  modified_base (321)..(321): a, c, t, g, unknown or other
  misc_feature (321)..(321): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagcccaccctgtctgtgtctccgaggggaaanacgccaccctctcctgcagggccagtcagagtggtaggagccaagttgccctggtaccaggccaaggaaaccctgggacccagggcctaccccgagggtcctaccctcaatccttagtcgggtanccactcccgaccgagggccctaccgttcggtttaccccaggtccgtaaggttcgaaggttcggacgtagggttcgggtcaggacgtacaggtacgttcacttcctacaccagtcccgaaccgtcgtgactacggtctacgtaagttctttcgacttagttttatacgtgtactagactaagtaataacttagtcggtaccttacgggtacgtaccggacgtaacggaccggtaaggtacgtagaccaacgtacgttggacggcttagcccgtaacgtacttacggtccgttattcccggtacttacccgtcccggtaac

SEQ ID NO: 292350 - DNA, 586 bp, Homo sapiens
  misc_feature: GYAE6OF02HJJ8Z.11.10.A10.1.454.CMB.1.raw
  modified_base (195)..(195): a, c, t, g, unknown or other
  misc_feature (195)..(195): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccgaggggaaanagccaccctctcctgcagggccagtcagagtgttaggagcaacttagcctggtaccagcagaaacctggaccaggcctcccgaggcctcctcaactctatggtgcatcccaccaggccacttcggttcccagtccaggttcagtgcgaggtggtctgagacagtgttcatctcactatcaacgcctgctagtctagaagttatttggactagtttattactggtatagtactagtataatacgttggtacctaccggtacgttccggtaccgtaacgggaaccgtaagggtacgtaaacgtacgaaaacgacgttacggtaggaccgttagacccgaacgttaactcggttacgtttaccttaccgttaacttcccgttacccgtaacccg

SEQ ID NO: 292351 - DNA, 663 bp, Homo sapiens
  misc_feature: GYAE6OF02H1ATK.11.10.A10.1.454.CMB.1.raw
  modified_base (143)..(143): a, c, t, g, unknown or other
  misc_feature (143)..(143): n is a, c, g, or t
  modified_base (197)..(197): a, c, t, g, unknown or other
  misc_feature (197)..(197): n is a, c, g, or t
  modified_base (244)..(244): a, c, t, g, unknown or other
  misc_feature (244)..(244): n is a, c, g, or t
  modified_base (315)..(315): a, c, t, g, unknown or other
  misc_feature (315)..(315): n is a, c, g, or t
tcagcgagagataccacgaccggtgctcgatttagcgtcgatctcgaggggggaactgctcagttaggacccagacggaaccatggaagccccagcgcagcttctcttcctcctgctactctggctcccagataacactgganaaatagtgatgacgcagtctccagccaccctgtctgtgtctccgaagggggaanacgcccaccctctcccgtgcagggccaggtccgagagtgttaggganctaacttgctcggtaccaggcaacggaaacctggccaggcctcccgaggcctcctcatccgtagtcggtcnccaagtcccgaacgacgggcccacgttcggtttaccccaggtcctaggttccaggtcggacgtaggtcgggtcctaggagacctaggtacgtttaccgaccgttctaccgaaccctagtaccggaaccggtccctagactacgtaccgttagtaacgttagttttacgactttagtttacttaacgttgtacgtacgtactagtaataacgtaacgtgggtacctacgggtaccgttcggaccgtaacgggtaccgtaagggtaggaacgtagaaaccggtacgtacggtcggacgtacgaccgtactacgtcgttcgtacgttacctacgttccgtcccgtactacg

SEQ ID NO: 292352 - DNA, 588 bp, Homo sapiens
  misc_feature: GYAE6OF02IJA9K.11.10.A10.1.454.CMB.1.raw
  modified_base (196)..(196): a, c, t, g, unknown or other
  misc_feature (196)..(196): n is a, c, g, or t
tcagcgagagataccacgaccggtgctcgatttagcgtcgatctcagggggggaactgctcagttaggacccagacggaaccatggaagccccagcgcagcttctcttcctcctgctactctggctcccagatagcactggagaaatagtgatgacgcagtctccagccaccctgtctgtgtctccgaggggaaangcccaccctctcctgcagggccagtcagagtgttaggagcaacttgcctggtaccagcagaaacctggccagcctcccaggcctcctcatctatggtgcatcccaccgaggccacgttcggtttcccagtcctaggttcaggtcggcaggttgggtctagagacagtacgttcacttctacaccctatccgaacggccgtgctgtctagtaagttatttgacttagttttattacgttgtacagtactagtataacgtacgtcggtaccttaccgtacttacgtttcggaccgtacgggacctaacggactaagtaactacgtaaacgaacgttaggtacggtacgtacggacctaccgtacgttcttacgttacttacctaccgtttcccg

SEQ ID NO: 292353 - DNA, 733 bp, Homo sapiens
  misc_feature: GYAE6OF02JL0RL.11.10.A10.1.454.CMB.1.raw
  modified_base (197)..(197): a, c, t, g, unknown or other
  misc_feature (197)..(197): n is a, c, g, or t
  modified_base (207)..(207): a, c, t, g, unknown or other
  misc_feature (207)..(207): n is a, c, g, or t
  modified_base (296)..(296): a, c, t, g, unknown or other
  misc_feature (296)..(296): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactgggagaaatagtgatgacgcagtctccagcccaccctgtctgtgtctccagggggaaancgccaccctntcctgcagggccagtcagatgtagagcaacttgcctggtaccagcaagaacctggccaggcctcccaggcctccgtcatcgtatgggtncctactcccaccggacgggccctacgttcgggttccccaggtcccgtaagggttccaagggttcggacctaggggttcgggttcctaggacggtaaccgtaggtaacggtttccaaccgttccgtaacctaacccgtaacgttacccggaaccggtcccgtaccggacgtaacggttccgtaggtaaagttacggttttacgacgttaagttttaacttacggttgtacctaacggttactaaggtttaacttaaacgttaaccgtcggtaccccgttaacgggttaccgtttaccggacccggttaaacgggtaaccgggtaacgggttaacgggtaaacgttaccgaaaggttaacccggtggtaaccgggttctacggtaccgtaacctacgttacggttacctcgttacccgtactttacccttacccggtcc

SEQ ID NO: 292354 - DNA, 842 bp, Homo sapiens
  misc_feature: GYAE6OF02GQBVK.11.10.A10.1.454.CMB.1.raw
  modified_base (194)..(194): a, c, t, g, unknown or other
  misc_feature (194)..(194): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccaggggaaanagccaccctctcctgcagggccagtcagagtgttaggagcaacttagcctggtaccagcaagaaacctggccaggcctccccgaggcctcctcatcctagtggtgcaactcccgaccacggggcccaacgttcggttttaccccaggtcccgtagggtttccaacggttcggggacctaaggggttcggggttccttaggaacggtaccgaaggttaacggtttaccaacccgtttcccgtacctaacccgtaacgttacccgaaacccgggtcccgttacggaccgtaacggttacccgtaggtaaacggttagttttttacgggaccgtttaaggtttttaactttaacgttcggttaccctaaaggttccttaaagttaacgtttaaaacgtttaaaccgttccggggtaacccgtttaccgggggttaacccggtttacccgggtaaccgggtaaaccgggggtaaacccgttaaaacgggggttaccgggtaaaacgggttaacccggtaaaaaccgggttaaccggttaacggggttacgggtaaccggttaccgggtaacccgtaaacccgttacggtttacccgtttacgggtttacccttttaccggtaaaccgtttcccgtttaacccccggtacccg

SEQ ID NO: 292355 - DNA, 611 bp, Homo sapiens
  misc_feature: GYAE6OF02I7BB8.11.10.A10.1.454.CMB.1.raw
  modified_base (194)..(194): a, c, t, g, unknown or other
  misc_feature (194)..(194): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccaggggaaanagccaccctctcctgcagggccagtcagagtgttaggagcaacttagcctggtaccagcaagaaacctggaccaggcctcccgaggctcctcattcctatggtgcatccaccgagggccacgttcggtttccccagtccaggttcaggtcggctaggtgggtctagagacgagtacgttcacttcaccacataccgacggcctgactagtcgtagaagttgtttgacttagtttacttacgttgtactagtactagttataactacgtcgtaccgtacggtacgttccggaccgaacgggtaaccgtaaggtacgggtaacgtaccgaaacggtacgttacgggtacggtacctaggaaccctaccgtacttcgttacgtttaccttaccgtacgttacccgtttccccgtaacccg

SEQ ID NO: 292356 - DNA, 512 bp, Homo sapiens
  misc_feature: GYAE6OF02FY6H2.11.10.A10.1.454.CMB.1.raw
  modified_base (194)..(194): a, c, t, g, unknown or other
  misc_feature (194)..(194): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccaggggaaangccaccctctcctgcagggccagtcagagtgttaggagcaacttagcctggtaccagcagaaacctggccaggctcccaggctcctcatctatggtgcatccaccgagggccactggtttcccagccaggttcaggtggcaggtgggtctgagacagtattcactctcaccatcaacggcctgcagtctagagtatttgctagttattactgtcagtctagtataatactggtcctcggtacgttcggaccgtaagggaccgtaaggtcgaagtacaacgactggtgctgactacagtctgtcttcacttcctcctcc

SEQ ID NO: 292357 - DNA, 629 bp, Homo sapiens
  misc_feature: GYAE6OF02GA8RD.11.10.A10.1.454.CMB.1.raw
  modified_base (195)..(195): a, c, t, g, unknown or other
  misc_feature (195)..(195): n is a, c, g, or t
  modified_base (424)..(424): a, c, t, g, unknown or other
  misc_feature (424)..(424): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccgaggggaaancgccaccctctcctgcagggccagtcagagtgtaggagcaacttagcctggtaccagcaagaaacctggccaggcctcccaggctcctcatcctagtggtgccactcccaccgacgggcctacgtcggtttcccagtcctaggttcagtggcgtaggtgggtctagagacaggtacgttccactcctaccacctactccgaaccggtcctgacctagtctaggaagttnttttcgacttagttttacttacgtgttacgtagtacgttaattaataacgttcggtaccgtaccggttacggtaccgggtacggtaaccgggtaacggaacgggtaacggtaaggtaccgtaaaccgtacgtacggtggtcgtacgaccgtaccgtacgttcttccgttctttaccgtactttcccgttacccctaccgttaccg

SEQ ID NO: 292358 - DNA, 712 bp, Homo sapiens
  misc_feature: GYAE6OF02JTZUF.11.10.A10.1.454.CMB.1.raw
tcagcgagagataccacgaccggtgctcgatttagcgtcgatctcaggggagctctgagagaggagcccagccctgggattttcaggtgttttcatttggtgatcaggactgaacagagagaactcaccatggagtttgggctgagctggtcttttctgtggctattttaaaaggtgtccagtgtgaggtgcagctgttggagtcgtgggggaggcttggtacagccgtggggggtcgcgtgagactcacctgtgcagcctctggattccaacctttaacaactaccgccatgagtcgtcgggtccgccacggtcctccgaggggaacggggcgtgggaggtgggtctcgtaggtagttgggtggtaggtgggtggtagcgagtacttacgttcgcgtacgtacgtccggtaggaacggggtcccgttacaccgtactcgtccgaaggacgtaacgaacttaccgaaaaagtaaacgtgaagtttacgttaatagtacgtaacgtaaaagtacgaaaaccgtgaacccgttaggaaaccggtacggaacccgggaacggggaacccgtaacccggggtaccgtttaagtttaacgttttccgtagggttaacggaaaccgggttaaagtacgggttaccgggaaccgttaagttaacggtaacgggttcccggttaacccgggttaccgtaaccggggttacggggttaacg

SEQ ID NO: 292359 - DNA, 533 bp, Homo sapiens
  misc_feature: GYAE6OF02F4161.11.10.A10.1.454.CMB.1.raw
  modified_base (194)..(194): a, c, t, g, unknown or other
  misc_feature (194)..(194): n is a, c, g, or t
  modified_base (234)..(234): a, c, t, g, unknown or other
  misc_feature (234)..(234): n is a, c, g, or t
  modified_base (291)..(291): a, c, t, g, unknown or other
  misc_feature (291)..(291): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccaggggaaanagcccaccctctcctgcagggccagtcagagtgttaggancaacttagcctggtaccagcagaacctggccaggctccaggctcctcatctatggtncatccacaggccactggttcccagccaggttcagtggcaggtgggtctggagacagtagttcactctcaccatcgaacgtcctgcagtctagagtatttgacttagtttattacgtgtacagtactagttataaactacgtcggtccttacggtacgttccggacgaacgggacctaaggtaggaacgtacgaacgagtacggtggctagcactagtcttgttcttctactcttcccgtacc

SEQ ID NO: 292360 - DNA, 183 bp, Homo sapiens
  misc_feature: GYAE6OF02JG6CS.11.10.A10.1.454.CMB.1.raw
  modified_base (157)..(157): a, c, t, g, unknown or other
  misc_feature (157)..(157): n is a, c, g, or t
  modified_base (164)..(183): a, c, t, g, unknown or other
  misc_feature (164)..(183): n is a, c, g, or t
tcagcgagagataccacgaccggtgctcgatttagcgtcgatctcagggagctctgagagaggagcccagccctgggattttcaggtgttttcatttggtgatcaggactgaacagagagaactcaccatggagtttgggctgagcggctgtcaggngcatagnnnnnnnnnnnnnnnnnnnn

SEQ ID NO: 292361 - DNA, 629 bp, Homo sapiens
  misc_feature: GYAE6OF02GPF8Y.11.10.A10.1.454.CMB.1.raw
  modified_base (245)..(245): a, c, t, g, unknown or other
  misc_feature (245)..(245): n is a, c, g, or t
  modified_base (523)..(523): a, c, t, g, unknown or other
  misc_feature (523)..(523): n is a, c, g, or t
tcagcgagagataccacgaccggtgctcgatttagcgtcgatctcaggggagctctgagagaggagcccagccctgggattttcaggtgttttcatttggtgatcaggactgaacagagagaactcaccatggagtttgggctgagcgtggtctttttcttggtggcttaattttaaaaggtgtccagtgtgaggtgcagctgttggagtcgtgggggagtcttggtacaggccgtggggggtcncgtgagactcacctgtgcagcctctggtattcctaacctttaacaacctacgccatgagcgtgggtccgccaggcctaccgaggggaacggggctaggggtacggtcgggtactcggtaggttacggttgggttagggttaggttgggttacgggtagcgtaagtacgttacgtcgactagtaccgtcgtaggacgggtccgtacacctatcctacgaagacaactaagttaaccaaaagaaatcgtaattagtattacgtgaaactaaagcgaaacncgtccgtagacgacgaaccggaaggacccaggtaccttagttacttgagtacgaaggaagtacggtccggataagttacgtgtaccgtactaccggagttgggtac

SEQ ID NO: 292362 - DNA, 728 bp, Homo sapiens
  misc_feature: GYAE6OF02GDUYB.11.10.A10.1.454.CMB.1.raw
  modified_base (194)..(194): a, c, t, g, unknown or other
  misc_feature (194)..(194): n is a, c, g, or t
  modified_base (204)..(204): a, c, t, g, unknown or other
  misc_feature (204)..(204): n is a, c, g, or t
  modified_base (295)..(295): a, c, t, g, unknown or other
  misc_feature (295)..(295): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccaggggaaanagccaccctntcctgcagggccagtcagagtgttaggagcaacttagcctggtaccagcaagaaacctggccaggcctcccgaggctcctcatctatggtnactactccacgagggcctacgtcggtttcccagcctaggttcaggtggctaggtcgggtctaggagtacgaggtaacgtttcaaccttccgtaccgaacctaacgttacccgaaaccgggtcccttacggaccgtacggttacgtacggtaacgtagtttttacggtaccgtttaaggtttttttaaccgtggtttaccgtacgtaccgttaaggttaagttaacggtttaaaccgttcgggtacccgttacccggttaaccgtttaccgtttttacgggacccggttaacgggggtaaccctaaacggtaccgttaaacgtaaaacgttaccgtaaaacggtaaccggttaacggtacgggtaccgttacggtaccctaaccgtaacgttaccgttacgttaccgtttaccgtaccgttcccgttacccccg

SEQ ID NO: 292363 - DNA, 659 bp, Homo sapiens
  misc_feature: GYAE6OF02IVNYX.11.10.A10.1.454.CMB.1.raw
  modified_base (266)..(266): a, c, t, g, unknown or other
  misc_feature (266)..(266): n is a, c, g, or t
  modified_base (452)..(452): a, c, t, g, unknown or other
  misc_feature (452)..(452): n is a, c, g, or t
tcagcgagagataccacgaccggtgctcgatttagcgtcgatctcaggggggaacgtgctcagttaggacccagacggaaccatggaagcccagcgcagcttctcttcctcctgctactctggctcccagatagcactggagaaatagtgatgacgcagtctccagcccaccctgtctgtgtctacgaaggggaaagacgcctaccctctcctgcaggccagtcagagtgttaggagcaacgttagcctggtaccagcaagaaccnggaccaggcctaccgaggcctcacatctagtggtgaccactcccgacgacgggtcccctacgttccgggtttaccccaggtccccgtaagggtttaccaggttcggaccgtaagggtcgggttacgtagaacggactaaggtacgttaccaacgttcctaacgaccctagtacccgaaccgggtcncgacgtaagtcctaaggtaagttatttgacttaaggttttactacgttgtacacgtataacgtataaacgtactcggtacctcggtaccgtcgaaccggtaagaaccggtaaggtaaggaacgttacgaaacggtagtacggtacggtactcgaacccgtaagttcgtaaccgttctaccggtttacactttcccggtaccctcccg

SEQ ID NO: 292364 - DNA, 657 bp, Homo sapiens
  misc_feature: GYAE6OF02I4RBF.11.10.A10.1.454.CMB.1.raw
  modified_base (239)..(239): a, c, t, g, unknown or other
  misc_feature (239)..(239): n is a, c, g, or t
  modified_base (300)..(300): a, c, t, g, unknown or other
  misc_feature (300)..(300): n is a, c, g, or t
  modified_base (619)..(619): a, c, t, g, unknown or other
  misc_feature (619)..(619): n is a, c, g, or t
tcagcgagagataccacgaccggtgctcgatttagcgtcgatctcagggggggaactgctcagttaggacccagacggaaccatggaagccccagcgcagcttctcttcctcctgctactctggctcccagatagcactggaagaaatagtgatgacgcagtctccagcccaccctgtctgtgtctccgaggggaaagcgccaccctctcctgcgagggccagtcagtagtgttagganactaacttagcctggtaccagcaagaacctggccaggctcccaggctctcatctagtggtncatcccgacgagggcctacgttcggttccccagtccgtaggttccaggtcggctagggtcgggtctggagacgaggtacgttcactctaccgaacctagtaccgtaaccgtccgtacgacgtacgtcgtaggtaactttacgtttcgtactttaacgtttacgttacgttagtacgtagtacttaagttaaataaccgttacggtaccgggtcccgttacggggttaaccgttccggtaaccggaaacgggtaaccggtagggtaacggaacgtaaccgtaaacgttacggtacgggtcggtaccacggacctaacgtnttacgttcggttccttaccgtcgttccctcccgtaacg

SEQ ID NO: 292365 - DNA, 682 bp, Homo sapiens
  misc_feature: GYAE6OF02IDWZA.11.10.A10.1.454.CMB.1.raw
tcagcgagagataccacgaccggtgctcgatttagcgtcgatctcagggggagctctgagagaggagcccagccctgggattttcaggtgttttcatttggtgatcaggactgaacagagagaactcaccatggagtttgggctgagcgtggtcttttcttgtggctattttaaaaggtgtccagtgtgaggtgcagctgttggagtcgtgggggaggtcttggtacagccgtggggggtcgctggagactcacctgtgcaggcctctggattctacctttaacaactcgccatgagctaggggtccgccgaggcctacccgagggggaacggggctgggacgttggggtcctcgaggtacgtttgggtaggtagtggggtggttagcgagtatactcgcagacgtcccgtaggaacggggtccgttacacctagtcctacccaaggtaacgaccaaacgttacccgaaaaggtaaaacttggaaattacggtaataagtacgtactaaaaagtcggaaaactggaacccgttaggaaggaccggaaccggaaacgggtaaccgaaccgggtaccgttaagtttaacgtttcgtacggttggaacggtaaaacgcggttacgggaacgttaagttaacggtagtccggtaacccgtaaccggtaccccgggtaggggtaacg

SEQ ID NO: 292366 - DNA, 580 bp, Homo sapiens
  misc_feature: GYAE6OF02H49ZJ.11.10.A10.1.454.CMB.1.raw
  modified_base (176)..(176): a, c, t, g, unknown or other
  misc_feature (176)..(176): n is a, c, g, or t
  modified_base (204)..(204): a, c, t, g, unknown or other
  misc_feature (204)..(204): n is a, c, g, or t
  modified_base (211)..(211): a, c, t, g, unknown or other
  misc_feature (211)..(211): n is a, c, g, or t
  modified_base (217)..(217): a, c, t, g, unknown or other
  misc_feature (217)..(217): n is a, c, g, or t
  modified_base (231)..(231): a, c, t, g, unknown or other
  misc_feature (231)..(231): n is a, c, g, or t
  modified_base (246)..(246): a, c, t, g, unknown or other
  misc_feature (246)..(246): n is a, c, g, or t
  modified_base (391)..(391): a, c, t, g, unknown or other
  misc_feature (391)..(391): n is a, c, g, or t
  modified_base (410)..(410): a, c, t, g, unknown or other
  misc_feature (410)..(410): n is a, c, g, or t
  modified_base (424)..(424): a, c, t, g, unknown or other
  misc_feature (424)..(424): n is a, c, g, or t
  modified_base (459)..(459): a, c, t, g, unknown or other
  misc_feature (459)..(459): n is a, c, g, or t
  modified_base (462)..(462): a, c, t, g, unknown or other
  misc_feature (462)..(462): n is a, c, g, or t
  modified_base (465)..(465): a, c, t, g, unknown or other
  misc_feature (465)..(465): n is a, c, g, or t
tcagcgagagataccacgaccggtgctcgatttagcgtcgatctcaggggagctctgagagaggagcccagccctgggattttcaggtgttttcatttggtgatcaggactgaacagagagaactcaccatggagtttgggctgagcgtgtcgtttctaggcgctaatttaaaggntcagtgtgaggtgcagctgttggagtgnggggagnttgacngccggtgggggtcnctgagctcaccgtgngcagcctctaggattcaacctttacaacgtcgcatgagtcgtacggccaccaggccaccggaggggtacggctgggaggttgggacctagtaggtgttgggtggtaagtgggtggtacgatacgtatactcggatagcttccggnggaacgggtcccgttaacnctactccgcaaggnaacaacttacgaaataaagtctattatactataanaanaanacgacacgtacgagagacgacgacgacgacgtaccgtacgttacttcgtgtacgggaacggaacgtaggtacgtacgtagtacgttacgtacgtaccgtacggtacggtaggtag

SEQ ID NO: 292367 - DNA, 575 bp, Homo sapiens
  misc_feature: GYAE6OF02FVTOT.11.10.A10.1.454.CMB.1.raw
  modified_base (195)..(195): a, c, t, g, unknown or other
  misc_feature (195)..(195): n is a, c, g, or t
  modified_base (369)..(369): a, c, t, g, unknown or other
  misc_feature (369)..(369): n is a, c, g, or t
  modified_base (399)..(399): a, c, t, g, unknown or other
  misc_feature (399)..(399): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccgaggggaaangccaccctctcctgcagggccagtcagagtgttaggagcaacttagcctggtaccagcagaacctggccaggctcccaggctcctcatctatggtgcatccaccgagggccactcggttcccagccctaggttccagtggcaggtgggtctgagacagagttcactctacaccntcgacgcctgacagtctagagtattttcgnttagtttattactgttcagtactagtataacgtaactcggtaccgttacggtacgttccggaccgtaaacggggaccgtaaagggtacggaacgtaccgaacgtacgtacggtcggtaccgtacggacctaccgtacgttccgtcgttaccttacctacttcccgttcccgtaccg

SEQ ID NO: 292368 - DNA, 673 bp, Homo sapiens
  misc_feature: GYAE6OF02I45Y6.11.10.A10.1.454.CMB.1.raw
  modified_base (196)..(196): a, c, t, g, unknown or other
  misc_feature (196)..(196): n is a, c, g, or t
  modified_base (232)..(232): a, c, t, g, unknown or other
  misc_feature (232)..(232): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagcccaccctgtctgtgtctccgaggggaaangcccaccctctcctgcaggccagtcagagtgtaggncaattagcctggaccagcaagaaacctgggaccacggcctcccgaggcctcctcacttctagtcggtgcactcccgaccgacgggtcccacgttcggtttcccagtcccgtaggttcaggtcggactaggtgggtctaggacgacaggtacgttcacgttctaccgacctacgtacccgaacggtcctaggtacgtcgttagtaacgtagtttttcgacgttagttttaacttacgttcgttacgacttacgtaagtttaactaacttaaccgtggttacccgttacggtaccggtttccgggaaccggtaacgggtaacgtaacggggtacggtaaacggttaccgaaacggtaccgttacgtacgggttactaccggtaccaccgttacgtttacgttccgttacttaccgtacctttacccgttccccgaccttaacg

SEQ ID NO: 292369 - DNA, 584 bp, Homo sapiens
  misc_feature: GYAE6OF02HWSM0.11.10.A10.1.454.CMB.1.raw
  modified_base (148)..(148): a, c, t, g, unknown or other
  misc_feature (148)..(148): n is a, c, g, or t
  modified_base (300)..(300): a, c, t, g, unknown or other
  misc_feature (300)..(300): n is a, c, g, or t
  modified_base (322)..(322): a, c, t, g, unknown or other
  misc_feature (322)..(322): n is a, c, g, or t
  modified_base (348)..(348): a, c, t, g, unknown or other
  misc_feature (348)..(348): n is a, c, g, or t
  modified_base (355)..(355): a, c, t, g, unknown or other
  misc_feature (355)..(355): n is a, c, g, or t
  modified_base (374)..(374): a, c, t, g, unknown or other
  misc_feature (374)..(374): n is a, c, g, or t
  modified_base (460)..(460): a, c, t, g, unknown or other
  misc_feature (460)..(460): n is a, c, g, or t
tcagcgagagataccacgaccggtgctcgatttagcgtcgatctcagggctgtcgtgatgattgcgtggtggactctgtcccgctccaaggcacccgctctcgtgggaccgggtgcccccccggggttttttggactccgtgggggtnacttagcagccgtctgcttgcagttggacttcccaggccactagtggtctggcttcgtaggagggtcaggccagatggtgggtacgtgggaggccagcaggacggttccagtgaggaaggcaggacagggccaggacagtcagcttcagtgngaccgccgagtacagaaggtcncgtagggtcgtcgttggtttttaggngggtagnggactacggactagttcgngtcctagttgtagactttaacgtactaacgtactctagcgtgtaccgtgtaggacgaacggaccgtacggtcgacgtctccgtacncgtcctccacgacgtcgacgtccgtcctcccgtcgccaccctacgccacgtacgcgacgtcgcgacgacgcgcgtccgcgcgccgtcgtcgtacgacgacgtcgtaccgtacgtcgtcgtcgcg

SEQ ID NO: 292370 - DNA, 685 bp, Homo sapiens
  misc_feature: GYAE6OF02HEA5Z.11.10.A10.1.454.CMB.1.raw
  modified_base (236)..(236): a, c, t, g, unknown or other
  misc_feature (236)..(236): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagcccaccctgtctgtgtctccgaggggaaagagcccaccctctcctgcagggccagtcagagtgttaggancaacttagcctggtaccagcaagaaacctggccaggcctcccgaggcctcctcattctagtggtcgcactcccaccgagggccctacgttcgggtttccccagcccgtaggtttccaggttggactaggtcggggtctaggagacgagtacgtttccaacgtctaccaaccgtactaccgaaaccgggtcctaggacctaacggttctaggaaagttagttttcgaccgttaagttttacttacgttgtactaggtactaagttaaataacgttaacgtcggtacccttacgggtacgtttaccgggaaccgtaaacggggaacccgtaaaggggtacggaaacgttaccgtaaaaccggtaacgttacgggtacggtaccgttacggtacctaaccgtaagttccgttacgttaccttaccgtaacgtttcccgttaccccggtaacc

SEQ ID NO: 292371 - DNA, 575 bp, Homo sapiens
  misc_feature: GYAE6OF02GA5SQ.11.10.A10.1.454.CMB.1.raw
  modified_base (193)..(193): a, c, t, g, unknown or other
  misc_feature (193)..(193): n is a, c, g, or t
  modified_base (232)..(232): a, c, t, g, unknown or other
  misc_feature (232)..(232): n is a, c, g, or t
  modified_base (277)..(277): a, c, t, g, unknown or other
  misc_feature (277)..(277): n is a, c, g, or t
  modified_base (288)..(288): a, c, t, g, unknown or other
  misc_feature (288)..(288): n is a, c, g, or t
  modified_base (341)..(341): a, c, t, g, unknown or other
  misc_feature (341)..(341): n is a, c, g, or t
  modified_base (553)..(553): a, c, t, g, unknown or other
  misc_feature (553)..(553): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccaggggaanagccaccctctcctgcagggccagtcagagtgttaggancaacttagcctggtaccagcagaacctgccaggcctccaggctcncatctatggtncatccaccagggccacgtggttacccagcctaggtcaggtgcaggttcggtcnggagacgagtacttcaacgtcttacgaacctatacccgaacggcctaggtcctacgtacgtagtaagttacgtttcgtacgtagttttacttacgtcgtactaggtacctagttagtacgtacgtcggtaccttccgtactttacggttcggaccgacggtacaacgtacgagtaactacgtaaacgtcgtagtacggtacctcgacctacngtacctgtctacgtctacccgg

SEQ ID NO: 292372 - DNA, 618 bp, Homo sapiens
  misc_feature: GYAE6OF02GFAG7.11.10.A10.1.454.CMB.1.raw
tcagcgagagataccacgaccggtgctcgatttagcgtcgatctcaggggagctctgagagaggagcccagccctgggattttcaggtgttttcatttggtgatcaggactgaacagagagaactcaccatggagtttgggctgagcgtggtcttttcttggtggctaattttaaaaggtgtccagtgtgaggtgcagctgttggagtcgtgggggaggcttggtacagccgtggggggtcgctgagactcacctgtgctagcctctggattctaacctttaacaactacgccatgagctgggtccgccaggcctccgagggagggctgggagtcgggtctcgaggtagttgggtggtaggtggtggtagcaggtatacgttcgacagacttccggaggaacggggtccggttaccacctacgtcctaccgagacgaactaaacttacccgaaaagtaaaactggaattgtaattacgtagaacaaataagacagtcccgtaggacgtacggaccgtaacgggaaccgtccggaaccgtttatacgtttcgtcggtaggtaacgaaaggtcgaccgggatacgtagtacggtcgaccctacgggtaccgtggggttac

SEQ ID NO: 292373 - DNA, 637 bp, Homo sapiens
  misc_feature: GYAE6OF02G8CRB.11.10.A10.1.454.CMB.1.raw
tcagcgagagataccacgaccggtgctcgatttagcgtcgatctcaggggctgtcgtgatgattgcgtggtgggactctgtcccgctccaaggcacccgctctctgggacgggtgccccccggggtttttggactcctggggtgacttagcagccgtctgcttgcagttggacttcccaggccgacagtggtctggcttctgaggggtcaggccagaatggtggggtacgtgggaggccagcagagggttccatgagaagggcaggacgagggccacggacagtcagcttccatcgtcgacggcccggagacgaggaacggtctcgtgggtggtcgttggggttttggtggggtggaggagtggactagttctgcgtattgtgtattactactacttactactacatcggtacgtcgtggggacgaaacgggacctacggtcaccgtctcctcgcgtccctccacgacgggcccacgtccggtcccttcccgtcggccctacccgtcccacacgacgtccacccgttcggtcgggaccaccgacggcccgggtaccgtcgggtcctccggccggttaccggtacgtacgggttaccttacccggtttaccggttactacccgttcgtaccggtccgg

SEQ ID NO: 292374 - DNA, 563 bp, Homo sapiens
  misc_feature: GYAE6OF02HBK2Y.11.10.A10.1.454.CMB.1.raw
  modified_base (193)..(193): a, c, t, g, unknown or other
  misc_feature (193)..(193): n is a, c, g, or t
  modified_base (232)..(232): a, c, t, g, unknown or other
  misc_feature (232)..(232): n is a, c, g, or t
tcagcgagagataccacgaccggtgctcgatttagcgtcgatctcagggggaactgctcagttaggacccagacggaaccatggaagccccagcgcagcttctcttcctcctgctactctggctcccagatagcactggagaaatagtgatgacgcagtctccagccaccctgtctgtgtctccaggggaaanagccaccctctcctgcagggccagtcagagtgttaggancaacttgcctggtaccagcaagaacctggccaggctcccaggctcctcatctagtggtgcatcccaccgagggcctacgttcggtttacccaggtcctaggttcaggtcggctaggtcggggtctgagacagtacgtttcaactctacacctactacgaacgcctcgcagtctagtagtatttgactagtttattacttgtcagctagtataataacgtgtaccttcggtacgttcggaccgaagggtaaccgtaaggtacggaagtaccgaagtacgtagggtcgactacgactacgattacgttcgtacttccgacttcctcccgtacg

SEQ ID NO: 292375 - DNA, 534 bp, Homo sapiens
  misc_feature: GYAE6OF02GW8X2.11.10.A10.1.454.CMB.1.raw
  modified_base (194)..(194): a, c, t, g, unknown or other
  misc_feature (194)..(194): n is a, c, g, or t
  modified_base (349)..(349): a, c, t, g, unknown or other
  misc_feature (349)..(349): n is a, c, g, or t
  modified_base (386)..(386): a, c, t, g, unknown or other
  misc_feature (386)..(386): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccaggggaaanagccaccctctcctgcagggccagtcagagtgtaggagcaacttagcctggtaccagcagaacctggccaggctcccaggctcctcatctatggtgcatccaccagggccacgtggtttcccagccaggttcagtggcaggtggtctgagacagngttcactctcaccatcaacggcctgcagtctgaagtnttttgctagtttacttactgtcagtctagtataatacgtgtccgtacggtacgttacggaccgaacgggaaccgaaggtaggaacgtaccgaacgtactggtcggctcgaccgacgtattctcgttccttactacttcttacgacccg

SEQ ID NO: 292376 - DNA, 700 bp, Homo sapiens
  misc_feature: GYAE6OF02IM0Q8.11.10.A10.1.454.CMB.1.raw
  modified_base (150)..(150): a, c, t, g, unknown or other
  misc_feature (150)..(150): n is a, c, g, or t
  modified_base (222)..(222): a, c, t, g, unknown or other
  misc_feature (222)..(222): n is a, c, g, or t
  modified_base (236)..(236): a, c, t, g, unknown or other
  misc_feature (236)..(236): n is a, c, g, or t
  modified_base (314)..(314): a, c, t, g, unknown or other
  misc_feature (314)..(314): n is a, c, g, or t
tcagcgagagataccacgaccggtgctcgatttagcgtcgatctcaggggagctctgagagaggagcccagccctgggattttcaggtgttttcatttggtgatcaggactgaacagagagaactcaccatggagtttgggctgagcggngtgtttctaggtcggctaattttaaaaggtgtcagtgtgagtgcagctgttggatgtggggagcttggtacngccgtggggggtcncgtgagactcacctgtgcacgcctgtggactttccaaccttttaaacaactaccgaccaagtcgagcctggggtcccnccgaacggctccggaagggggaacggggtctagggtaggtcggggtaccttacggaggttagttgggaggttaggttggtaggtaagcgaagtattacgttcggataacgacctccggtaggaaacggggttcccgtttaacaacccgtataccgtacccgaaggaacgtaaactaaacgttaacccgaaaagtaaaaagtgtaaacgttaggttaaattaacgttaagaactaaaaagttacgaaacgaccgtaccgttaggaacgaaggtaccgaaaggaccggaacgtaacccgttagttactttaccgtaggtacgaacgtaacgaggttacgggaactaattaagtacggtacgtacccgtaacggtaccggtgggtaacg

SEQ ID NO: 292377 - DNA, 529 bp, Homo sapiens
  misc_feature: GYAE6OF02FQV16.11.10.A10.1.454.CMB.1.raw
  modified_base (195)..(195): a, c, t, g, unknown or other
  misc_feature (195)..(195): n is a, c, g, or t
  modified_base (231)..(231): a, c, t, g, unknown or other
  misc_feature (231)..(231): n is a, c, g, or t
  modified_base (392)..(392): a, c, t, g, unknown or other
  misc_feature (392)..(392): n is a, c, g, or t
  modified_base (510)..(510): a, c, t, g, unknown or other
  misc_feature (510)..(510): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagcccaccctgtctgtgtctccaggggaaangccacctctcctgcagggccagtcagagtgttaggngctaacttgcctggtaccagcagaaacctggccaggctcccaggctcctcatctatggtgcatccaccgagggccacgttcggtttcccagccaggttcaggtggacaggtgggtctgagacagtagttcactctcaccatcgacgctgctagtctagatntttgacttagtttattcttgtcagcagtatatacgtgcctgacgttcggaccgaagggtaccaggtagacgtacacgtacgtaggtcggctacgaccaccgtagtccgtcgttccttntaccttccgttcccgaccg

SEQ ID NO: 292378 - DNA, 732 bp, Homo sapiens
  misc_feature: GYAE6OF02IOALE.11.10.A10.1.454.CMB.1.raw
  modified_base (195)..(195): a, c, t, g, unknown or other
  misc_feature (195)..(195): n is a, c, g, or t
tcagcgagagataccacgaccggtgctcgatttagcgtcgatctcagggggaactgctcagttaggacccagacggaaccatggaagccccagcgcagcttctcttcctcctgctactctggcctcccagatagcactggagaaatagtgatgacgcagtctccagccacctgtctgtgtctccgaaggggaaanacgcccaccctctcctgcgacggccagtcagagtgttagacgtacaacgttgctggtaccagcaagaaacctggaccagggcctaccccgagggtcccttacccgtactacttaccgtaacggttcgggttacgaccctacgttaccccgaaacccgtaaccgggggtcccctaaccggtttccgggttttacccccgaaggtaccccggttaaggtttaccgaacgggttcggaccgtagggttcgggtctaggaacgtaacgtaggtacgttaccaactcgtaccaaccgtataccggaacggtcctagactaacgtcgtagtaacgtttagtttacggacgtttaagtttacttaagtcgtacgagtacgttaaagttataaacgtacgtcggtacctacggtacgttcggaacccgtaacgggtacctaagggtaacgtaacgtaaccgtaacgacggtttaggacggtacgtacgtaaccgtaccgtacgttacgttacttccgttaactaccgtttcccgtacccgtaccg

SEQ ID NO: 292379 - DNA, 712 bp, Homo sapiens
  misc_feature: GYAE6OF02F2H1D.11.10.A10.1.454.CMB.1.raw
  modified_base (178)..(178): a, c, t, g, unknown or other
  misc_feature (178)..(178): n is a, c, g, or t
  modified_base (196)..(196): a, c, t, g, unknown or other
  misc_feature (196)..(196): n is a, c, g, or t
  modified_base (247)..(247): a, c, t, g, unknown or other
  misc_feature (247)..(247): n is a, c, g, or t
tcagcgagagataccacgaccggtgctcgatttagcgtcgatctcagggggagctctgagagaggagcccagccctgggattttcaggtgttttcatttggtgatcaggactgaacagagagaactcaccatggagtttgggctgagcggtgtgtttctaggcggctattttaaaggngtcagtgtgaggtgcagngtgttggagtcgtaggggggagtcgttgggaacaggccgtgggggggtccncgtagacgactcacgtgtcgcacgctcgtgtacttacctaacctttaacaaccgtaccgacctatcggtacgtcggtcgggtcccgccgtacggccgtaccggaagggggtaacgggtcggtagggtagggttcggggttaccgtacggtaagggtttagttggggttagggttaggttggggttacgggtaacgagtaacgtaacgttacgttcgacgtaacggtaccgtaccgggtaaggtaaccgggtccgttaccaccgtacgtccgaccgaacgtaacgtaaaccgtaaacttaaccgaaaagaaacgtgtaagttagtaattacgtacgaaactaaagtacgaaacgacgtacgagtacggaacggaccgtaaggaccgtacggtaccttagttacttgtgtacggaacggtaagtcggtacgagtagtacgtcgtacgtacgtacggtacggtaggta

SEQ ID NO: 292380 - DNA, 551 bp, Homo sapiens
  misc_feature: GYAE6OF02GL2GF.11.10.A10.1.454.CMB.1.raw
  modified_base (194)..(194): a, c, t, g, unknown or other
  misc_feature (194)..(194): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccaggggaaangccaccctctcctgcagggccagtcagagtgttaggagcaacttgcctggtaccagcagaacctggccaggctcccaggctcctcatctatggtgcatcccaccgaggggcccacgtcggtttccccagccaggttcaggtggcaggtgggtctggagacagtagttcactctacacctatccgaacggtcctgcagtctagaagtatttgacttagtttattacttgtcagtctagtataatacgtggtaccgtcggtacgttcggaccgtaacgggaccgtaaggtcggaagtacgaacgtacgtggtacggactcgactacctagtctcgttccttactacttccttcccgtcc

SEQ ID NO: 292381 - DNA, 556 bp, Homo sapiens
  misc_feature: GYAE6OF02G3RFM.11.10.A10.1.454.CMB.1.raw
  modified_base (194)..(194): a, c, t, g, unknown or other
  misc_feature (194)..(194): n is a, c, g, or t
  modified_base (202)..(202): a, c, t, g, unknown or other
  misc_feature (202)..(202): n is a, c, g, or t
  modified_base (289)..(289): a, c, t, g, unknown or other
  misc_feature (289)..(289): n is a, c, g, or t
  modified_base (403)..(403): a, c, t, g, unknown or other
  misc_feature (403)..(403): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccacctgtctgtgtctccgaggggaaangccacctntcctgcagggccagtcagagtgttaggagcaacttgcctggtaccagcagaaacctggccaggcctccaggctcctcatctatggtncatccacgacgggccacgttcggttaccccagcccgtaggttcaggtggctaggtggggtctggaagacgagtgttcacttctacaccatcgaacggtctgcagtctagaagtntttcgactagtttattacgtgtcagtctaagtataatacgtgacgtcggacgttcggacgaaggtaccgtaaggtacgaagtacgaacgtacgtggtacggacgtagacctaccgtagtcgtacgttccttacgactttcccgtacccgtacg

SEQ ID NO: 292382 - DNA, 734 bp, Homo sapiens
  misc_feature: GYAE6OF02HXNX9.11.10.A10.1.454.CMB.1.raw
  modified_base (195)..(195): a, c, t, g, unknown or other
  misc_feature (195)..(195): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccgaggggaaancgccaccctctcctgcagggccagtcagtagtgttaggacgctaacttagcctggtaccagcaagaaaccgtggaccaggcctccaggctcctcatctatggtcgcactccaccgacgggcctacgttcggtttccccagccgtacggttcaggtcggacgtaggtcgggttctaggagaacgaggtagttaccgacttcgtaccaacctacgttacccgaaccggtccttacggacgtacgttcgtaaggtaaaggtttactttttacgaccgtttagttttaacgtttacgttacgttaccgaagttaccgttaaaggttaaactttaaaacgttaaccggttcgggtaaccccgttacggggttaaccggtttacccgggaaccggtaaacgggggtaaacccgtaaagggttaacgggtaacgtaaacgtaaaccgggttaaccgttagggtaacgggtcctaacgggtaccgtaacccgtagttccgttacggttaccctttacggtaccctttcccgtttaccccggtacccg

SEQ ID NO: 292383 - DNA, 880 bp, Homo sapiens
  misc_feature: GYAE6OF02HUVB7.11.10.A10.1.454.CMB.1.raw
tcagcgagagataccacgaccggtgctcgatttagcgtcgatctcaggggagctctgagagaggagcccagccctgggattttcaggtgttttcatttggtgatcaggactgaacagagagaactcaccatggagtttgggctgagctggtctttttcttgtggcttattttaaaaggtgtccagtgtgaggtgcagctgttggagtcgtgggggaggtcttggtacaggccggttgggggggtcgcgttggagacctcacctgtcgcacgtcctcgtggtacttcctaacctttaaaccaaccttaccgacctatcggagtccggtcggggtccccggccgaacgggcccgttacccggaaggggggaacgggggtccgttagggggtagggttcggggtccgttacggtaagggtttaggtttagggggttagggggtttaaggttgggggttaggggttaacggtaccggtaagggtaaactttacccgtttaccggacgtaacgggttaaccccgtttcccggggtaagggtaaaaccggggggtcccccgggttttaacccaacccgtaacgttcccgttaaccccggaaaggaaaccggttaaacctaaaaccgtttaaccccgaaaaggtaaaaccgtacggggttaattaaacggtttcctaaagtacccgaaaataccgaaaccgacgttaccgaacgggaaggaacgacccgggaacggtaaccgtaacgggtccgttaagttaacgtttaacgtttaccgttgggaaccggtaagggggaaaaccgggtaacgacgggtaaccctaagggttcccggtaaggggaccccgggtaaaggggtttaccgttaccggggttaggttttacgg

SEQ ID NO: 292384 - DNA, 700 bp, Homo sapiens
  misc_feature: GYAE6OF02H72KV.11.10.A10.1.454.CMB.1.raw
  modified_base (636)..(636): a, c, t, g, unknown or other
  misc_feature (636)..(636): n is a, c, g, or t
tcagcgagagataccacgaccggtgctcgatttagcgtcgatctcaggggggaactgctcagttaggacccagacggaaccatggaagccccagcgcagcttctcttcctcctgctactctggctccagatagcactggagaaatgtgatgacgcagtctccagccacctgtctgtgtctccgaaggggaaatacgccacctctcctgcgaggccagtcagtggtgttaaggatacaacttaggccttggtaacccagaccaagaaacccgtggaccacggcctccgaggtcctcctctatctagtggtcacctatacccacgacgggtcctacggttcggttacccagtcctaggttcaggtggcgtgggttgggctaggaagactagtacgtttccaacttcaccgaaccctagtaacccgaaccggtcctacggtacctaaggttcaacggtaaagtttcttttacgggtacctttaaggtttttaaacttaaccgttacggttactaacggtacgtttaaacgtaacttaaaacgttacgggttcggtaacccggttcggtaacccggtttaccgggaaccgtaaacgggtaccgtaaaggggttaacgaacgttaaccgaaacggttacgnggtacgacggtcaacccgtactcgttacctacgttacctttacaccgtttacccgccgtaaccg

SEQ ID NO: 292385 - DNA, 788 bp, Homo sapiens
  misc_feature: GYAE6OF02I9P3T.11.10.A10.1.454.CMB.1.raw
  modified_base (145)..(145): a, c, t, g, unknown or other
  misc_feature (145)..(145): n is a, c, g, or t
  modified_base (159)..(159): a, c, t, g, unknown or other
  misc_feature (159)..(159): n is a, c, g, or t
  modified_base (225)..(225): a, c, t, g, unknown or other
  misc_feature (225)..(225): n is a, c, g, or t
  modified_base (246)..(246): a, c, t, g, unknown or other
  misc_feature (246)..(246): n is a, c, g, or t
  modified_base (310)..(310): a, c, t, g, unknown or other
  misc_feature (310)..(310): n is a, c, g, or t
tcagcgagagataccacgaccggtgctcgatttagcgtcgatctcaggggggaacgtgctcagttaggacccagacggaaccagtggaagccccagcgcagcttctcttcctcctgcctactctggctcccagatagcactgganaaatgtgatgacgnagtctccaggccacctgtctggtctctccgaggggaaacgcccacccttctccctgcgacgggccngttccagtagtcgttaggacnctaacttagccttggaccagcaagaacctggccagtcctccaggctcctcagttctagtcggtncctactccgaacgtcggcctacctttcgggttacccaggcctaacgggttcacggttcggctaggggttgtcgttcggaactacgaggttaccttacgaacttcgcccgtaaacctcgtacgaaaccgggtccttaggacccgttacggtaccgttaggtaaacggttcttttacggaccgtttaaggtttacctttaagttcggttaccgtagtaacggttaactttaaacgtaaaccgtttacgtaccgggttacccgttaacgggtacccggtttacggtaaccccggttaaaggggtaacccggtaaacggggttaaaccgggtaaccgttaacccgggtaaaaccggttaccgtttaacgggggttaccggttaccggttaaaccggtaaccgttaacccggttacgttaccggtttaccggtttacccgttacgggtaaaccctttcccccgggttacccgtttaaccccgg

SEQ ID NO: 292386 - DNA, 782 bp, Homo sapiens
  misc_feature: GYAE6OF02JSWTA.11.10.A10.1.454.CMB.1.raw
  modified_base (321)..(321): a, c, t, g, unknown or other
  misc_feature (321)..(321): n is a, c, g, or t
tcagcgagagataccacgaccggtgctcgatttagcgtcgatctcagggggaacgtgctcagttaggacccagacggaaccatggaagccccagcgcagcttctcttcctcctgctactctggctcccagatagcactggagaaatagtgatgacgcagtctccagccaccctgtctgtgtctccgaggggaaacgagcccacccttctcctcggcacgggccaggtccagtacggtgttaggacgactaacttaggcctggtaccagcagaacctggccacggcctcccgaaggtcctcccgtacacgttctagtcggtnccgatcccgaccgtacggcctacgttcgggtttacccccaggtccccgaggtttaccgacggttggtaccgtaagggttccgggttactaggggtaactacggaaggttacggttacaacccggtttcaacccgtacccgaactttaccggaaacccggtccgtacgaccgttacgtaccggtagttaaacgttacgttttcgtaaccttagttttaacgttccgttaaggtaccgtacggtaaccttaagttaaccgttaaattaccgtttaccggggacccgtttacgggtaaccgggttacccgtaaccgggaaaccggttaccgggaaacggttaaacggtaaccggttaaccgaacccggtaacgttcgggaaccgggtttccgacggtaaccccgtacgtacccgtttaaggtccgttttacggtacccaccgttttacccggacccctacccgg

SEQ ID NO: 292387 - DNA, 633 bp, Homo sapiens
  misc_feature: GYAE6OF02ICIMM.11.10.A10.1.454.CMB.1.raw
  modified_base (340)..(340): a, c, t, g, unknown or other
  misc_feature (340)..(340): n is a, c, g, or t
tcagcgagagataccacgaccggtgctcgatttagcgtcgatctcaggggctgtcgtgatgattgcgtggtgggactctgtcccgctccaaggcacccgctctctgggacgggtgccccccggggtttttggactcctggggtgacttagcagccgtctgcttgcagttggacttcccaggccgacagtggtctggcttctgaggggtcaggccagaatggtgggtacgtgggaggccagcagagggttccagtgagaagggcaggacgagggccacggacagtcagcttccatgtgacgcccggagacagaaggtctcgtgggtgcgttgggtttttgnggggtgaggtatggactattcgtcgcctagtttgtgtacttactactactactactactagtggacgtcgtaggggacgaaacgggtaccgtacggtcacccgtctcctcacgtccctaccgaccgaacggcccacgtccggttcccttcccccgtcggaccctaccccttccctacccgaacgaccggtaccgtacccgttccggcggggcccacgacggcccggtacccgtcgggctccggccgtcggtaccgaacggtaccttaccgttccgtactccttccgtcgtcgg

SEQ ID NO: 292388 - DNA, 580 bp, Homo sapiens
  misc_feature: GYAE6OF02I3LGE.11.10.A10.1.454.CMB.1.raw
  modified_base (195)..(195): a, c, t, g, unknown or other
  misc_feature (195)..(195): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccgaggggaaancgccacctctcctgcagggccagtcagagtgttaggagctaacttgcctggtaccagacagaacctggccaggctcccaggctccgtcatctatggtgcatccaccgagggccctacttcggtttcccagcctaggttcaggtggcaggttgggtctggagacgagtacgttcactcgtaccacactccgaacggtcctggctagtccgtaggtaagttagttttgaccttaggttttacttaccgttggttacgagtactaagttaactaacttaacgcgtaccgttcggtacgtccggacgaacggaacgaggtacggaatacgaagtacgtaggcgtacgacggtacacgtattcgtcgtccttcaccttccgtcccgtacg

SEQ ID NO: 292389 - DNA, 575 bp, Homo sapiens
  misc_feature: GYAE6OF02GFHLD.11.10.A10.1.454.CMB.1.raw
  modified_base (194)..(194): a, c, t, g, unknown or other
  misc_feature (194)..(194): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccaggggaaangccaccctctcctgcagggccagtcagagtgttaggagcaacttagcctggtaccagcagaacctggccaggctccaggctctcatctatggtgcatccaccgacgggccacgtcggccaccccagccaggttcaggtcggacgtaggtgggtcgtaggggacaggtacttcaccttctacacctatcagcacgcctagcgtccgtgtaggtatttgactagtttattacgtgtacgagcagtcgtagtcgtacgtggtactaccgtaccgttacggaccgaaacgggacgtacgacgttaggtaaacttaaaccggtaacgttacggtacggtctacgactacctacgttccgttacgtttaccttacgtacgttccccg

SEQ ID NO: 292390 - DNA, 726 bp, Homo sapiens
  misc_feature: GYAE6OF02FQARW.11.10.A10.1.454.CMB.1.raw
tcagcgagagataccacgaccggtgctcgatttagcgtcgatctcaggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgttggagtcgtgggggaggcttgggtacaggccgtggggggtcgctgagactcacctgtgcaggccctcgtggacttcctaacctttaacaacgtacgacctagtcgagtcggtcgggcccgacgacggtcctaccggaagggggaacggggtcgtagggtacgggttgggtcctacggtaacgggtttagttggggtaggttagggttggggtaggtacgcgaaggtacgttaccgttcgacgaacgtaccgttccgggtaagggaaccggggtccggttaccgacctacgtcccgtaccgaaggtaacgtaacgttaaccgtaccgaaaaaaggtaaacgtagtaagttagtaagttagtacgaataaagtaacggaaactacggaccgtaggacgacggaccggaacggaaccgaccgggtacgttaatttacgtttcgtacggtaggaaaccggaaagtaccgggtacggacttaagttaacgtacggtacccgtaccgtaacccggtacggggttgggttaacg

SEQ ID NO: 292391 - DNA, 670 bp, Homo sapiens
  misc_feature: GYAE6OF02I4JLK.11.10.A10.1.454.CMB.1.raw
  modified_base (194)..(194): a, c, t, g, unknown or other
  misc_feature (194)..(194): n is a, c, g, or t
  modified_base (293)..(293): a, c, t, g, unknown or other
  misc_feature (293)..(293): n is a, c, g, or t
  modified_base (360)..(360): a, c, t, g, unknown or other
  misc_feature (360)..(360): n is a, c, g, or t
  modified_base (368)..(368): a, c, t, g, unknown or other
  misc_feature (368)..(368): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgtcagtctccagccacctgtctgtgtctccgaggggaanacgccaccctctcctgcaggccagtcacgagtgtagagcaacttagcctggaccagcacgaactggaccgagcctccgagtcctctcactctagtcggngcatcccacgacggcctaacgttcggttaccccagccgtaaggttcaggtcgacgtaggtcgggtcngaggtacnggtacgttcacgtctaccactacgtcgaacggtcctcgtacgtacgtcgtagtaacgttattttcggacgttaacgttttacgtaacgtttacgtagtagtaccgtaagtttaactaaacgtttacgtacggtcccgttacgggtacggtaccggtaaccgaagggttaacccgaaaggttacggggaaacgtccgtaaacgttaacggttacggtcggtaaccgtacgtaacccgtaccgttaagttcccggtttcccgttaacgtttacccgtaaccgtttccccgtttaccctaaccgg

SEQ ID NO: 292392 - DNA, 756 bp, Homo sapiens
  misc_feature: GYAE6OF02HHXIA.11.10.A10.1.454.CMB.1.raw
  modified_base (193)..(193): a, c, t, g, unknown or other
  misc_feature (193)..(193): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggaagaaatagtgatgacgcagtctcagccacctgtctgtcgtctcgaggggaanacgcccaccctctcctgcgacgggccagtcagtagtgttaggagactaacgttagcctaggtaccagaccaacgaaccgtggaccaggcctcccgaggtcctcctacacttcgtagtcggtcgctacctacccgaccggacgggccctacggtttccggttccccgagtccgtaggttcgaggtggacgtagggtgggtctaggacgacgtaggtacgttccacgttcctaccgaacctacgtaacccgaaccggtccctagtaccgtaacggttacgtaaggttaagtttacgttttacgacgttttaacgtttttacgttaccgttacgttacgtaacgttacgtaaacgttaactttaaaccgttaccgtaccgggtacccgttaccggggtaaccgtttaccggggaacccggtaaacggggtaaccggtaaagggttaacgggaaacgttaaccggtaaacggttacgttacgggtacggtaccgttacggtacccgtaaccgttacgtttaccgttacgttcccgttaccgttacccgtttcccgtaccccgtaccg

SEQ ID NO: 292393 - DNA, 619 bp, Homo sapiens
  misc_feature: GYAE6OF02H376U.11.10.A10.1.454.CMB.1.raw
  modified_base (195)..(195): a, c, t, g, unknown or other
  misc_feature (195)..(195): n is a, c, g, or t
tcagcgagagataccacgaccggtgctcgatttagcgtcgatctcagggggaactgctcagttaggacccagacggaaccatggaagccccagcgcagcttctcttcctcctgctactctggctcccagatagcactggagaaatagtgatgacgcagtctccagccaccctgtctgtgtctccgaggggaaagngcccaccctctcctgcagggccagtcagagtgttaggagcaacttagcctggtaccagcagaaacctggccaggctcccaggctcctcatctatggtgcatccaccgagggccctacgttcggttttaccccagccgtaggttccaggtcggccaggttcggggtctaggagacgagtaagttccactcctacacctatcccgaaacggccttcgctagtactgaaagttattttgcttaaggttttatttaacgtcgttacaagtcctaagttactaaataacgttcgggaccttacgggtacgtttaccgggaccgtaaacggggaccgtaaagggtacggtaagtcgaaacgtaacgtggttagggaccttagctaacctacgtcttacgttactttaccacttcccgttacccgtacccg

SEQ ID NO: 292394 - DNA, 669 bp, Homo sapiens
  misc_feature: GYAE6OF02IGHNA.11.10.A10.1.454.CMB.1.raw
  modified_base (142)..(142): a, c, t, g, unknown or other
  misc_feature (142)..(142): n is a, c, g, or t
  modified_base (179)..(179): a, c, t, g, unknown or other
  misc_feature (179)..(179): n is a, c, g, or t
  modified_base (194)..(194): a, c, t, g, unknown or other
  misc_feature (194)..(194): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactgganaaatagtgatgacgcagtctccagccacctgtctgtntctccgaggggaaanacgcccaccctctcctgcgagggccagtccagtagtgttaggagctaacttgcctaggtaccagcagaacctggaccaggcctccgaggtcctcctcgactcgtagtggtcgacctaactcccacgacgggccctaacgtttcggtttaccccaggtcccgtaggttccaggttcgcgtaggtcgggtctaggacgacgacggtacgttcaacgtctaccaccagttccaacggtcctacgacgacgttctaggtaacgttacgttttcgacgtttaaggttttacttaccgttaggttaccagtacgtaagttaaacgtaacgttaacgtcggtaccgttaccggtacggttaccggaaccgtaacgggaaccgtaaggtacgggtaacgtaccgtaaacgacgttaggtcggtacgtacggtacccaacgtaccgtacgttacgttacctaccgtacttcccgtaccctaccg

SEQ ID NO: 292395 - DNA, 752 bp, Homo sapiens
  misc_feature: GYAE6OF02FH421.11.10.A10.1.454.CMB.1.raw
  modified_base (334)..(334): a, c, t, g, unknown or other
  misc_feature (334)..(334): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtcctgtgtcctccgagggggaaacacgcccaccctctcctgccacgggccagtccaggacggtgttagggacgccaactttacggcccttgggtaacccagccaacgaaaccctgggacccagggcctccccgaggtcctcccgtcatccttagtggtcncagtcccaaccgaggggtcccctaacgttcgggttttaccccaaggtccccgtaaggggtttcaagggttcgggcctagggttcggggtccttaggaacgaactacggtacgtttaccaaccgtttcctacccgaaccctagttacccgaaacccgggtccctaggaccctacggttccgttaaggtaacgttacgttttacggtaccgttaagttttacttaccgttacgtacgacggtactaacgtttaacttaaacgttaacgttcgggtacccgttaccgggtaccggttaccgggaacccggtaaacgggaacccgtaaagggtacgtaaacgtaccgaaacggtacgtaggtacggcgtacgacctaccgtattccgttacgttaccttcctacgttcccgttacccgtacc

SEQ ID NO: 292396 - DNA, 634 bp, Homo sapiens
  misc_feature: GYAE6OF02IULI7.11.10.A10.1.454.CMB.1.raw
  modified_base (207)..(207): a, c, t, g, unknown or other
  misc_feature (207)..(207): n is a, c, g, or t
  modified_base (235)..(235): a, c, t, g, unknown or other
  misc_feature (235)..(235): n is a, c, g, or t
  modified_base (557)..(557): a, c, t, g, unknown or other
  misc_feature (557)..(557): n is a, c, g, or t
tcagcgagagataccacgaccggtgctcgatttagcgtcgatctcaggggagctctgagagaggagcccagccctgggattttcaggtgttttcatttggtgatcaggactgaacagagagaactcacatggagtttgggctgagcgtggtcgtttctaggtggctaatttaaaaggtgtccagtgtgaggtgcagctgtgagtcgnggggagcttggtacagccgtgggggtcncgtgagactctacctgtcgcagcctcgtggacttccaacctttaacaacctacgccaatgacgtcgtcgggtccgccgtaggcctccggaagggggaaggggcctgggagtgggtctcgtaggttagttcgggtggtagtgggtggtaagcaagtacttactcgacaacgcgtccgtaggaacgggtccgttacaccgtactccgtacacgagtacctaattacccgaaagtaaaactgattagtatagtgaactaaagcgaaagtacgactaggaagtcggaccggtaaggacctaccgggtaacttattacgtttaccgnggtacggtaaacgtaaaggtcgaccgggtataagttacgtacggttacgacccgttaacgggtaccggtagggtaac

SEQ ID NO: 292397 - DNA, 756 bp, Homo sapiens
  misc_feature: GYAE6OF02GW9GM.11.10.A10.1.454.CMB.1.raw
tcagcgagagataccacgaccggtgctcgatttagcgtcgatctcaggggagctctgagagaggagcccagccctgggattttcaggtgttttcatttggtgatcaggactgaacagagagaactcaccatggagtttgggctgagctggtctttttcttgtggctattttaaaaggtgtccagtgtgaggtgcagctgtggagtcgtgggggaggcttggtacagccgtggggggtcgcgtgagactcaccgtgtgcagcctcgtggacttcaacctttaacaactacgcctatgacgtcgtcgggtccgccgaggcctccggaaggggaacggggtcgtagggtaggtcgggtctcggtaaggttagttcgggtaggttaggttgggtaggtaacggcgtaaggtactaccgttcggacgacgtaccgttccggtagggtaacgggtcccgggtttacaacccgtacttaccgtacccgaacgtaacgaacctaaactttaccgaaaaagtaaaacgtagtaacttaagttagttaagtacgtaaacgtaaaagtacggaaaaccgtaacggtacccgttaaggaaacgggaccggtacccgggaaaccgggaacctaacccggggtaccgttaacgtttacgtttacgtaacgggtacggtaaaccgggtaaaggtaaccggtccgggtaacctaagttaacggttaaccggtcggttaaccccgttaacgggtacccggtagggggttaacg

SEQ ID NO: 292398 - DNA, 792 bp, Homo sapiens
  misc_feature: GYAE6OF02HJ74I.11.10.A10.1.454.CMB.1.raw
  modified_base (197)..(197): a, c, t, g, unknown or other
  misc_feature (197)..(197): n is a, c, g, or t
  modified_base (294)..(294): a, c, t, g, unknown or other
  misc_feature (294)..(294): n is a, c, g, or t
  modified_base (299)..(299): a, c, t, g, unknown or other
  misc_feature (299)..(299): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggaagaaatagtgatgacgcagtctccagcccaccctgtctgtgtctccgaggggaaancgccaccctctcctgcagggccagtcagagtgtaggagcaacttgcctggtaccagcagaaacctggccaggcctccaggcctcctcatctatggtnctacncccgaccgacgggccctacgttcggtttaccccacggtaccgtagggtttaccagggttcgggaccgtaggggttcggggttacgtacggaacgtacgtaggtaacgtttacccaaccgttcccgttaccgaaccctaacgtttacccgaaaaccgggtcccttacggaccgtaacgggttcccgttaaggtaaacggtttagtttttccgggaactttaaggtttttaactttaaccgttcggttaccgtaagttaccgtaacgttaaagtaaaccgtttaacgtaccgggtacccggttaccggggtacccggtttaaccggggaacccggtaaacggggtaacccggtaaaggggtaaccggggtaaacgttaacccggtaaaaccgttaccggttacgggttaccgggtaccgtacggtaacccgaacccgttacgttccgttaccggtttaccttacccgttaccgtttacccgttccccgtaacccg

SEQ ID NO: 292399 - DNA, 701 bp, Homo sapiens
  misc_feature: GYAE6OF02IEOLK.11.10.A10.1.454.CMB.1.raw
tcagcgagagataccacgaccggtgctcgatttagcgtcgatctcagggggggaactgctcagttaggacccagacggaaccatggaagccccagcgcagcttctcttcctcctgctactctggctcccagatagcactggagaaatagtgatgacgcagtcctccagcccaccctgtctgtcgtctaccgagggggaaacacgcccacccttcctccttgaccgagggcccaaggtccgagacgttggttaggaactctaacttagcctagggtaaccagaccaaaggaaacccgtggacccgacggcctaccccgaacggtccttacctcctaattccgtaagttcgggtacgtaccaacgtacccgaccgtacggggccctacgttccggtttacccacgtccgtacggttcgtaggtcgggacgtgggttcggtacgtaggtacgacgtaggtacgttaccactcgttccaaccgtacgtaccgaccggtcctagaccgtagtacgtacgaaggttacttttcggacctttaggtttttactaaccgttcgtacgttagtaccgtaagttataaacgttacgtaccgggtaccgtacggtaccggttaccggaccgaacggggtacgaagggtagaacggtacaacgtacgtagtcggctcgccactgtcgtacgtcctactacgttccctcctacg

SEQ ID NO: 292400 - DNA, 705 bp, Homo sapiens
  misc_feature: GYAE6OF02HAHTA.11.10.A10.1.454.CMB.1.raw
  modified_base (192)..(192): a, c, t, g, unknown or other
  misc_feature (192)..(192): n is a, c, g, or t
  modified_base (202)..(202): a, c, t, g, unknown or other
  misc_feature (202)..(202): n is a, c, g, or t
  modified_base (234)..(234): a, c, t, g, unknown or other
  misc_feature (234)..(234): n is a, c, g, or t
  modified_base (333)..(333): a, c, t, g, unknown or other
  misc_feature (333)..(333): n is a, c, g, or t
  modified_base (667)..(667): a, c, t, g, unknown or other
  misc_feature (667)..(667): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatgtgatgacgcagtctccagcccacctgtctgtgtctcgaggggaancgccaccctntcctgcgagggccagtcagagttggttagganactaacgttacgccgttaggtaccaggacaacggaaacccgtggacccaagggccctaccccgagggtcccttacccgtacacttcgtacgtgggtacnctactcccgaaccgacgggtaccctacggtttcggttaccccaggtacccgtaggttaccaggttcggacgtacgggttcgggtactaggaacgtaacgaggttaaccgtttccaaccgttccgtaacaacccgtaacgttacccggaacccggtcccttaggacccgttaggttaccgtaagggtaactttacgttttacgactttaacgttttacttacgttggtacctagacttaagtaataacgtacgtcggtaccgttacggtacgttaccggaacgtaacgggtacgaaggtagaacgtacgtaacgtacgtggcggtactcgaaccnctagttccgtcgttcctacgtaccttccgtacccgtac

SEQ ID NO: 292401 - DNA, 716 bp, Homo sapiens
  misc_feature: GYAE6OF02F2K5N.11.10.A10.1.454.CMB.1.raw
  modified_base (240)..(240): a, c, t, g, unknown or other
  misc_feature (240)..(240): n is a, c, g, or t
tcagcgagagataccacgaccggtgctcgatttagcgtcgatctcagggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgttggagtcgtgggggaggcttggtacagccgtggggggtcnctgagactcacctgtgcagcctctggattcacctttaacaactacgccatgacgcgtcggggtccgccgaggcctaccgaggggaaggggctgggagtcggggtctcgtaggttattgggtggtaggtgggtggtagcagtactacgttcgcgagtacgtccggtaggaacgggtccgttacaaccgatcctccgaaggaactactaaacgttaaccaaaacggtaaatcggtaattacggtaattaacgtacggaaactaaagtacgaaacgtacggacccggttaaggaacggacgggtacccgggaaacggggtaaacccaccggggttaacccttttaagtttactttttacccggtagggttaccggaaaccgggtaaaaacggtttcgggtaacccgggtaacctaaagtttaacgggtacggttaccggtaacccggttaaacccgggtacggggttaagggggtttac

SEQ ID NO: 292402 - DNA, 659 bp, Homo sapiens
  misc_feature: GYAE6OF02H0IE6.11.10.A10.1.454.CMB.1.raw
  modified_base (191)..(191): a, c, t, g, unknown or other
  misc_feature (191)..(191): n is a, c, g, or t
  modified_base (216)..(216): a, c, t, g, unknown or other
  misc_feature (216)..(216): n is a, c, g, or t
  modified_base (225)..(225): a, c, t, g, unknown or other
  misc_feature (225)..(225): n is a, c, g, or t
tcagcgagagataccacgaccggtgctcgatttagcgtcgatctcagggggaactgctcagttaggacccagacggaaccatggaagccccagcgcagcttctcttcctcctgctactctggctccagatagcactggagaaatagtgatgacgcagtctccagccacctgtctgtgtctcgaggggaaangccacctctctgcaggccagtcagngtgtaggancaacgttagcctggtacacgacagaacgtcgcgacgcgtaccgacgcgtcctctactctacgtagtcgtctactccaccgacggccgtacgttcgttccgtacgtaccgtacgtcgtacgtcggcgtacggtggtccccccgtgacgacgtagtacgtactactactactacctacgtacgtacgtaccgtcgtacgtacgtacgtacgtaagttacgtttacgtacgttacgtttagttacgttcgttacgtacgtacgtaagtaactaacttaacgttacggtaccgttaccggtaccggttaccggtaccggtaacggtaaccggtaacggtaacggtaacgtaacgtaacgtaacggtacggtacggtacgtacgtaccgtaaccgtacgttcgttacgttaccgttacgtacttcccgttaccgtaccg

SEQ ID NO: 292403 - DNA, 708 bp, Homo sapiens
  misc_feature: GYAE6OF02IVZ9J.11.10.A10.1.454.CMB.1.raw
  modified_base (194)..(194): a, c, t, g, unknown or other
  misc_feature (194)..(194): n is a, c, g, or t
  modified_base (657)..(657): a, c, t, g, unknown or other
  misc_feature (657)..(657): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccgaggggaangccaccctctcctgcagggccagtcatagtcgttaggagcaacgttacgcctacgggtacccaggtcaacggaaaccctgggacccagggtcctaccccgagggtccctccctaccacttacctaagttgggtacactacgttcccgaacccgaggggcccctaacgttcggtttaccccagtcccgtaggtttcaggtgggacctagggttcgggtcgtggaagacgtacggtagttaccaccgtctaccaaccactaccgaccgtcctgaccgtatccgtagtaacgttagttttcgaacgtttagtttttactcgttacgtaggtccgttaaagttaagttaaggttaacctcgggtccctttaccggtaacgtttaccgtttcgggaccggttaacgggtaaccgtaacgtaacgttaacgtaaacctacgtaaaacgtaacggttcggtacggtaccncggtaccgacttacgttccgttacgttcttacctaccgttcccttaccccg

SEQ ID NO: 292404 - DNA, 707 bp, Homo sapiens
  misc_feature: GYAE6OF02GAY4V.11.10.A10.1.454.CMB.1.raw
  modified_base (202)..(202): a, c, t, g, unknown or other
  misc_feature (202)..(202): n is a, c, g, or t
  modified_base (247)..(247): a, c, t, g, unknown or other
  misc_feature (247)..(247): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactgggaagaaatgtgatgacgcagtcctccagcccaccctgtctgtcgtcctcggaaggggaaacncgccctacccttctcctgccgacggccagtcagtagttgtaaggnactaacttcgctaggacagcaacgaacctcggccaacggtcctacccgaggtccctccgtactacgttctaaggtcgggtacactaacctcccgaaccggtacgggtaccctaccggttccggtttaccccaggtccgttaacgggttcaagggttcgacgtagggttcgggtctaggagacgtagtacgtcctaacgtctaccacgtactaccgaccggtctacgcctagtactaggtaacgttgtttcacgtttaacgtttactacgttcggtactaaggttactaaacgtttaactaaacgttacggtcggttacccgttcgggtaaccgttcggaaccggtaacgggtaacgtaaaggacggtaacgtaacggtaacctaggttcgggtacgtaactcggtaaccctacgtacttacgttaccgttccttaccgtacctttacccggtaccctacg

SEQ ID NO: 292405 - DNA, 768 bp, Homo sapiens
  misc_feature: GYAE6OF02JJKMY.11.10.A10.1.454.CMB.1.raw
  modified_base (195)..(195): a, c, t, g, unknown or other
  misc_feature (195)..(195): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaatagtgatgacgcagtctccagcccaccctgtctgtgtctccgaggggaaanagccaccctctcctgcagggccagtcagagtgttacgcaactacttacgcctaggtaccagcaacgaacctggccaggcctcccgaggctacctcaattcctaatcgtatcgtactaagtttacgggacgggcctacgtcgggaccacgttaccccccgaaccggtacggttaccgtacgggtacggtacggtaacgggtttcgggggttaccggttacgggggaaaccgtacgggtaccttttaaccgtaccgtttaccgttacccaacccggtacgttaccccggtaccgaacggtaccccgttaacggacgtaccccgttaagggtaaaccgttagtttttaccggacgtttaacggttttaattaccggttacggtaaccgaacgttacgtacgttacggcggtacgtaccggtaccggttacccgtcccgggtaccggtaccgggttttccgggaacccggtaaacgggtaacccgtagggttacgggacgtaccggacggtaacggtaacggttcggtacggcgtacgtaccgtacctacgttaccgtcgttaccgtacttacccgg

SEQ ID NO: 292406 - DNA, 815 bp, Homo sapiens
  misc_feature: GYAE6OF02I57LC.11.10.A10.1.454.CMB.1.raw
  modified_base (290)..(290): a, c, t, g, unknown or other
  misc_feature (290)..(290): n is a, c, g, or t
  modified_base (793)..(793): a, c, t, g, unknown or other
  misc_feature (793)..(793): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccgagggaaagcgccaccctctcctgcaggccagtcagagtgtaggacgctaacttgcctggtaccagcaacgaaccgtggccaggtcctacccgaggctccctacngttacctagtcggtcacctaacctcccgaccgacgggccctacgtttccggtttacccacgtaccggtaggttccgaacggtcgggtacctaggggttacggggtttcccagggtaacggtaaccgtaagggttactttaccgaaacccttccgtaacgtaaccccttagtacccgtaaccgggtccttaacggtaccgtaacgttctaaagggtaaccggttttattttacggggtaacctttaaacgggttttttaattacccggtttcgttaaaccgttacgggtaacttaaacgggttttaaactttaaacggtttaaacccgttcggggtaacccccgttaaggggtttaccccgtttaacccgggcccggggttaaaaaccgggtaacccgggttaaaacggttagggtaaaccgttaacgaaccggtttaaaccggtggttccgggtaacctcgggttaaaccctcggttaacttcggttaccgttcgtttacccncgtttaccccgttaccctaccg

SEQ ID NO: 292407 - DNA, 693 bp, Homo sapiens
  misc_feature: GYAE6OF02HESSA.11.10.A10.1.454.CMB.1.raw
  modified_base (195)..(195): a, c, t, g, unknown or other
  misc_feature (195)..(195): n is a, c, g, or t
  modified_base (237)..(237): a, c, t, g, unknown or other
  misc_feature (237)..(237): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccgaggggaaancgcccaccctctcctgcgagggccagtcagagtggttaggancaacttgcctggtaccagcaagaacctggccaggcctcccgaggcctcctcatctagtggtcgcactcccacgacgggccctacgttcggtttacccagtccgtacggttcgaggttggcgtagggtcgggtacgtggagacgaggtacgttcaccttctaccacctaacgtaccgaaccggtcctagaccgtacgttacgtagtaagttgttttacgtacgtttacgttttacttacgttagtactacgtacttaagttaaactaacgttaacgtccggggttacccgtacgggttacccgttaaccggggtaccgtaaacggggtaacccggtaaagggttacggaaacggttaaccggaaaccggttacggtacggtcgggtaccgtacggaacccgtaccgtacgttcgttaccgttaccgtttacctaccgtttcccgttaccccgtaccg

SEQ ID NO: 292408 - DNA, 624 bp, Homo sapiens
  misc_feature: GYAE6OF02JA036.11.10.A10.1.454.CMB.1.raw
  modified_base (209)..(209): a, c, t, g, unknown or other
  misc_feature (209)..(209): n is a, c, g, or t
  modified_base (282)..(282): a, c, t, g, unknown or other
  misc_feature (282)..(282): n is a, c, g, or t
  modified_base (295)..(295): a, c, t, g, unknown or other
  misc_feature (295)..(295): n is a, c, g, or t
  modified_base (311)..(311): a, c, t, g, unknown or other
  misc_feature (311)..(311): n is a, c, g, or t
  modified_base (589)..(589): a, c, t, g, unknown or other
  misc_feature (589)..(589): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagggaccacgggagacatagtgctgacgcagtctccagccacctgtctgtgtctccaggggacagacgcccaccctctccngcagggtccagtcagactattagttacacttagcctaggtaccagacaaaacctgccaggcctcccgctcctnactctagtcggtnacatccaccgaggccncgtcggtccgtaccccaccgtagtctaggtcggtcgggtcgggtcgtagggactagttcgtcgtactcctacgtacacgtcagcctaacgccgtgacagtctagtaacgttattttcgacttaagtttattaacgttcggtacacgtacgtaaaggttacttaaggttaacgtcggtcctcgtacgttacggtttccgggacggtaacgggaccgttaagggtgtaagactacgtaagaaccggtgtcggtacggcttagacctaaacctgttaccgngtttactaaccgttcgtaccccgttcccgattacg

SEQ ID NO: 292409 - DNA, 942 bp, Homo sapiens
  misc_feature: GYAE6OF02ID22N.11.10.A10.1.454.CMB.1.raw
tcagcgagagataccacgaccggtgctcgatttagcgtcgatctcagggctgtcgtgatgattgcgtggtggactctgtcccgctccaaggccacccgctctctgggacggtcgtccccccggggtttttggactccgtggggtgacttagcagccgtctgcttgcagttcggaccttcccgaggccgacagtcggtctcggcttcgtgggacgggtcacggccgaagtagtggtgggtacgtgggacgcagcgaggtacggtaccagtggacggaaggcgaacggtacgacgggacccgaaccgggactacggtcgaacgtccttacgagttcggtacggacccggtacccggaagaccggtaaacggtaacgggttccgttcgggttcgggggtacggtttcgggtttttgggggttttttaggggtcgggggttacggaacggggttaaggttaccgggtaaacttacggtttccggtacgttaacccgtttaggttttcgggttaacgttaacgtttttaaaccccgttaaccttaaaccgttaaccgtttaaaccgtacgttaacgggttaccgggtaaccgggttttacgggaaccgggggtaaaccggtaaacccggggtaacccgttaccgggtaaccccgttaacccggttttaccctcccggttaaccgtaacccgtaccccgttaacccccgaaaccggttaacccgggcccctttaacggttccccgtttcccccgttccccggtcccgtaaccccgtaacccctttacccggtaacccaacgggacccgtacccgtaccggttaccgggacgggaccctaacggacccggtcccgggtacccggtacggccttccggtaccggtaccgggtaactaaccgggttacccttaccggttacccgttacgtacccgttaccggtcgtaccgg

SEQ ID NO: 292410 - DNA, 608 bp, Homo sapiens
  misc_feature: GYAE6OF02JWV0J.11.10.A10.1.454.CMB.1.raw
  modified_base (300)..(300): a, c, t, g, unknown or other
  misc_feature (300)..(300): n is a, c, g, or t
tcagcgagagataccacgaccggtgctcgatttagcgtcgatctcaggggagctctgagagaggagcccagccctgggattttcaggtgttttcatttggtgatcaggactgaacagagagaactcaccatggagtttgggctgagctggctttttctgtggctattttaaaggtgtccagtgtgaggtgcagctgttggagtcgtgggggagtcgttggtacaggccgtgggggcgcgtgagactcacctgtgcagcctcgtggtattcacctttaacaactcgccatgagctgggccncaggctccgagggaggctgggagtggctcgagtagtggtggtaggtggtaggtgcagtacttacgtcgcgaacgacgtccgtaggtaacgggtccgttacaccgtatccctacgaggaacaactaaatccaaaaggtaaatgtaattaggtaatagtagaactaaatgaaactcgactagaacgggtacgaaccggaacggtacgtaccggtaccgttaaattcgttttacgacggtagaaccggtaaaagtcggtaacggacgtaattaagttcgacccgttaccgtaacgggcgttaggggttaac

SEQ ID NO: 292411 - DNA, 685 bp, Homo sapiens
  misc_feature: GYAE6OF02J1QTH.11.10.A10.1.454.CMB.1.raw
  modified_base (188)..(188): a, c, t, g, unknown or other
  misc_feature (188)..(188): n is a, c, g, or t
tcagcgagagataccacgaccggtgctcgatttagcgtcgatctcagggggaactgctcagttaggacccagacggaaccatggaagcccagcgcagcttctcttcctcctgctactctggctccagatagcactggagaaatagtgatgacgcagtctcagccacctgtctgtgtctccaggggaanagccacctctcctgcagggccagtcagtagtcgttaggagcaacttagcctaggtaccagcaagaaaccgtcggaccaggcctcccgaggtcctacctcacttctagtggtcgctactccaccgacggcctacgttcggtttacccacggtcctaggttccaggttcggactaggggttcgggtcttaggaacgtaccgaagtacgtttcaacgtccttacgaaccctagtacccgaacggccttcgacgtacgtcgtacgtaagttagttttacgtactttacgtttttacgtacgttactacggtactaacgtttacgtaacgtaacgtttccggtaccttaccgttaccgttaccgttttaccgggtaccgtaaccggggtacctaaacggtactaacgtaacttaaccgaacggttaaccgtcggttacggacttaccgaccctaacgtacgttacgttaccgttacgttaacttacccgttaccttaccccg

SEQ ID NO: 292412 - DNA, 673 bp, Homo sapiens
  misc_feature: GYAE6OF02IYHO8.11.10.A10.1.454.CMB.1.raw
  modified_base (248)..(248): a, c, t, g, unknown or other
  misc_feature (248)..(248): n is a, c, g, or t
  modified_base (329)..(329): a, c, t, g, unknown or other
  misc_feature (329)..(329): n is a, c, g, or t
  modified_base (462)..(462): a, c, t, g, unknown or other
  misc_feature (462)..(462): n is a, c, g, or t
tcagcgagagataccacgaccggtgctcgatttagcgtcgatctcagggggagctctgagagaggacgcccagcccctgggattttcaggtgttttcatttggtgatcaggactgaacagagagaactcaccatggagtttgggctgagcgtggtcttttcttgtggctattttaaaaggtgtccagtgtgaggtgcagctggttggagtcgtggggggaggtcgttggtacaggccgtggggggtcncgtgagactcacctgtcgcacgcctcgtggacttccaaccctttaaacaacttacgcctatacgagtccgtggggtccccnccgaggccgtaccgaagggggaacggggctgggaggtcgggtctcggtaggttagttgggtaggtaggtgggtaggtagcgagtatacgtgctagactcggtggaacgggccgtcaccgattccacagacganaacgttaccaaagtaaatgtaattagtactatacgacgtaaatcgtaaagcgtacgtaggaacgtacggaccggaaggtaaccggaccggttacgttaaccgtttagttttcggtacgtaacgggtaaccggaaaaggtccggtaaccgggaccttaagttaagttaacggtccggttaacccacccggggttaaccggttgggggttaac

SEQ ID NO: 292413 - DNA, 705 bp, Homo sapiens
  misc_feature: GYAE6OF02I5WBJ.11.10.A10.1.454.CMB.1.raw
tcagcgagagataccacgaccggtgctcgatttagcgtcgatctcaggggctgtcgtgatgattgcgtggtgggactctgtcccgctccaaggcacccgctctctgggacgggtgccccccggggtttttggactcctggggtgacttagcagccgtctgcttgcagttggacttcccaggccgacagtggtctggcttctgaggggtcaggccagaatgtgggtacgtgggaggccagcagagggttccatgataagggcaggacagggccacggacagtcagctcatgtgacgccgagacagaaggtctcgtgggtggtcgttgggttttgtggggtgtaggagtggactagttcctggtcctagtttggtcgtatttaacgtaacttaaccgttaactaactaacgtagttaggtaaccgtcgtagggggtaaccgaaaacggggaccgaaccggtacgacccgttactaccgtcctaacgcccgtacccgaacccgaaacgggcccctaacgttcccggtaccctttccccgtacgggccctaaccccgtccctaccgaaacgtccgaccaccgtcggtccggggactaaccggacggcccgggtacccgtcggggtccttccggaccgttacgggtaaccgtaaaccgggttaaccttacccggtttacccggtatttcccggttcgtacggttacccgg

SEQ ID NO: 292414 - DNA, 735 bp, Homo sapiens
  misc_feature: GYAE6OF02IR7MZ.11.10.A10.1.454.CMB.1.raw
  modified_base (197)..(197): a, c, t, g, unknown or other
  misc_feature (197)..(197): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatgtgatgacgcagtctccagcccaccctgtctgttgtctccgaggggaaagngcccaccctctcctgcgagggccagtcagagtgttaggagctaactacgcctaggtaccacgcgaacgaaaccgtcggaccacgggcctaccccgacggtcctcccgtacacttacctacgtgggtcgtacctacctacccgaaccggaccgggaccctaaccgtttccgggtttaccccacgtcccgtaaggtttccgaaggtcgggaccgtagggtcggggtctaggaagaaccgtaggtacgtttaccaccgtcctaccactacgtaacgaccggtcctacggactacgttccgtaaggtaacgttatttcgtacgtttaacgttttattacgttactacgtacgacgttaacgttaataaacgtacgtcggtacccgttaccggttaccggttaaccggaaccggtaaggttaaccggaagggttaacggtaaacgggtaaccaaacgggttacctagggtacggtaccggtactaacccgaactacgtttaccgtgtttacccgttacttcccgtttaccctacccgtaccgg

SEQ ID NO: 292415 - DNA, 848 bp, Homo sapiens
  misc_feature: GYAE6OF02F3PO5.11.10.A10.1.454.CMB.1.raw
tcagcgagagataccacgaccggtgctcgatttagcgtcgatctcaggggagctctgagagaggagcccagccctgggattttcaggtgttttcatttggtgatcaggactgaacagagagaactcacatggagttgggctgagctggtctttttcttgtggctattttaaaaggtgtccagtgtgaggtgcagctgttggagtcgtgggggaggtcgttgggtacagccgtggggggtcgctggagactcacctgtgcagcctcgtggattctacctttaacaactacgccatgagcgtcgggtcccgcgacggccgtccgaagggggaacggggtctggggaggttcgggttaccgttcctttttaacgtttacgagtaccgtaaggttgggttaacgttaactaagttaacgtttccccggactaacggtaccgttcccgggttagggaacggggggtccccgtaacgtttaccgaaccctacttcccgttaaccgaaaggtaacgaaaccctaaacgttacccgttaaaaacggaaacccgtaccggtaccttttacggtttttacccttaaaccgtaaaaagttccggaaaaccacgggttaccccgtaagggaacgggtaaccggacccggtaaagttaccggaaacccggtaccggggttaccctttaagggtttaaacctttaaccgggttcggtacgggtaacggaacggggtaacggtaaccgggttaccccgggggggaaaccccctaaaccgggttaaaaccgttttaaccccgtaacgggtaacccgtttagggttacccgggggtaacccggttcggggttaaccccggggggg

SEQ ID NO: 292416 - DNA, 635 bp, Homo sapiens
  misc_feature: GYAE6OF02FG5CZ.11.10.A10.1.454.CMB.1.raw
  modified_base (236)..(236): a, c, t, g, unknown or other
  misc_feature (236)..(236): n is a, c, g, or t
  modified_base (254)..(254): a, c, t, g, unknown or other
  misc_feature (254)..(254): n is a, c, g, or t
  modified_base (296)..(296): a, c, t, g, unknown or other
  misc_feature (296)..(296): n is a, c, g, or t
tcagcgagagataccacgaccggtgctcgatttagcgtcgatctcgaggggggaactgctcagttaggacccagacggaaccatggaagccccagcgcagcttctcttcctcctgctactctggcctcccagatagcactggagaaatagtgatgacgcagtctccagccaccctgtctgtgtctccgagggaaagcgccaccctcgtcctgcacgggccagtcagacgtgtaggnactaacttgcctggaccngcagaaccgtgaccaggtcctccgagtcctcctcatcgtagngtacgcactcccacgacggcctagttccggttcccaggcctagggttcagtggctagggtcggtctagagtaccgagtactccacttccaccgtacacgtacgaaccggtcctagccgtacgtcgtaaggtaacgttctttacggacttaggtttacttacgttctaacgagtactaataaagttaacgtacgtcgtccggttaacggtaccggttaaccggacggaaacgggtaaccctaaaggggtcgaaacgtaaccggtaaacgtccgtaaggtccggactcgtaaccgtccgtaacgttcgtacgtacctttcgaccgttcccgtaccctaccg

SEQ ID NO: 292417 - DNA, 739 bp, Homo sapiens
  misc_feature: GYAE6OF02H16L8.11.10.A10.1.454.CMB.1.raw
  modified_base (322)..(322): a, c, t, g, unknown or other
  misc_feature (322)..(322): n is a, c, g, or t
  modified_base (452)..(452): a, c, t, g, unknown or other
  misc_feature (452)..(452): n is a, c, g, or t
tcagcgagagataccacgaccggtgctcgatttagcgtcgatctcaggggagctctgagagaggagcccagccctgggattttcaggtgttttcatttggtgatcaggactgaacagagagaactcaccatggagtttgggctgagctggtctttttcttgtggcttattttaaaaggtgtccagtgtgagtgcagctgttggagtcgtgggggaggtcttggtacaggtccggtggggggtcgcgtggacgactcactgtgcagccttgtggtattctaacctttaaacaacgtacgcccagtagacgtcgtcgggtaccnccgaggtcctaccggaggggaacggggcgtgggtaggtagggtctcgagggttattgggtaggtaggtgggtgggtagcaggtacttaacttcgacgagtacctaccggtggaaacggggtcccgtttanacctagttccctaccgaaggacaactaaacttaccgaaaagaaaacttagtaacgttagtttaaacttaagtacgaactaaaagtacgaaaacgtaccggtaacctagggaacgaacgggtacccggaagggtaacccgtaaccggaaacccgtaatttaacgtttaactttttccggtaacggtcggttaaaccggaaaaaccggttcggggtaacccggaggttaaacgttaaccgtaaaggtttcccggtaacccggttaacccgggacggttttaacgggggg

SEQ ID NO: 292418 - DNA, 629 bp, Homo sapiens
  misc_feature: GYAE6OF02GVTVB.11.10.A10.1.454.CMB.1.raw
  modified_base (224)..(224): a, c, t, g, unknown or other
  misc_feature (224)..(224): n is a, c, g, or t
  modified_base (233)..(233): a, c, t, g, unknown or other
  misc_feature (233)..(233): n is a, c, g, or t
  modified_base (300)..(300): a, c, t, g, unknown or other
  misc_feature (300)..(300): n is a, c, g, or t
  modified_base (348)..(348): a, c, t, g, unknown or other
  misc_feature (348)..(348): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatgtgatgacgcagtctccagccaccctgtctgtgtctccaggggaaagacgccaccctctcctgcacgggccagtcagngtgttaggngcaacttagctcggtacagcaacgaactggaccaggcctcccgaggcctcctctatctagtcggtcnctactccgaccggacggccacgttcggttccccagtccgtaggttacnggtcggcgtagggttcggtctagacggtacaggtacgttactacgtctaccaaccctacgtacgaaccggtcctacggtctacggtcgtaagtaacgttagtttcgactttagttactttactgtacgtagtcgtaaataataactacgtcggtccgtacggtacggtccggtacgtaacgggtaaccgtaggtaacggaacgtaacgaacgtacgtacggtggaccgtcgaacctacgttaagtccttacgttcctttacgtactttcccgtccctaccg

SEQ ID NO: 292419 - DNA, 740 bp, Homo sapiens
  misc_feature: GYAE6OF02F1RW5.11.10.A10.1.454.CMB.1.raw
  modified_base (196)..(196): a, c, t, g, unknown or other
  misc_feature (196)..(196): n is a, c, g, or t
  modified_base (316)..(316): a, c, t, g, unknown or other
  misc_feature (316)..(316): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccgaaggggaaanagccaccctctcctgcagggccagtcgagagtgttaggagacaacgttagcctaggtaccagacaacgaaaccgtcggaccgacggcctccccgaggtcctcctcactccgtagtcggtnctactcccaccgacgggaccctacggttccggtttccccacggtacccgtaggttcgaggtcggacgtagggttcgggtcgtaggacgtacgaaggtcgttacaccttctacccgtaactaacgtacccgaaccggtcctacggtaccgtaggttaccgtaaggtaaacggtttcttttacggtacgtttaaggttttactttacgttacgttacgtacgtacgttaagtttaaattaaacgttaaccggttccggtacccggttaccgggttaccggtttaccgggaaccgggtaaacgggtaaccggtaaagggttaacgggtaaacgtaacccggtaaacgtaaccggtggtacggtacgtacggacccgtacttacgttacgttcgttaccttacgttacccgttcccgttccccgtacc

SEQ ID NO: 292420 - DNA, 655 bp, Homo sapiens
  misc_feature: GYAE6OF02I29YD.11.10.A10.1.454.CMB.1.raw
  modified_base (368)..(368): a, c, t, g, unknown or other
  misc_feature (368)..(368): n is a, c, g, or t
tcagcgagagataccacgaccggtgctcgatttagcgtcgatctcaggggagctctgagagaggagcccagccctgggattttcaggtgttttcatttggtgatcaggactgaacagagagaactcaccatggagtttgggctgagctggtcttttcttgtggcttattttaaaaggtgtccagtgtgaggtgcagctgttggagtcgtgggggaggtcttggtacaggtccgtggggggtcgcgtgagacctcaccgtgtgcagcctctggattcctacctttaaacaactaccgccatgagctgggtcccgccgaggcctccggaggggaacggggctagggaggtgggtctcgtaggtattgggnggttagtgggtggtagcagtattacgttcgcagaccttccggtaggaacggggtcccgttcacctactcctaccagacgaactaaactaccaaagaaaactgaacttagtacttagtagaactaaagtagaaacacgtccgtaaggaacgacggacggaacgggaaaccgaccgggtaaccgttaagttactttcgttagggtacggtaacggaaaacggtacggtaacgggacttaagtaagttacggtaccgtacccgtaaccggtaccggttacggggttaacg

SEQ ID NO: 292421 - DNA, 718 bp, Homo sapiens
  misc_feature: GYAE6OF02HHMZN.11.10.A10.1.454.CMB.1.raw
  modified_base (144)..(144): a, c, t, g, unknown or other
  misc_feature (144)..(144): n is a, c, g, or t
  modified_base (313)..(313): a, c, t, g, unknown or other
  misc_feature (313)..(313): n is a, c, g, or t
tcagcgagagataccacgaccggtgctcgatttagcgtcgatctcagggggggaactgctcagttaggacccagacggaaccatggaagccccagcgcagcttctcttcctcctgctactctggctcccagatagcactggaanaaatagtgatgacgcagtctccagccaccctgtctgtgtctccgaaggggaaagacgccaccctctcctagcaagggccagtcagaggtagttaaggagactaacttaggcctaggtaaccgagcgaagaaaaccgtggaccaggtctccgagctccacatactatggncactccaccgtaggacctacgttcgtttacccgagtaccgtaggttacaggtggactagggttcgggtacgtacgaacggaacgtaacggtacgttacgaacttaccgtaccaccgtaacttaccgaaaccgggtcctaggtacaacgtcgtaagtaagttactttacgtacgttaaactttttacgttaacttggttacgtaacgtacgtaaaggttaactaaagttaaccggtggtacccgttacgggtacggtttaccggaaccggaaaacgggtaaccgggtaacggttaacgggaaaacggttaaccgtaaaacggtaacggttacggtacgggtacgtaggtaaccctaacggtacttacgttacgttaccgttaataccggttaccttcccgtaaccg

SEQ ID NO: 292422 - DNA, 920 bp, Homo sapiens
  misc_feature: GYAE6OF02IK19U.11.10.A10.1.454.CMB.1.raw
tcagcgagagataccacgaccggtgctcgatttagcgtcgatctcaggggagctctgagagaggagcccagccctgggattttcaggtgttttcatttggtgatcaggactgaacagagagaactcaccatggagttgggctgagctggtctttttcttgtggcttaattttaaaggtgtccagtgtgaggtgcagctggttggagtcgtggggggaggtcgttgggtacgaggtccggtggggggtcgcgtgacgactccacctgtgcacgcctgtggtacttacctaacctttaaccaacctaccgacctagtgacggtcgtccggggtcccgccgaacggccgtaccggaggggaacggggtcgtagggtacggttcggggtccttacggtaaggggtttaggtttggggttaggggttagggttagggggttagggttaacgggtaccgtaaagggtaacgtttacccggtttaccgggaccgtaaacgggttaaccccggtttacccggggtaacgggggtaaaccggggggtttcccccgggtttacccgaaaccccgtacgtttaccccggtaccccggaaacgggtaaaccggtaaaacccttaaaacgtttaaaccccggaaaaaaaggttaaaaccgttaggtaaaagtttacgggtttaaataacggttaacggtaaacctaaaagtaaaccgggaaaccgtaaacgggtacccggtaagggaaacgggtaaccgggaacccgggaaacgggtaaccccggtaaacccgggttaacccgtttaagtttaaccgttttcggtaaggtaaccggaaacgggtaaacggtaccgggtccgggtaaactaaacgtttaggtaacggttacccggtaacccggttaaaccggtacccggggttagggtttaacg

SEQ ID NO: 292423 - DNA, 705 bp, Homo sapiens
  misc_feature: GYAE6OF02GBDT1.11.10.A10.1.454.CMB.1.raw
  modified_base (242)..(242): a, c, t, g, unknown or other
  misc_feature (242)..(242): n is a, c, g, or t
tcagcgagagataccacgaccggtgctcgatttagcgtcgatctcaggggagctctgagagaggagcccagccctgggattttcaggtgttttcatttggtgatcaggactgaacagagagaactcaccatggagtttgggctgagcgtgtcgttttctaggtggctaagttttaaaggtgtccagtgtgaggtgcagctgttggagtcgtgggggagcttggtacagtccggtgggggtcncgtgagactcaccgtgtgcacgcctcgtggtacttcctaacctttaaacgaacctacgaccattcgagtcgttcggggtccccgaccgaggtcctacccggaagggggaacggggcgtaaggggcggttcgggtccttacggaggttagttggggtggttaaggttgggtaggtagcgtaagtacgttacgttccgcgtaagtacccgttccggtaaggaaccggggtcccggtactacctaacgtttcccgaaccgaaggaactaactaaacgttaccgaaaagtaaacgtgtaattagtaagttaactgtaacgtaaagttaccggaactaccgttacgagaacggacgacccgggagaacccgtacgggtaccttaatttcgtttacgtggtacgaaccgtaaggtcgtaccgggattaaggtactaggtcccgtacccgtaacggaccgttggggtaac

SEQ ID NO: 292424 - DNA, 858 bp, Homo sapiens
  misc_feature: GYAE6OF02IKPBA.11.10.A10.1.454.CMB.1.raw
  modified_base (255)..(255): a, c, t, g, unknown or other
  misc_feature (255)..(255): n is a, c, g, or t
  modified_base (287)..(287): a, c, t, g, unknown or other
  misc_feature (287)..(287): n is a, c, g, or t
tcagcgagagataccacgaccggtgctcgatttagcgtcgatctcaggggagctctgagagaggagcccagccctgggattttcaggtgttttctatttggtgtatcaggtactgaacagagagaactcaccatggagtttggctgagctggtcttttctgtggcttatttaaaggtgtccagtgtgtaggtgcagtctggttggagtcggtgggggaggtccgttgggtacgacggtccggtgggggggtaccncggtcggaagtccgtccgaccgtggtacgccncggtccttcgtggtacttcctaaccttaaacaaccgttacgcctaagtcgacgtccgtcggtcccgccgacggtccttaccggaagggtaaccggggtcgttaggggtaccggttggggttccgtaccggtaacggggtttagttcggggttaggtaggttggggttacggtacgacgtagggtacttaacggtcggacgtaacgaccgttacccggtagggtaacggggtccccggtttacaacccgtcggttaccctaccggtaaaggaaccgttaacgtaaaccgtttaaaccgaaaaggtaaaacgtttacggacgttttaacggtaaattttaacgagtaaaccgttaaaacgtacggaaacctaccggtaaccgttagggaaacggtacggtacccggggtaaaccggtacccgggtaacgttacccgggtttatttaaccggttttcccgaagggtttaccgggaaaccgttaaacgggtcggttaacccgggtaacttaacggttttaccggtaacgttccccggtaaaccccggtacggtacccgggttaggggttaacccg

SEQ ID NO: 292425 - DNA, 706 bp, Homo sapiens
  misc_feature: GYAE6OF02FVSUZ.11.10.A10.1.454.CMB.1.raw
  modified_base (195)..(195): a, c, t, g, unknown or other
  misc_feature (195)..(195): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccgaggggaaangccaccctctcctgcagggccagtcagagtgttaggagctaacttagcctggtaccagcaacgaaacctggaccaggcctaccccgaggccttcctcattctagtggtcgcactcccgacgacgggacctacgttcggttccccacgccgtaggttccaggtcggcgtagggtcgggtcgtaggacgacgtagtacgttccacgttcctccaacctacgtaccgaaccgggtccttacggcctacggtacgtaggtaaagtttacgttttacggaccgtttaggttttactttacgttaggtaccgtaacgtaccgttaaagttaatttaaacgttaaccggtcggttacccggttaccgggtaccgttacgggacccggtaaacgggaaccgtaaagggtacggtaaacgtacgaaaccgtacgtcggttacgggaccttacgggaccctaccgtaagtttcccgtacgtttacccgttaccgtaccctttccccggttacccgtacccg

SEQ ID NO: 292426 - DNA, 699 bp, Homo sapiens
  misc_feature: GYAE6OF02HSFY2.11.10.A10.1.454.CMB.1.raw
  modified_base (182)..(182): a, c, t, g, unknown or other
  misc_feature (182)..(182): n is a, c, g, or t
  modified_base (198)..(198): a, c, t, g, unknown or other
  misc_feature (198)..(198): n is a, c, g, or t
  modified_base (238)..(238): a, c, t, g, unknown or other
  misc_feature (238)..(238): n is a, c, g, or t
tcagcgagagataccacgaccggtgctcgatttagcgtcgatctcgaggggggaactgctcagttaggacccagacggaaccatggaagccccagcgcagcttctcttcctcctgctactctggcctccagatagcactggaagaaatggtgatgacgcagtctccagcccacctgtctgtntctacgaaggggaaancgcccacctctcctgcgaggccagtacagtagtgtagganactaattcgctaggtacagacaagaacctggaccacggtccacccgtaggtccttcccgagtacgttaccttagtggtactcgtaactcccgaaccgacggtccaacgtttccggttacccgagtacccgtaaggttctaggtacggtacgtacgggttagggtccggtagggtacctaggtaccttaccaaccgttactacccgaaacctactacacggacctagaccttaaggacccgtcgtagggtacgtttactttacggctttaagttttactagttaccgtatacgcgttagaccgtacgtacggtagtaccggtacgttacctaacccggttcgggaaaccgaaacggtacctaaccggtaacgttaaccggtaaaagttaaccggtagtggtaccggtctaaccggactaacccgttctacggttacttaacttacgtccttacgttaccccg

SEQ ID NO: 292427 - DNA, 636 bp, Homo sapiens
  misc_feature: GYAE6OF02FVZ6J.11.10.A10.1.454.CMB.1.raw
  modified_base (194)..(194): a, c, t, g, unknown or other
  misc_feature (194)..(194): n is a, c, g, or t
  modified_base (231)..(231): a, c, t, g, unknown or other
  misc_feature (231)..(231): n is a, c, g, or t
  modified_base (349)..(349): a, c, t, g, unknown or other
  misc_feature (349)..(349): n is a, c, g, or t
  modified_base (364)..(364): a, c, t, g, unknown or other
  misc_feature (364)..(364): n is a, c, g, or t
  modified_base (379)..(379): a, c, t, g, unknown or other
  misc_feature (379)..(379): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcaccggagaaattgtgttgacacagtctccagcccaccctgtcttgtctccaggggaaangccaccctctcctgcagggccagtcagagtgttaacngctattagcctggtaccaacagaaacctggccagactcccaggcctacctcatctatgatgcatccaagacgggccacgtgccacccgagccaggttcagtggcaggtggctgggacngacttcactcacacntcagcacgcctaganccgtgaggttatttcgactttagtttacttacgtcgttacgacgtacgtacgttcgttaacgtccggtactacgggtacttacccgtaacccggtttccgggaacccgtaaacggggtaccgtaaccggtaacgtaaagggtaaaaccgtttaaaccggtacgtcgggttaacggccgttacggaacccgtaaccgtagttaccggttacgtttaccttacccgttaagtttccccctttaccccgtaccttaaccg

SEQ ID NO: 292428 - DNA, 703 bp, Homo sapiens
  misc_feature: GYAE6OF02H47K0.11.10.A10.1.454.CMB.1.raw
  modified_base (298)..(298): a, c, t, g, unknown or other
  misc_feature (298)..(298): n is a, c, g, or t
  modified_base (556)..(556): a, c, t, g, unknown or other
  misc_feature (556)..(556): n is a, c, g, or t
tcagcgagagataccacgaccggtgctcgatttagcgtcgatctcaggggagctctgagagaggagcccagccctgggattttcaggtgttttcatttggtgatcaggactgaacagagagaactcacatggagtttggctgagctggtctttttcttgtggcttaattttaaaaggtgtccagtgtgaggtgcagctgttggagtcggtgggggaggtcgttgggtacacgccggtggggggtcgtcgtaagactcacctgtgcacgcctcgtggacttctacctttaacaactacnccatgagcgtcggcccgccgaggccgtccgaggggagggcgtgggaggttgggtctcggtaggtagtttgggtaggggttaggttgggttgggtaggacgtaaggtactttaacgttccgacgtacggtaccgtcccgggtagggtaaaccgggggtcccgtttaccgaccgtacttccgtacccgaagacgaactaactttacccgaaaaagtaaactgtagttagtaagttacgacgtacaaaagtacgtaaaccnggtaccgtaaggagtaaccggaccggaacggtaccggaacccggtccggttaagttacttttccgagggtacgaacggtaaacggacggtacgggataacgttaggtagttaccgaccggttaccgtacgggttacgggtattacgg

SEQ ID NO: 292429 - DNA, 772 bp, Homo sapiens
  misc_feature: GYAE6OF02IAEFS.11.10.A10.1.454.CMB.1.raw
  modified_base (195)..(195): a, c, t, g, unknown or other
  misc_feature (195)..(195): n is a, c, g, or t
  modified_base (400)..(400): a, c, t, g, unknown or other
  misc_feature (400)..(400): n is a, c, g, or t
tcagcgagagataccacgaccggtgctcgatttagcgtcgatctcgaggggggaactgctcagttaggacccagacggaaccatggaagccccagcgcagctttctccttcctcctgctactctggctccagatagcactggagaaatagtgatgacgcagtctccagcccacctgtctgtgtctcgagggaaancgcccacctctcctgcacgggcaagtcagagtgttagagactaactgcctgtaccaagccaacgaaaccgtcggaccaagggccctaccccgaggtcctaccttcaaattcctagttggtctacacctccgaaccgacgggaccctacgtttccggttacccaggtccgtaagggttccaaaggttcggacgtacgtcggggttntaggacgaacgtaggtaccgttactacctaccgtacctaacctactaccggaaacccggtcctacgtaccggtataacgtacgtaaagtttacgtttagacgtttaacggttttaacgttacctttaggtacgtaacgtacgttaaaggttaaccttaaaacgttacgtaccgggttaccccggtacggtaaccggttttaccgggaaccggtaaacgggtaccggtaaacgggttacgggtaaacgggtaaacccgtaaaccggtaaccgttacggtagggttaacccggtaccggttaaccgtaacccttagttaaccgttttcggttaccttttacccggtacgtttacccccgttcccggtaaccccg

SEQ ID NO: 292430 - DNA, 834 bp, Homo sapiens
  misc_feature: GYAE6OF02HGX0A.11.10.A10.1.454.CMB.1.raw
  modified_base (263)..(263): a, c, t, g, unknown or other
  misc_feature (263)..(263): n is a, c, g, or t
tcagcgagagataccacgaccggtgctcgatttagcgtcgatctcaggggagctctgagagaggagcccagcccctgggattttcaggttgttttcatttggtgatcaggactagaacagagagaactcaccatggtagtttgggctgagcgtggtctttttcgttgtggtacttaagttttaaaggtgtaccagtgtgaggtgcagtctggttggagtcggtgggggacggtcgttcggtacgcggtccggttggggggtcncgtagacgacgtaccaccgtgtcgacacgtcccttcgtggtactttaccgtaacctttaaaccaaaccgttaccgaccctaagtacggacggtccgtcggggtcccgaccggtacggcccgtaccgggaaggggggaacgggtcggtagggtacgggttcgggtacgttacggtaacggtttacggtttggggtagggttacgggttggggtagggttacggaccgtaagtacgttacgtcgacgtaacgtaccgtccgggtacgggtaacccggggttcccgttaccaacccgtactaccttaccggaagtaactaacgtaaacgtttaaaccggaaaagaaaagttctaaaggttacgtaaagttagccgtaaacttaaacgtaagaaccgacgttaccgtaggaaacggtcggaaccggtaaacgggtacccgtacccggtaaccgtttaagtttccgtttaccggtaggttaacccggaaaagggttaacccgtggttaacccggacgtttaacgacggttaaccggttaccctaccggggttaaaccgtacgggttgggttaaccg

SEQ ID NO: 292431 - DNA, 689 bp, Homo sapiens
  misc_feature: GYAE6OF02HEDKO.11.10.A10.1.454.CMB.1.raw
  modified_base (202)..(202): a, c, t, g, unknown or other
  misc_feature (202)..(202): n is a, c, g, or t
  modified_base (365)..(365): a, c, t, g, unknown or other
  misc_feature (365)..(365): n is a, c, g, or t
tcagcgagagataccacgaccggtgctcgatttagcgtcgatctcaggggggaactgctcagttaggaccagacggaaccatggaagccccagcgcagcttctcttcctcctgctactctggcctcccagatagcaacgtggaagaaatagtgatgacgcagtctcagcccacctgtctgtcgtcctacggaaggggaaacncgccctacctctcgtgacgacgggccaagtcaggtgtagtaggatactaacgttcgccgtgggaacacgacgaagtaaccgtcggaccgacggcctaccgaggcctccgtacacttcgtagtcggtcactactccgacgaccggtcctacggtttcgtaccgngtaccgtaggtcgaggtcgacgtaggtcgggtcaggtacgacgtaagtacggttcctacgtactaccggtaacctacgtcccgtaagtccgtagaccgttaacgtacgtacggtaagttacgtttcggtaacgtttaacgtttattacgtacggtacctaagtacgtaacttaaacgttaacgtaaaccggtccggtaaccggttccggtaacgtccggtaacggaacggtaacggttaaacggaaggtacgtaacgtaaccgtaggtacgtacgtcgtacgacgacgtactcggtctacgttactaaccgtccttacgtaccg

SEQ ID NO: 292432 - DNA, 773 bp, Homo sapiens
  misc_feature: GYAE6OF02IKYSU.11.10.A10.1.454.CMB.1.raw
  modified_base (259)..(259): a, c, t, g, unknown or other
  misc_feature (259)..(259): n is a, c, g, or t
  modified_base (290)..(290): a, c, t, g, unknown or other
  misc_feature (290)..(290): n is a, c, g, or t
  modified_base (468)..(468): a, c, t, g, unknown or other
  misc_feature (468)..(468): n is a, c, g, or t
  modified_base (720)..(720): a, c, t, g, unknown or other
  misc_feature (720)..(720): n is a, c, g, or t
tcagcgagagataccacgaccggtgctcgatttagcgtcgatctcaggggagctctgagagaggagcccagccctgggattttcaggtgtttttcatttggtgatcaggactgaacagagagaactcaccatggtagtttgggcgtgagcgtggtcgttttcgtgtgtcttattttaaacggtgtcctagtgtgtaggtgcgagtcgttgttggagttcggtaggggagtcgttaggtacgcggtccggtggggggtcncgtcggacggtacgtacgtaccgtcgtacgngacggtcctcggttggtacgtttactaaccgttttaaacaacgttacgacctaagtcgagtccgttacgggtccgaccggagtaccgtacggaggggaacgggtccggtggggtacggtagggttccgtacggtagggttaccggttgggtaggttaggtcggggttaggttaacggntaaacggtcgttaaacgttcgacgtacgtaccgtacggttacggaacgggtcccgttacgtaacctacgttaccgtacgtacgacgtaactaaccgtaactaagtaaacgtagagttaacgttatacgtaacgaacgaaacgtacgtaaacggtaaccttacgtaaggtaccgggactaacccgggaacgaaccggtaaaccgacccggtttaattagttcggtttagagggtaaaccgttagtacccgggngtaacgtaacgttacggttcggtacgtaccggaacgggtacgttcgggtaagg

SEQ ID NO: 292433 - DNA, 1007 bp, Homo sapiens
  misc_feature: GYAE6OF02GA8Q2.11.10.A10.1.454.CMB.1.raw
  modified_base (207)..(207): a, c, t, g, unknown or other
  misc_feature (207)..(207): n is a, c, g, or t
tcagcgagagataccacgaccggtgctcgatttagcgtcgatctcaggggagctctgagagaggagcccagccctgggattttcaggtgttttcatttggtgatcaggactgaacagagagaactcaccatggagtttggctgagctggtctttttcttgtggtcttaattttaaaaggtgtccagtgtgaggtgcagcgtgttggngttcggtgggggtaggtcgttggtacgacggccggtggggggtcgcgttgagtactacctaccgtgtcgcacgtccctcgtggtacttacctaaccgttttaaaccaacttaccgaccctaagttggaacggtccggttccggggtccccgtacccggaacgggtcccgtacccgggaaacggggggacgggggtccgtagggggtaacgggtttggggtcccgttaaggtaacggggttttagtttggggtttaggggtttaagggtttgggggttagggtttaacgggtacggtaaggtttaacgtttaccggtttaccggtaaccgtaaccggtaaacccggttttcccggggtaaggggttaaacccggggggttaccccgggttacccgtaaaccccgttaaccgttacccgttaacccgaaacgggtaaccgtaaaaccgtaaaccgtttaaaacccgtaaaaaacgggtaaaaagtttacgggttaaagtttaacggtttaaacgtttaacggtaacgaaacctttaaaaggtaacggtaaaacccgtacgggttaacccttaagggaaccggggttaaaccgggacccgggttaaacggggtaaaccccggtaacccgggttaaccgttttaaagttttaccgttttacgggtttagggttaacccggtaaaccgggggtaaaagtttaaccccgggtacggggttaacttaaaccggtttaaggtttaaccccgggtacggtttaacccccgggttaacccgggggttacgggtttaccggggtttaaggg

SEQ ID NO: 292434 - DNA, 752 bp, Homo sapiens
  misc_feature: GYAE6OF02JYXPC.11.10.A10.1.454.CMB.1.raw
  modified_base (142)..(142): a, c, t, g, unknown or other
  misc_feature (142)..(142): n is a, c, g, or t
  modified_base (174)..(174): a, c, t, g, unknown or other
  misc_feature (174)..(174): n is a, c, g, or t
  modified_base (186)..(186): a, c, t, g, unknown or other
  misc_feature (186)..(186): n is a, c, g, or t
  modified_base (197)..(197): a, c, t, g, unknown or other
  misc_feature (197)..(197): n is a, c, g, or t
  modified_base (206)..(206): a, c, t, g, unknown or other
  misc_feature (206)..(206): n is a, c, g, or t
  modified_base (333)..(333): a, c, t, g, unknown or other
  misc_feature (333)..(333): n is a, c, g, or t
  modified_base (446)..(446): a, c, t, g, unknown or other
  misc_feature (446)..(446): n is a, c, g, or t
  modified_base (476)..(476): a, c, t, g, unknown or other
  misc_feature (476)..(476): n is a, c, g, or t
tcagcgagagataccacgaccggtgctcgatttagcgtcgatctcagggggaacgtgctcagttaggacccagacggaaccatggaagccccagcgcagcttctcttcctcctgctactctggctcccagatagcactgganaaatagtgatgacgcagtctccagccaccctntcctgtcgttcncctaggggaangccacctcncctgacaggcctagtcgagagtgtaggacgctaacgttaggcctcgggtacccaggtacaacgaaccgtcggaccacggtcctacccggacggccttaccccgtataccgttacttaggtcggtacncctaaccgttcccgaaccggaggggtcccccttaaccggtttcggtttaacccccgcggtacccgtaaggtttcccggaggtcggaccgtagggtcggttcaagggtacgtanacggggttactacccgtaactcccgttaanaccccaagttcccggtaacccggtaccgtacgtaccgtacgtacgttaacggttaaagttcgtttaacgttacgtttaaccgtttattacgttacgttacgtacgtacgttaagtaattaccgttaacgtccggttaccgaccggtcggttaccgtaacggaaaccggtaacggtaacggtaacgggaaagtttacccgaacgtacgttaggtcgggtacgttcaaccgacgttaactcggttacttcgttaccggtacttacccgtaccgttacg

SEQ ID NO: 292435 - DNA, 602 bp, Homo sapiens
  misc_feature: GYAE6OF02FMOJN.11.10.A10.1.454.CMB.1.raw
  modified_base (198)..(198): a, c, t, g, unknown or other
  misc_feature (198)..(198): n is a, c, g, or t
  modified_base (236)..(236): a, c, t, g, unknown or other
  misc_feature (236)..(236): n is a, c, g, or t
tcagcgagagataccacgaccggtgctcgatttagcgtcgatctcagggggggaactgctcagttaggacccagacggaaccatggaagccccagcgcagcttctcttcctcctgctactctggctcccagatagcactggagaaatagtgatgacgcagtcctccagcccaccctgtctgtgtctccgaggggaaangccaccctctcctgcagggccagtcagagtgttaggancaacttgcctggaccagcagaacctggccaggcctcccaggcctcctcatctatggtgcactccaccgagggccacgtcggcccaccccgagcccgtaggttcaggtcggacgtaggtcgggtacgtaggggacacgtacttacaccgttctaccaccgtactcgacgccacgccctaaggacgtccgtaggaggttactttacgcgttagttttaacttacgtcgttacgagtcctagtacgttactacggtacgtggtacttccgtaccgttccgggaccgaacgggtaccaccgacgttaggaaacttaaacggactaggtcggacgtacgactactacgtccttcgtacttcgtacttcccg

SEQ ID NO: 292436 - DNA, 520 bp, Homo sapiens
  misc_feature: GYAE6OF02FHMUJ.11.10.A10.1.454.CMB.1.raw
tcagcgagagataccacgaccggtgctcgatttagcgtcgatctcagggggaactgctcagttaggacccagacggaaccatggaagccccagcgcagcttctcttcctcctgctactctggctcccagatagcactggagaatagtgatgacgcagtctccagccaccctgtctgtgtctccaggggaaacagccaccctctcctgcagggccagtcagagtgttaggagcaacttagcctggtaccagcagaacctggccaggctcccaggctcctcatctatggtgcatccacagggccactggttcccagccaggttcagtgcagtgggtctgagcagagttcactctcaccatcaacgcctgcagtctgaagtattttgcagttttataccttgtcagcagtataataactcggccttcggacgtacggccgaacgggaccaacggtggaacgtagaaccgtaactagtggtctcgccaccacgtactcgtccttctacgtcttaccccggtccg

SEQ ID NO: 292437 - DNA, 703 bp, Homo sapiens
  misc_feature: GYAE6OF02GUB0K.11.10.A10.1.454.CMB.1.raw
  modified_base (193)..(193): a, c, t, g, unknown or other
  misc_feature (193)..(193): n is a, c, g, or t
  modified_base (371)..(371): a, c, t, g, unknown or other
  misc_feature (371)..(371): n is a, c, g, or t
tcagcgagagataccacgaccggtgctcgatttagcgtcgatctcagggggaactgctcagttaggacccagacggaaccatcggaacgccccagcgcacgcttctcttcctcctgctactctggctcccagatagcactggagaaatgtgatgacgcagtctcagccacctgtctgtgtctcgaggggaacncgccacctctcctgcgagggtccaggtcagagtgttaggcgctaacgttgccgttggtaccgtagtactaacggtaaccgtggaccgacggtcctaccgaggtcctacctactacttcgtagtggtcgacctacgtccgacgtacggcctacgttcgttaccagtccgtaggttacgngtcggcgtagggtcgtctaggaacgtcgtaggtacgttacaccgttaccgtaaccgaccgtaacgtaacccgtaccgggtccgtacggtacgtagttacgtaggtaacgtttacgtttacgtacggttaacgtttacgttacgtcgtaacgtacgtacgtaacgttaattaacgtacggtccggtaccgtacgggtaccgttaccggaaccggtaacggtaacggtacggtaacggtaacgtaaccgtacggtaaccggtcggtacggtacctacggtaacccgtacgtacgttacttaccggtaccttacgtacctaccgttacccgtacg

SEQ ID NO: 292438 - DNA, 702 bp, Homo sapiens
  misc_feature: GYAE6OF02I4UK1.11.10.A10.1.454.CMB.1.raw
  modified_base (248)..(248): a, c, t, g, unknown or other
  misc_feature (248)..(248): n is a, c, g, or t
tcagcgagagataccacgaccggtgctcgatttagcgtcgatctcaggggagctctgagagaggagcccagccctgggattttcaggtgttttcatttggtgatcaggactgaacagagagaactcaccatggagtttgggctgagctggtcttttctgtggctatttaaaggtgtaccagtgtgaggtgcgagcttgttggagtcggtggggggaggtcgttggtacgcggtccggtgggggggtcncgtggacgacctcacctggtgccgagccctcgtggtacttacctaacccttttaaaccaaacctaccgacctagtaggacgtcgtcgggtcccgccgacggcgtccggagggggaagggcgtagggtaggtgggtctaggtaggttagttgggtggtggtgggtggtagcgagtattcgtacgacagtacgtccggtaggacgggtccgtacgacctactcctccgaagacgactaaactaccgaaaagaaaagtgtaattagtaacttagtacgtaaactaaaacgtagaaacgacgtaccgtaggacggtacggaaccgggtaacggaaccggtaaccggtacgtttaagttacgttttacgaggttacggaaaccggtaaaggtacggtacggtaacttaacgtaagttacggtaccgtacccgggtaaccggtaccggtaggggttaacg

SEQ ID NO: 292439 - DNA, 691 bp, Homo sapiens
  misc_feature: GYAE6OF02GVK6L.11.10.A10.1.454.CMB.1.raw
  modified_base (220)..(220): a, c, t, g, unknown or other
  misc_feature (220)..(220): n is a, c, g, or t
  modified_base (234)..(234): a, c, t, g, unknown or other
  misc_feature (234)..(234): n is a, c, g, or t
  modified_base (416)..(416): a, c, t, g, unknown or other
  misc_feature (416)..(416): n is a, c, g, or t
  modified_base (628)..(628): a, c, t, g, unknown or other
  misc_feature (628)..(628): n is a, c, g, or t
tcagcgagagataccacgaccggtgctcgatttagcgtcgatctcgaggggggaactgctcagttaggaccagacggaaccatggaagcccagcgcagcttctcttcctcctgctactctggcctccagatagcactgggaagaaatggtgatcgacgcagtctccgacgccctacctagtctgtcgtacctaccggaaggggaaacacgccctacctcncgtgacggcggacngtcgagtagttcgtaggacgtactaacgttcgctaggtaaccgacgacaacgaacgtcggacgtacggcctaccgacgtcctcctacacgttctaggtacgtcgtacctacgcccaacggaccggcgttaacccgtttcggttaccccgacgttcccggtaacgggttcgtagtcgggtacncggggtacggttcgtaacggacgtaacgtacggttacgtccaccgtttacaccgttacgaccgaccggtacgtcgtacgacgtcgtacgtaagtacgtttagtgtacgtatttacttagtacgtacgagtacctaagtacttaaacgtcgtacggaccttaggtacgtccggtaacggtaacgaaccggaagtacggtacaacggtaaccgngtacgggttcgacgacgttaacgacttcggtacttctacgttcgacccgttcgtaacccgtcg

SEQ ID NO: 292440 - DNA, 731 bp, Homo sapiens
  misc_feature: GYAE6OF02FOP3J.11.10.A10.1.454.CMB.1.raw
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
  modified_base (210)..(210): a, c, t, g, unknown or other
  misc_feature (210)..(210): n is a, c, g, or t
  modified_base (310)..(310): a, c, t, g, unknown or other
  misc_feature (310)..(310): n is a, c, g, or t
  modified_base (367)..(367): a, c, t, g, unknown or other
  misc_feature (367)..(367): n is a, c, g, or t
  modified_base (381)..(381): a, c, t, g, unknown or other
  misc_feature (381)..(381): n is a, c, g, or t
tcagcgagagataccacgaccggtgctcgatttagcgtcgatctcaggggggaactgctcagttaggacccagacggaaccatggaagccccagcgcagcttctctcctcctgctactctggctcccagatagcactggaagaaatagtgatgacgcagtctccagccaccctgtctgtgtcctccgaggggaaancgccaccctntccngcgacgggccagtcagtgtgttaggagcaaacgttgcctaggtaccagcaacgaaacctggccgagcctacccgaggtcctacctaccatactagtggtnacgtactcccaaccgagggcctacgtccggtttcccagtccgtaggttcaggtcggntagggtcggggtcnggacgacgtacgtaccttacgacctctaaccaccgtattaccacgtaccgacgtccgtaaggacgtccgttaggaacggttttacgtttacggaccgtttaaagttttaaccttaacgtccgtttaacgaccggttaaccgtacgtaaccgttacgttaccggtaccgttaggttaacccttaaccggttacccgttaaccggggtaacccgtaaacgggggtaaacccaccgggttaacggttaaacggttaaaaaccgttaaacggtaaaccttcgggtaacggtaccgttaccggaaccgttaactcggttaccggttacgtttaccttaccgttacgttacccccg

SEQ ID NO: 292441 - DNA, 605 bp, Homo sapiens
  misc_feature: GYAE6OF02JI834.11.10.A10.1.454.CMB.1.raw
  modified_base (250)..(250): a, c, t, g, unknown or other
  misc_feature (250)..(250): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaatagtgatgacgcagtctccagccaccctgtctgtgtctccgaggggaaggccaccctctctgtagggccagtcagagtgttagcagcaactcgtagcctggtaccngcagacacctggccaggcctcccaggcctccgtcactccagtcggtcgccatcccaacgacgggcccacgtggaccataccccagacacggtttacaggtcgactaggttcggggtctaggggactacgtacttcgaacttctaccacgtatcagcagtactggacgccgtagacgtagtttcgcgtagttgtaacgtttactacgtacagtacgtaggtacggtacgttcacgttaccgtaccgtaccggttaccgaccggtaacgggtaccgtagggtacggtaaacgttaacgtaaacggtacgttacgtacggtacgtcgtaccgtaccgtaagtccgtacgtccttaccg

SEQ ID NO: 292442 - DNA, 701 bp, Homo sapiens
  misc_feature: GYAE6OF02JE4TA.11.10.A10.1.454.CMB.1.raw
  modified_base (201)..(201): a, c, t, g, unknown or other
  misc_feature (201)..(201): n is a, c, g, or t
  modified_base (217)..(217): a, c, t, g, unknown or other
  misc_feature (217)..(217): n is a, c, g, or t
  modified_base (473)..(473): a, c, t, g, unknown or other
  misc_feature (473)..(473): n is a, c, g, or t
  modified_base (503)..(503): a, c, t, g, unknown or other
  misc_feature (503)..(503): n is a, c, g, or t
  modified_base (640)..(640): a, c, t, g, unknown or other
  misc_feature (640)..(640): n is a, c, g, or t
tcagcgagagataccacgaccggtgctcgatttagcgtcgatctcaggggggaactgctcagttaggacccagacggaaccatggaagccccagcgcagcttctcttcctctgctactctggctcccagatagcacgtgaagaaatagtgatgacgcagtcctccgagcccacctgtctgtagttccaccgaaggggaaancgcccacccgtctcgngcgacggccagtcataggtcgtaaggcgtactagtacgccgttcggaccagtcaagaaccgtcggaccgaacggtccacccgtacggccttacctcacttacgttagtacggtcactaccgacccgtaccgacgggtacctacgttccgttaccccgagtaccgtagtaccgtaggtcgagttcgggtaggtccgtaagacgtagtaaacgtcgttactaccgttacccgataaacctcgtaaccggtacccgttnaccgagttactacggttagtaaacgttttnttaacggttaatacggtttttactaggtacgttacgataacgtataaacgtttacacgtcgacgttcggtacgtaccggacgtacggaactacgggtaacctaaaggtccttaacggcgtttacggcgtaaccgttnaacccgttaacccgtgttaaccgtttcgtaaccgttcctaccgttttcccgaccccgttcg

SEQ ID NO: 292443 - DNA, 774 bp, Homo sapiens
  misc_feature: GYAE6OF02JTAR7.11.10.A10.1.454.CMB.1.raw
  modified_base (195)..(195): a, c, t, g, unknown or other
  misc_feature (195)..(195): n is a, c, g, or t
  modified_base (752)..(752): a, c, t, g, unknown or other
  misc_feature (752)..(752): n is a, c, g, or t
  modified_base (768)..(768): a, c, t, g, unknown or other
  misc_feature (768)..(768): n is a, c, g, or t
tcagcgagagataccacgaccggtgctcgatttagcgtcgatctcaggggagctctgagagaggagcccagccctgggatttcaggttgtttcatttggtgatcaggactgaacagagagaactcaccatggtagttggctgagcgtggtcttttctgtggtacttaagtttaaaggtcgtccagtgtgagtgcngtctggttggagtcggtagggggacggtcgttggtacgacggtccggtggggggtcgacgttggacgtaaccgttccgaccgttcgtcgccgtacgtccgtcgttggtacttcctaaacctttaaacaaccgttaccgacctagtacggacgtccgtcggggtcccgtaccggtaacggcccgttaccgggaacgggggtaacggggtcgtacggggtaaccgggttacggggttccgtaccgggttaagggttaaggtttcggggtacgggttaagggttcgggtaacgggtggtacgtaaggtacgttaacgtacgacgaacgtaccgtaccggtaaggtaccgggtaccggttaccaacccgtggttccaacgtaacgaacggtaaactaaccgttaaacgaaaaacggtaaacttagacggttaactaagttacgaacgttaacaaaggttaccgaaaacgtcgaaccgtaggaacgtacggtaacggaaccgaccggtacggtaacttagtactagtacgtagaacgtaaggcgtcgaacttagtacggttnccggtactaggtcggnggttac

SEQ ID NO: 292444 - DNA, 551 bp, Homo sapiens
  misc_feature: GYAE6OF02FPBWZ.11.10.A10.1.454.CMB.1.raw
  modified_base (194)..(194): a, c, t, g, unknown or other
  misc_feature (194)..(194): n is a, c, g, or t
  modified_base (293)..(293): a, c, t, g, unknown or other
  misc_feature (293)..(293): n is a, c, g, or t
  modified_base (496)..(496): a, c, t, g, unknown or other
  misc_feature (496)..(496): n is a, c, g, or t
  modified_base (512)..(512): a, c, t, g, unknown or other
  misc_feature (512)..(512): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccgaggggaangccaccctctcctgcagggccagtcagagtgttaggagacaacttaggcctggtaccagcagaaacctggccagctcccgagctcctcatctatggtcncactcccaccgacgggccctaacgtcggttttcccagtccgtagggtttccaaggtggcgtaggtgggtctggagacagtagttcactctccacatcaacggcctgctagtctagaagttacgtttgacttagttttactacgttgtcgagtctaagtataacgtacgtcgtcgtacggtcgtcggacgaacgggtaacaggngaagtacgaagtacgnggtgcgtgcgacgtatctcgttctcgacttcctccgtcc

SEQ ID NO: 292445 - DNA, 798 bp, Homo sapiens
  misc_feature: GYAE6OF02HW3PZ.11.10.A10.1.454.CMB.1.raw
  modified_base (198)..(198): a, c, t, g, unknown or other
  misc_feature (198)..(198): n is a, c, g, or t
tcagcgagagataccacgaccggtgctcgatttagcgtcgatctcagggggggaactgctcagttaggacccagacggaaccatggaagccccagcgcagcttctcttcctcctgctactcgtggctccagatagcactggagaaatagtgatgacgcagtcctccagcccaccctgtctgtgtctacgaagggaaancgaccaccgtctcctgcgaggccagtcagtgtgtaggagactaactgccgtaggtaccagacaacgaactcgaccgagcctaccaggtcctacctctactcgtagtgtcgactactacccaccgtacggacctaccgttcggtacccacggtaccgtacggttacgacgtcggtacgtaggtcgggtctaggacgtaacgtaggtaccgttacaacgttccgtaacctaaccgttaacgtaccccggtaaacccgggtccttacgaacgttaacgggttttaccgaagggttaaattttaacgggtttccgtaaacgtttttaacgttttaccttaaccggttaaggtacccgaaggttaaccgttaagttaaaataaccgggttaaaccgttccgggtaacccgggttaccgggttaaaccgggtttcccggaaaacccgggggtaacgttaaaacccgggggtaagggttaaccgtaaaacggtaacccggtaaacggtttaaggttcccgggtggtaaccgttccgttaaacccaaggtttacgttacccggtttaacgtcctttaacccgttcccgtttacccggtaaccccctcg

SEQ ID NO: 292446 - DNA, 734 bp, Homo sapiens
  misc_feature: GYAE6OF02G231J.11.10.A10.1.454.CMB.1.raw
  modified_base (176)..(176): a, c, t, g, unknown or other
  misc_feature (176)..(176): n is a, c, g, or t
  modified_base (185)..(185): a, c, t, g, unknown or other
  misc_feature (185)..(185): n is a, c, g, or t
  modified_base (188)..(188): a, c, t, g, unknown or other
  misc_feature (188)..(188): n is a, c, g, or t
  modified_base (190)..(190): a, c, t, g, unknown or other
  misc_feature (190)..(190): n is a, c, g, or t
  modified_base (202)..(202): a, c, t, g, unknown or other
  misc_feature (202)..(202): n is a, c, g, or t
  modified_base (208)..(208): a, c, t, g, unknown or other
  misc_feature (208)..(208): n is a, c, g, or t
  modified_base (226)..(226): a, c, t, g, unknown or other
  misc_feature (226)..(226): n is a, c, g, or t
tcagcgagagataccacgaccggtgctcgatttagcgtcgatctcaggggagctctgagagaggagcccagccctgggattttcaggtgtttttcatttggtgatcaggactgaacagagagaactcaccatggagtttgggctggagcgtcgtgtttctaggtgctatttaaggntcagtgtgngtncngctgtgagtcgngggcgntgtacagcgtgggggtcncgtgagacgtcacttggcgcacggccttcgtggtacttacctaacctttaacaacctaccgtacctagtacgcggtcgtcgggccgccgacggtcgtaccggaggggtaacggggcgtggggtacggttcggggtccgtacgggtaaggttggttagggttggttaggttggggtacggtaacgcgaaggttaagttaccgtttacgactacgacccgtttacgggtaacggggtacgggtaccccgttaccgaccgtacttaaaccggtcccgaaaggtactaacttaaactaaacccgtaaaagtaaaaccgttagaaattttaggaattaactaacgtaaacgtaaactaagaacccgtaggtacgtacggtaacggacggtaacgacgggaaaccggtaccggtaccgttattacggtttcggtacgtacgggtaaacggttaaggaccggacggttacgttacggttaactgtaccgtacgtacccggtaggtacgggttagg

SEQ ID NO: 292447 - DNA, 956 bp, Homo sapiens
  misc_feature: GYAE6OF02HE306.11.10.A10.1.454.CMB.1.raw
  modified_base (97)..(97): a, c, t, g, unknown or other
  misc_feature (97)..(97): n is a, c, g, or t
  modified_base (209)..(209): a, c, t, g, unknown or other
  misc_feature (209)..(209): n is a, c, g, or t
tcagcgagagataccacgaccggtgctcgatttagcgtcgatctcaggggggaactgctcagttaggacccagacggaaccatggaagccccagcgnagcttctcttcctcctgctactctggcctccagatagcactggaagaaattaggtgatggacgcagtcctccagccctaccctgtctgtacgtcgtaccggaaggggaaacnccgacccctacccttcaccgtggaccgacgggcccacggtcgaaggtagttgggttaacggacgtacctaaacgttacgcccgttacggtaacccacgaccgtaaaacggaacccggtagggaccccgacggtccctaccccggacggttcccctacctactacgttacgttacggttggtaccgaacctaccccgtacccgaccgggtaacccgggtccccttaaccggttttcccggttaccccgagggttacccgttacggggttcaacggggttcggacgtttacgggtcgggttacgtacgaacggtacgtagttaaccgtaccgtacccttacgaccgtaaccgtaccggtacgaccgggtccacgtaccgtacgtttacgtaagggttaacttttagttaccgttaacgtttacgttttaactttaccggttacggttaaccgtacggttaaacgttacggttttaaaacttaccgggttaaaccggttcccggttacccgggttaaccgggggtttaacccggttaacccggggttaaacccgggaaacggggtttaaccgggtaaaaacggggtttaaccgggtaaacccggtttaaacccggggaaccgtttaacccggggtaagggttccccgggttaaccggttccggtaaaacccgttacccggttcgtttaacccggtttaccgtttcccggtttaaccccgtttacccggttaccccgtttaccccgtaacg

SEQ ID NO: 292448 - DNA, 895 bp, Homo sapiens
  misc_feature: GYAE6OF02F2QGS.11.10.A10.1.454.CMB.1.raw
  modified_base (236)..(236): a, c, t, g, unknown or other
  misc_feature (236)..(236): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagcccaccctgtctgtgtctccgagggaagagccaccctctcctgcgacggccagtcgagtagtgttagganactaacgttacgaccgtggtaccagcaacgaaaccgtcggccgaacggcctccccgaacgggtcccttcccgtaccgtacgttccttaagtcgggtcgtaccgaaccttacccgaacccgggtaacgggtccctaaccggttacgggttacctaccccccgaacggtaccccggtaacggtttaccggacggttcggtacggtaaggggttccggggttacggttacggggaacggtaacggttaacggttacgtacccgtttacctaacccgtaaccgttaaccgtaccgtaacggcccgtaaccgtccggtacgttcccggtaacggttaccggtacgttaaacggtttacgttttacggttaaacgtttttacggtttttttaaccgtcggtttacccgtaggttaaccgttaaagggtttacgtttaaacgggttaacccgtacgggttacccctttacccggtttaaccgtttaccgggttttacgggaaaccccgggtaacgggggtaaaccttaaacgtaaccgggttaaacgtaaacccgttaaacggtaaaaccggtaaaccgtttaagggtaaccgggttaaccgtttaccggaacccggtaacccttaaccggttctttaccccggttacgtttaccgttaacccccg

SEQ ID NO: 292449 - DNA, 742 bp, Homo sapiens
  misc_feature: GYAE6OF02HQ8D4.11.10.A10.1.454.CMB.1.raw
  modified_base (236)..(236): a, c, t, g, unknown or other
  misc_feature (236)..(236): n is a, c, g, or t
  modified_base (335)..(335): a, c, t, g, unknown or other
  misc_feature (335)..(335): n is a, c, g, or t
tcagcgagagataccacgaccggtgctcgatttagcgtcgatctcaggtgggaactgctcagttaggacccagacggaaccatggaagccccagcgcagcttctcttcctcctgctactctggctcccagatagcactggagaaatagtgatgacgcagtctccagcccaccctgtctgtcgtctccgaggggaagacgccaccctctcctgcagggccagtcagagtgttaggancaacttgccgtggtaccagcaagaacctggccaggcctcccgaggcctctctatctagtggtcgacgactccaccgagggccctacgttcggttacccnggtaccgtaggttcgaggttcgccgtaggttcgggtactggacgacgaggtactcctacgtcctacgtaaccgtaacgttaccgaaaccgggtcccttacgggacctaggttacccgtaagggtaacgttttacgtttacgtaccgtttaaggtttttaaccgtttaacgttagttacctaaggtacccttaaaggtttaacctaaacgttaaacccggttcgggaccggtttacccggggtaacgggttacccggtaaccggtaaaaccgggggtaacccggtaaaggggttacggtaaaccggtaaccgtaaaacggttaaccggtcgggttaccggtaccggttacggacccttaacccgtacgttaccgtccttacgtttacccttacgttccccgttacccg

SEQ ID NO: 292450 - DNA, 949 bp, Homo sapiens
  misc_feature: GYAE6OF02G1SMR.11.10.A10.1.454.CMB.1.raw
  modified_base (249)..(249): a, c, t, g, unknown or other
  misc_feature (249)..(249): n is a, c, g, or t
tcagcgagagataccacgaccggtgctcgatttagcgtcgatctcaggggagctctgagagaggagcccagccctgggattttcaggtgttttcatttggtgatcaggactgaacagagagaactcaccatggagtttgggctgagctggtctttttcttgtggcttaagttttaaaaggtgtccagtgtgaggtgcagctgttggagtcggtgggggaggtcttggtacgacggccggtggggggtcncgtgacgacctcgaccgtggtcgcacgccgtcgtggtacttaccgtaaccctttaaaccaacctaccgaccctagtggacgtcggttcggggtccccgaccgacgggtccgtaccgggaagggggtaacggggcgttaggggaggttcgggtctcggtaggttagttgggtgggttaggtgggtaggtagcgaagtacttacgttcggacgtaaggtacccgttccgggtaacggggtaaccggggtacccggttttacccaacccgtacgtttcccgtaacccggtaaaggaaaccggtaaacccttaaaaacgtttaaccccggaaaaaaaagggtaaaaacttacgggtaaaactttaagggtttaacgttaaacgtaaccggtaaaaagtttaaaaaccgtaacgggttaaaaacccaacccggggttaaacccgtttaggggaaaaaacccgggggacccgggtaaaaccccggggtaaaacgggggtaaaacccccggttaacccggggttaaacccttttaaaggtttttaccccggtttttaccgggttaacgggtttaacgggaaaaaccggttaaaaacgggtccgggtttaacccgggaactttaaaacgggttttaacggtaacgggttttaccccggaaacccggtttaaaccccgggtttaccgggggttaaggggttttaaacgg

SEQ ID NO: 292451 - DNA, 653 bp, Homo sapiens
  misc_feature: GYAE6OF02JXWEW.11.10.A10.1.454.CMB.1.raw
  modified_base (158)..(158): a, c, t, g, unknown or other
  misc_feature (158)..(158): n is a, c, g, or t
  modified_base (196)..(196): a, c, t, g, unknown or other
  misc_feature (196)..(196): n is a, c, g, or t
  modified_base (231)..(231): a, c, t, g, unknown or other
  misc_feature (231)..(231): n is a, c, g, or t
  modified_base (278)..(278): a, c, t, g, unknown or other
  misc_feature (278)..(278): n is a, c, g, or t
  modified_base (298)..(298): a, c, t, g, unknown or other
  misc_feature (298)..(298): n is a, c, g, or t
  modified_base (332)..(332): a, c, t, g, unknown or other
  misc_feature (332)..(332): n is a, c, g, or t
  modified_base (437)..(437): a, c, t, g, unknown or other
  misc_feature (437)..(437): n is a, c, g, or t
tcagcgagagataccacgaccggtgctcgatttagcgtcgatctcaggggggaactgctcagttaggacccagacggaaccatggaagccccagcgcagcttctctcctcctgctactctggcctccagatagcactggaataatagtgatgacgacntcctccagcccacctgtctgtcgtctacgaagggtaanctcccacctcctcagccgagggacctagtacgagnggttgtaacggctacacgttagccgtagtaccagacgaacgaaccgngtaccgacggccgtacccgnggtcctacctctactacgtacgtggactccgacncccgacggtacgacctacgttccggtaccacgtaccgttagtcgtagcggtacgtgggtacgtagtcggaagacggtacgttctaccgacttccgacctaaccgnttaccgaccgtcgtcgacgtctacgagttagtcgttaacgtcgtttaagttctaacgtcgttacagttaccgtaaattacgtaaccgttacggtcggtacccgtacgggttcgaccggtaacgacggtaacggtaagtacggtaaacgtacgtacgagtacggtacgtacgtacaccgtacctcgtacttcgtcctacgttctcccttacggtacc

SEQ ID NO: 292452 - DNA, 994 bp, Homo sapiens
  misc_feature: GYAE6OF02JN6GT.11.10.A10.1.454.CMB.1.raw
  modified_base (144)..(144): a, c, t, g, unknown or other
  misc_feature (144)..(144): n is a, c, g, or t
tcagcgagagataccacgaccggtgctcgatttagcgtcgatctcaggggctgtcgtgatgattgcgtggtgggactctgtcccgctccaaggcacccgctctctgggacgggtcgccccccggggtttttgactccgtggggngacttagcagccgtctgcttgcagttggacttcccaggccgacaggtggtctggcttcgtggagggtcaggtccgagtaacgtggtgggggtacgtcgggacggccagcgacggtacgggttccagtggacgggaaacgggtcgaagggtaccgacggggaccctaccgggaactacgggttaccgacggttccccttaccgagttcgggtaccggaccgggtccccgggaagtaccggtacggtaacgggttcctcgggtggggttccggtacggtttttgggggtttttggagggggttcgaaacgggtcgtaggtaaaccttcgttttacgcggtaaccgttaggttttcggacgtttaactttaaccgttaaccgttaccttaacgttaccgttaacgaggttaccgggttaaccggtcggttaacgggggaaccggtaaaaccggtacccggtacggtttacccgtaccccggttaccgtttacgtacccggtaccggtcccgttaacccgggaaacccggttaccggggtacccccttaaggttttccccccggttcccgttacccccggtttacgggaccccccgttacccgttaccccgttaacccggtaaacgggtaacccggttaccccggttacccgggttttacccgggggacccgggggttaaacccacccggggacccgggggttaaccccggtcccccggggtccggggtttaacccggtcccggtttaaccccgggggttaccgggttaaaccggtaaacccgggtttacccgtttaccccggttaacccgggtttaccgtaacccgggttttcccggtacccgggttcccggg

SEQ ID NO: 292453 - DNA, 774 bp, Homo sapiens
  misc_feature: GYAE6OF02GCRNC.11.10.A10.1.454.CMB.1.raw
  modified_base (240)..(240): a, c, t, g, unknown or other
  misc_feature (240)..(240): n is a, c, g, or t
  modified_base (665)..(665): a, c, t, g, unknown or other
  misc_feature (665)..(665): n is a, c, g, or t
tcagcgagagataccacgaccggtgctcgatttagcgtcgatctcaggggagctctgagagaggagcccagccctgggattttcaggtgttttcatttggtgatcaggactgaacagagagaactcaccatggagtttgggctgagctggctttttctgtggcttaattttaaaaggtgtccagtgtgaggtgcagctgttggagtcgtgggggagtcttggtacaggccgtgggggtcncgtggagactcaccgtgtgcgagccctgtaggtattccgaaccttttaaacaaccgttacgaccctaagtcggacgtccgttcggggtccccgaccgacgggtcctacccggaagggggaacgggggtccttggggaacggttcggggttaccctaggtaacgggtttacgtttggggtacggggttaaggttggggttacggtaacgccgtaaggtacgttacgttcggactaacggtaccgttccgggtaagggaaccgggttcccggttaccaaccgtacttacccgtaccgaaaggtaactaacccgtaactttaacccgaaaaagtaaacgtcggtaagttaagtacgtttaacgacgtaaacttaaacgacgtaaaccgtaacgtccgtaagggaaccgacggaaccgtaacggaaccnccgggttacttaagttaccgttttcgacggtacggaaacggtaaacgtggtaccgggaattagttaacgtcggtaccggtaccgttaaccgggtacgggtaggttaacg

SEQ ID NO: 292454 - DNA, 936 bp, Homo sapiens
  misc_feature: GYAE6OF02I9HCK.11.10.A10.1.454.CMB.1.raw
  modified_base (195)..(195): a, c, t, g, unknown or other
  misc_feature (195)..(195): n is a, c, g, or t
  modified_base (362)..(362): a, c, t, g, unknown or other
  misc_feature (362)..(362): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccgaaggggaanacgcccaccctctcctggacgacgggacctagtcgaggtagttagggttaaggacgacctaacgttacgaccgttacgggtaacccaggaccaaaccggtaacccgtcgggacccaacgggtccctacccgacggtcccttacctaccacttcgttagtcgggtacncctacctaccccgaccggacggcccttaccgtttccggttaccccaggtacccgttaggttacgtaggtcggacgtgggttacgggtccaggtacgaacgacggttacgtacctaccttcgtaacccacgttaaccgtacccgaaccgggtcgttacccggacgttaaccgggtagtttaacgggtaaccgttttacggtttttaaccgtaacgtttttacgggttttttaaccgttacggttttaccggttaccggtaaacggttaaccgttaaaggtttaaacccggttttaaacgacccggggtttacccggttaaccccgggtttacccgggtttaaaccccggggttacccggggtaaaccccgggttaaaaccgggggttaacccgggtaaaacggggttaaccgggttaaaacccgggtaaacccgttaaaccggggtaccggtttaacgggttacccgggtacgttaaccccggtaacgtttaaccccggttaccggtttaccgtttaacccgttttccgtttaaacccccggttccgttttacccccccgtacccggtttaaccg

SEQ ID NO: 292455 - DNA, 696 bp, Homo sapiens
  misc_feature: GYAE6OF02FI4QP.11.10.A10.1.454.CMB.1.raw
  modified_base (199)..(199): a, c, t, g, unknown or other
  misc_feature (199)..(199): n is a, c, g, or t
  modified_base (241)..(241): a, c, t, g, unknown or other
  misc_feature (241)..(241): n is a, c, g, or t
  modified_base (309)..(309): a, c, t, g, unknown or other
  misc_feature (309)..(309): n is a, c, g, or t
tcagcgagagataccacgaccggtgctcgatttagcgtcgatctcaggggggaactgctcagttaggacccagacggaaccatggaagccccagcgcagcttctcttcctcctgctactctggcctcccagatagcactggaagaaatagtgatgacgcagtctccagccaccctgtctgtcgtctccgaaggggaaancgcccaccctctacctgcgacgggccagtcagagtgtaggancaacttacgcctggtaccagcaagaacctggccaggtcctcccaggcctcctcattctaagtgggtcncctatcccaaccgagggtccctacgtcggttcccaggtccgtaggttacagtggcctagggtcgggtcaggacgacaggtacgttaccacttccgtacacctatacccggaaccggtcctcgacgtagtcgtaagtaagttgttttacggaacgtttaagtttactttacgttcgtaacgtacggtacttaaagttaacttaaacgtaacgttccggtacccgttacgggtaaccgttccgggtaacccggtaaacgggaacccgttaaagggtaacggtaaccggtaaccgtaaacggtaacgtagggttccggaccgttacggtacccgtaaccgtagtttccgtacgtttaccttacctaccgtttcccggttaacccgtaccg

SEQ ID NO: 292456 - DNA, 821 bp, Homo sapiens
  misc_feature: GYAE6OF02GI5YX.11.10.A10.1.454.CMB.1.raw
  modified_base (195)..(195): a, c, t, g, unknown or other
  misc_feature (195)..(195): n is a, c, g, or t
  modified_base (530)..(530): a, c, t, g, unknown or other
  misc_feature (530)..(530): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggaagaaatagtgatgacgcagtctccagcccacctgtctgtgtctccgaggggaanacgccaccctctcctggcgacgggccagtacgaggtaggttaggttaggagtacctaacgtttacggcccgttaggtaaccgacgtacgaaacgtaaacccggtcggaccgacggccctacccgaggtcccttacccgacctacgttacgttaacgttcggggtcacctacgtacccgaccggaaccggggtaccctaaccggtttcccgggttttaccccgacggttacccgtaaacggggttccgtaacgggtcgggaccggttacggggttcgggtaccgttagggaaccggtaacggttaagtacggttaccaaccttccgaccgtaaccncgtttaacgaacgtccggtacctcgaccgtacggttacgtaaggttaaggtttaccgtttagaacttttaggttttaaccgttagttacgttactaacgtataacgtttaactaagttacccggtacggtcccggttacggtacccgggttacgggtaacccggtaaacgggtaccggtaaaggggttaccgtaacgtaacccgtaaacgggtaacgttcgggttacgtccggtacgaccgtaaccgttacgttcggttacgtaccgtttaccgtccgttaccctacccgg

SEQ ID NO: 292457 - DNA, 828 bp, Homo sapiens
  misc_feature: GYAE6OF02H6YO1.11.10.A10.1.454.CMB.1.raw
  modified_base (143)..(143): a, c, t, g, unknown or other
  misc_feature (143)..(143): n is a, c, g, or t
  modified_base (158)..(158): a, c, t, g, unknown or other
  misc_feature (158)..(158): n is a, c, g, or t
  modified_base (197)..(197): a, c, t, g, unknown or other
  misc_feature (197)..(197): n is a, c, g, or t
tcagcgagagataccacgaccggtgctcgatttagcgtcgatctcagggggaactgctcagttaggacccagacggaaccatggaacgccccagcgcagcttctccttcctcctgctactcgtggctccagatagcactgganaaatagtgatgacgnagtctcagcccacctgtctgtcgtctaccgagggaaacncgcccacctctcctgcagggccaggtcaggtagtgttaggacgctaacgttagcctacggtaccgacggtcaacgtaaacctcgggccgacgggtcctcccgaggtcctccgtactacgtcgtaacgttggtctaccgtaccgtacccgaaccggtaccggcctaaccgttccggtttacccaccggtccgtacggttaccgtcggtacggtccgtaacggggttcggttacgtaggacgaacgacggtacgtaccgtccgtaccgtttacccgtacctaacccgtaaccgtcccggaacgtacccgtaacccggttaacgaccggtaccgtttaaacggttaacggtttaacgttttccggttaacgttttaacgtttttaaaccgttaccgtttacggtaaccgtaaaccgttacgggtaacccggttaagacccggtaacggtacccggtaacccgggtcccgttacccgggggtaccgttacccgggttaaccgggtaaccgggtaaaccggggtaccggttaagggtaccgggaacgttaaccgggaacgggtaaccgtaacggttacgggaccgtaccgtacggtaccggtacccttacggttaccgttacgttccgttaacccg

SEQ ID NO: 292458 - DNA, 836 bp, Homo sapiens
  misc_feature: GYAE6OF02G0OTI.11.10.A10.1.454.CMB.1.raw
tcagcgagagataccacgaccggtgctcgatttagcgtcgatctccaggggggaactgctcagttaggacccagacggaaccatggaagccccagcgcagcttctcttcctcctgctactctggctcccagatagcactggagaaatagtgatgacgcagtctccagccaccctgtctgtgtctccgaaggggaaacacgccctaccctctcccgtgccaacggggcctaggtcaggtagtggttaggagtacctaaacgttacgcccgtagggtaccaaggccaaggaaaaccctgggaccacggacctacccccgaaggtccctcctacgtacgttctaagtcgggttacgcctacgttacccgaacccggtacgggcccctaacgtttccgggtttaccccaacgtcccggttaacggggtttacccaagggttccggaccgtaggggttacggggtctacggaacgtaccggtaaggtaacggtttccctaaaccgttccgtaacctaacccgtagttacccgaaacggtccacggtacccgtgtacgtacggtaaacgttatttaccggattaggttttaacgttacctttgggtacccttaagtacccgttaaaggtttaaactaaaaccgtttcggttaaccgggttacccggttacgggtaaccccggtttcgggaaacccgggtaaaccgggtaaccggtaaacggggttaacgggaacgttaaacgaaccgggtaacgttacgggtacggtacccgtaacgtacccgttaacccgtagttaccgttcgtacccgtttccgtaacctttacccgttccccgtaaccg

SEQ ID NO: 292459 - DNA, 721 bp, Homo sapiens
  misc_feature: GYAE6OF02IJXMX.11.10.A10.1.454.CMB.1.raw
  modified_base (188)..(188): a, c, t, g, unknown or other
  misc_feature (188)..(188): n is a, c, g, or t
  modified_base (207)..(207): a, c, t, g, unknown or other
  misc_feature (207)..(207): n is a, c, g, or t
tcagcgagagataccacgaccggtgctcgatttagcgtcgatctcgaggggggaactgctcagttaggaccagacggaaccatgaagccccagcgcagcttctcttcctcctgctactctggcctcccagatagcactaggaagaaatagtagaatggacgctagtctccacgcccaccctgtctgtntccgtacgaaggggaaacnccgcctaccctctcctgccgaggccagtcgagtagtggttaggacacgtaacgtacgtccgtagtaaccgaagaccgaaacggtaaacccgtcggccaacggacccccttacccggacggccttaccttacgacgttacctaggtacggtacgaccgttacaacccgaccggtaacggcccttaacgttccgttacccgagtaccggtaaggtacgaggtcggtaggtaggtcggtacgtaagacgtaacgtacgttaacgttcctaacgtttcccacctaaacccgtacgtaaccgaccgtacgcgtaccagttacgtaagtaacgttactttgtaaactttacggtttactacgtagtaccgaagtaattaacgtaataaacgtaacgtccgtaacggtacccggtagtacggaaaccggtagaaaccggtagtaacggaacaaccggtagacggtcgaacgtacgtgaacccttagtccgtcgttactacgttactccggttcctactacg

SEQ ID NO: 292460 - DNA, 637 bp, Homo sapiens
  misc_feature: GYAE6OF02FO029.11.10.A10.1.454.CMB.1.raw
  modified_base (193)..(193): a, c, t, g, unknown or other
  misc_feature (193)..(193): n is a, c, g, or t
  modified_base (210)..(210): a, c, t, g, unknown or other
  misc_feature (210)..(210): n is a, c, g, or t
  modified_base (285)..(285): a, c, t, g, unknown or other
  misc_feature (285)..(285): n is a, c, g, or t
  modified_base (296)..(296): a, c, t, g, unknown or other
  misc_feature (296)..(296): n is a, c, g, or t
  modified_base (298)..(298): a, c, t, g, unknown or other
  misc_feature (298)..(298): n is a, c, g, or t
  modified_base (324)..(324): a, c, t, g, unknown or other
  misc_feature (324)..(324): n is a, c, g, or t
  modified_base (616)..(616): a, c, t, g, unknown or other
  misc_feature (616)..(616): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaatgtgatgacgcagtctccagccacctgtctgtgtctccgaggggaaanacgccacccttcgtccngacacgggcctagtcaagagtggttaggatcaattacgcctggtaccagcaagaacctggccagcctccagctcncatctatggtncntccacacgggcactggttcccagtcngtcaggtgcgtaggtcggtactggaacgacgtaggtaggttacctacgtcgtacccaaccgttactaaccggaccggtccgtacggtctacggttcgttaagtaagtttacgtttacgtacgttaagttttacgttacttggtacctaaggttcctaagggttaactaacgggttaagtaccggccgttactccggttacgttccgggcgggtaaacgggtacgtaagggtcggtacgtacgtaccgtaggaacgtaacggttggacgtaccgacgtaccgtaccgcggttnttaccggttacctcgtacccg

SEQ ID NO: 292461 - DNA, 927 bp, Homo sapiens
  misc_feature: GYAE6OF02GX8FN.11.10.A10.1.454.CMB.1.raw
tcagcgagagataccacgaccggtgctcgatttagcgtcgatctcagggggggaactgctcagttaggacccagacggaaccatggaagccccagcgcagcttctcttcctcctgctactctggcctcccagatagcactggagaaatgtgatgacgcagtctccagcccaccctgtctgtgtctccgaggggaaatcggcccaccctctaccgtgaccgacgggccagtccaaggtagttcggttaaggagacctaaacgtttagacccgttagggtaacccgaggtaccaaacggtaaaacccgttcgggacccgaacgggttccctaacccccgtaggggtaccccttcccgtaccgtaacgtttacctaaacggtttcggggtacgtacccgtaacgttaccccggaaccgtaaccgggggtacccctaaccgggttttccgggttttaacccccgacgggttacccgtaacggggtttaccaagggttccgggtaacgtagggttcggggtacgttacggaacgtaacggtacggtaacgtttacccgaaccgttacccgtaccgtaacccgtacgtacccggtaaaccggtcccgttacggaccgttaacggttacgttaacgggttaaacgtttacgtttttacgggaacctttaaggttttttaaccgttaaccggttacgttaccgtaaacgggtactttaaacggttaaactttaaacggttaaacccgttccgggttacccgttacccgggggttaaaccgtttcccggggaaacccggtaaacggggttaacccggtaaagggttaaccgggaacgtttaaccggaaaccggttaccggtagggtacggtacgtacggaaccgtaccgtagttcccgtactttaccgttaccggtactttccggtaccctaccgg

SEQ ID NO: 292462 - DNA, 687 bp, Homo sapiens
  misc_feature: GYAE6OF02ICC92.11.10.A10.1.454.CMB.1.raw
  modified_base (206)..(206): a, c, t, g, unknown or other
  misc_feature (206)..(206): n is a, c, g, or t
  modified_base (488)..(488): a, c, t, g, unknown or other
  misc_feature (488)..(488): n is a, c, g, or t
  modified_base (513)..(513): a, c, t, g, unknown or other
  misc_feature (513)..(513): n is a, c, g, or t
  modified_base (631)..(631): a, c, t, g, unknown or other
  misc_feature (631)..(631): n is a, c, g, or t
tcagcgagagataccacgaccggtgctcgatttagcgtcgatctcgagggggaactgctcagttaggacccagacggaaccatggaagccccagcgcagcttctcttcctcctgctactctggctcccgagatagcactggaagtaaattagtgaatgacgcagtctccgagcccacccgtgtctgtacgtctaccggaggggaanacgccctaccctcgtccgtcgccgaaggccagtcgagtacgtaggttagacgtactacgtacgtcgtcgtacgagtaccgaacggtaaccgcggccgacggcccctaccgacggtcctccgtatactacgttacggtcgtacgtaccaccgtccgtaacgccgggtacctaaccggtttccggttacccacgttccggtacggttcggacgtggaccgtgggtacggtcgttaggaaccgtacgtagtaacgttccaacggtctcctacgactaccggtacncgtcgagtcgtagtacgtacgtttntagtagtttacttaacgtcgttcgtagtacgtataagtacctaagtacggtacgtaccggttagccgttacggacggttaaacgcggtaaggtagaaccgtacgtaaccgtgtacggnggtacctacgtaccgtctacgtacgttctaccttacggtaccttccggaccttacg

SEQ ID NO: 292463 - DNA, 886 bp, Homo sapiens
  misc_feature: GYAE6OF02GNMGR.11.10.A10.1.454.CMB.1.raw
  modified_base (212)..(212): a, c, t, g, unknown or other
  misc_feature (212)..(212): n is a, c, g, or t
tcagcgagagataccacgaccggtgctcgatttagcgtcgatctcaggggggaactgctcagttaggacccagacggaaccatggaagccccagcgcagcttctcttccgtcctgctactctggcgtcccagatacgcaccggagaaattgtgttcgacacagtcctcagccaccctgtctttgtctccgagggaaacgcgccacctctcgngcgagggcagtcagacgtagttaacagacttacgtacgcctaacggtaccaaacgaacgaacctcggacaacggtacctcccggaagtccctacccgtacgtaacttccgttaagtacggtacgttacgacctaaaactaacccgaacgtaccggggtacccaaccggttacggacccccgaacccagggtaaccccgtacggttacggaaggtccgggtacgtacggtacgggtcgtaacgggtaacctaggtaacccttttaccgaaccccgttacaaccccgtaacacggtacgtacccgacggtaaccgtaacgtacggaacccgttaaggtaaccgggttacgttttaacgtaacgggtttacgtttaacgtttacgttacgtaccggtaaggtccgtaacggttaaccggaacgttaacgaccgttacgggttaaccggtacccttaacccgggtttaccgggaaaccgtaaccggggtaaacccgaacgttaaaccgggaaaggtttaaaaaacccggtaacgtttaaaccgggtacggttacgggttaacccgtcccggttaaaccctaacggttaaacccgtttaccggtttaccgtttaacccggtttaacccgtaaacccgttttcccccgtttaccgggaaccccttttaccgttaaccggg

SEQ ID NO: 292464 - DNA, 715 bp, Homo sapiens
  misc_feature: GYAE6OF02F7VFD.11.10.A10.1.454.CMB.1.raw
  modified_base (249)..(249): a, c, t, g, unknown or other
  misc_feature (249)..(249): n is a, c, g, or t
  modified_base (330)..(330): a, c, t, g, unknown or other
  misc_feature (330)..(330): n is a, c, g, or t
  modified_base (344)..(344): a, c, t, g, unknown or other
  misc_feature (344)..(344): n is a, c, g, or t
  modified_base (349)..(349): a, c, t, g, unknown or other
  misc_feature (349)..(349): n is a, c, g, or t
tcagcgagagataccacgaccggtgctcgatttagcgtcgatctcaggggagctctgagagaggagcccagcccctgggattttcaggtgttttcatttggtgatcaggactgaacagagagaactcaccatggagtttggctgagcgtggtctttttctgtggtcttaagttttaaaaggtgtccagtgtgaggtgcagtctggttggagtcggtgggggagtcttggtacaggccggtggggggtcncgtgacgacctcaccgttgcgtcacgtcctgtggcttcctaacctttaacaacgtaccgctatgaacgtcgggtcccgcgngcgtcgagggaggngtggngtacggtctgtaggtagttggtggtaggtggtaggtacgacgaaggtactaccgttcgactaacggtaccgtaccgggtaggaacgggtcccgttacaccgtacgtccgtaccgaacgtaacgaactaaacttaaccaaagtaaaacgttgtacgttaagttaacgtaagtcgaaacgtaaacgtaagaaccgtacggtcccgtagggaacgaccgggtacggaacggaaccgtaccgggtaaccgttacgttttaacggtttcgttacgggtacggtaacggtaaacgtgggtaccggtaactaaggtttaaccggagttcccggttaaccgttaccggtaccggggttacgggttagttaacgg

SEQ ID NO: 292465 - DNA, 959 bp, Homo sapiens
  misc_feature: GYAE6OF02F7R3V.11.10.A10.1.454.CMB.1.raw
tcagcgagagataccacgaccggtgctcgatttagcgtcgatctcaggggggaactgctcagttaggacccagacggaaccatggaagccccagcgcagcttctcttcctcctgctactctggctcccagatagcactggaagaaatagtgactgacgcagtctccacgccaccctgtctagtgtcctaccgaaggggaaactggccctacccttcctacccttaggacgacggggaccctagtccaagtacggtaggtttacggacgtacctaaactttacggaccctaggggtaacccaacggtactaaacgtaaaacccgttccgggaacccgaacggtccccgtaacccccgacgggtcccttaacccttctaacgtttaccgtaagttcggggttctaccgtaaccgttaacccccgaacccggaacggggtaccccctaaccggttttaccgggtttacccccagggttacccccgttaaggggtttccaacggggtttacggccggttaaccggggttcggggttaaccgttaacggggaaccgggtaaacggttaacgggtacgtttaacccgtaaccggtttaccaacccggtaacccttaccggtacctaaacccgggtccttacggtaaccgtacgggttacccggttaaggtaaacggtttagttttaacccgggttactttaacggttttaaacgttttacccgttaacgggtttaacccaaaggttaacccgtaacggttttaaaactaaaccggttttaccggttaccggtacggtttaccccgggtaaccgggttttaccggaaaccgttaaaccggggacctttaaacggggtaaccttaaggggaaacctaaaccggttaccggttaggaaccggttaccggtacgtaacctactaaccggtctacgttaccgttacctaccttcccggtaacccttaccc

SEQ ID NO: 292466 - DNA, 742 bp, Homo sapiens
  misc_feature: GYAE6OF02HMIQ8.11.10.A10.1.454.CMB.1.raw
  modified_base (196)..(196): a, c, t, g, unknown or other
  misc_feature (196)..(196): n is a, c, g, or t
  modified_base (242)..(242): a, c, t, g, unknown or other
  misc_feature (242)..(242): n is a, c, g, or t
  modified_base (321)..(321): a, c, t, g, unknown or other
  misc_feature (321)..(321): n is a, c, g, or t
  modified_base (499)..(499): a, c, t, g, unknown or other
  misc_feature (499)..(499): n is a, c, g, or t
tcagcgagagataccacgaccggtgctcgatttagcgtcgatctcaggggggaactgctcagttaggacccagacggaaccatggaagccccagcgcagcttctcttcctcctgctactctggctcccagatagcactggagaaactagtgatgacgcagtctcagccaccctgtctgtgtcctccgaaggggaanacgcccacccgtctccgtgcagggccagtccagacgtggttagganacgtaacttagcccgttggaccagccaaggaaacctggccaacgggcctccccgaggcctccgctagtcttagtgggtnccaacgtcccaaccggcggtacccacgttccggtttccccaggtcccgtaggtttccaaggtcggcctagggtcgggtctagggacagtacggtacttccgacttccgtacacccgtataacccgacgtccgtacgctacgttccgtagaagttacttttcgaacgtttaagtttttntacgttacgtactacgggtactaaagttaacgtaaagttaaccggttaccggtaccggtttaccgggtacccgggttaccggaacccgggttaacgggggtaaacccgtaaaggggttaccggtaaacggttaaccgaaaccgggtaacggttttagggtacggttccggaaccggttaacgtacccgacgtttaccgttacggttaccgttaccctacgtttccccgttacccgggttaccc

SEQ ID NO: 292467 - DNA, 556 bp, Homo sapiens
  misc_feature: GYAE6OF01C61MJ.33.68.G02.1.454.CMB.1.raw
  modified_base (222)..(222): a, c, t, g, unknown or other
  misc_feature (222)..(222): n is a, c, g, or t
tcagtacacacactcacgaccggtgctcgatttagtcgatagtgaagggaaagggggagtcagtctcagtcaggacacagcatggacatgagggtccccgctcagctcctggggctcctgctcctctggctccgaggtgccagatgtgacgtccagatgacccagtctccatccctccctgtcttcatctgtaggagacagagtcaccatcacttgccgggnaagtgagagcattagaacctattgaattggtatcagcagagacagggaaacgccccaaactcctgatctctgccgcatccgatttacacaagtcgggtcccagtcgaggttcaggtggcagtggatcgtgggacagtatttcactctcaccataagctagtctaggaacctgaaagtatttaggaagtattacttctagtacaacagtaactttagtaacgttaacccgtacttacgttttaggaccgtaacggggaccaaggtccgttagggacgtagtacgaaaggtacgaacgtggtacggcttacgacctacctattctgttccttaccg

SEQ ID NO: 292468 - DNA, 535 bp, Homo sapiens
  misc_feature: GYAE6OF01BQTWN.33.68.G02.1.454.CMB.1.raw
  modified_base (276)..(276): a, c, t, g, unknown or other
  misc_feature (276)..(276): n is a, c, g, or t
tcagtacacacactcacgaccggtgctcgatttagtcgatagtgaagggaaagggggagtcagtctcagtcaggacacagcatggacatgagggtccccgctcagctcctggggctcctgctcctctggctccgaggtgccagatgtgacgtccagatgacccagtctccatcctccctgtcttcatctgtaggagacagagtcaccatcacttgccgggcaagtgagagcattagaaccttattgaattggtatcagcagagaccagggtaaacncccccaaatcctgactctctgccgcatccgatttacacgaagtcgggtcccatcgagttcagtggcagtggatcgtgggacagtatttcactctacacataacgctagtctagaacctgaaagtatttaggaagtacttacttctagtacaactagtacttaagtaacgttaacccgtatacttttcggacctaggggaccaagcgtaggatactacgaagtcgaacgtgtacggactcgaccacctattctgtcttac

SEQ ID NO: 292469 - DNA, 504 bp, Homo sapiens
  misc_feature: GYAE6OF01BMNEC.33.68.G02.1.454.CMB.1.raw
tcagtacacacactcacgaccggtgctcgatttagtcgatagtgaagggaaagggggagtcagtctcagtcaggacacagcatggacatgagggtccccgctcagctcctggggctcctgctcctctggctccgaggtgccagatgtgacgtccagatgacccagtctccatcctccctgtcttcatctgtaggagacagagtcaccatcacttgccgggcaagtgagagcatcgtccgctatttaaattggtatcagcagaaccagggcaagccccctaaactcctgatctatgctgcgtccagtctgcaaagtgggtcccatcaaggttcagtggcagtggatctgggacaggtatttcactctcaccatcagcagtctgcaaccctgaacgtattttcgctaactttacttctgtaccaacactagttacaattcctcccgtactaccttttggccaggggacccaagcgtggagatcgaggcgaactgtggctgcactac

SEQ ID NO: 292470 - DNA, 505 bp, Homo sapiens
  misc_feature: GYAE6OF01BCJZR.33.68.G02.1.454.CMB.1.raw
tcagtacacacactcacgaccggtgctcgatttagtcgatagtgaagggaaagggggagtcagtctcagtcaggacacagcatggacatgagggtccccgctcagctcctggggctcctgctcctctggctccgaggtgccagatgtgacgtccagatgacccagtctccatcctccctgtcttcatctgtaggagacagagtcaccatcacttgccgggcaagtgagagcattagaacctatttgaattggtatcagcagagaccagggaaagcccccaaaactcctgatctctgccgcatccgatttacacaatggggtcccatcgaggttcagtggcagtggatctgggacagatttcactctcaccataagcagtctggaacctgaagattttggaagtatactttctgtcaacagacttaatagtaacccgtatacttttggccaggggtaccaaggctgggagatacaagtcgaactggtggctgcaccatctgtcttc

SEQ ID NO: 292471 - DNA, 514 bp, Homo sapiens
  misc_feature: GYAE6OF01DND5R.33.68.G02.1.454.CMB.1.raw
tcagtacacacactcacgaccggtgctcgatttagtcgatagtgaagggaaagggggagtcagtctcagtcaggacacagcatggacatgagggtccccgctcagctcctggggctcctgctcctctggctccgaggtgccagatgtgacgtccagatgacccagtctccatcctccctgtcttcatctgtaggagacagagtcaccatcacttgccgggcaagtgagagcattagaacctattgaattggtatcagcagagaccagggaacgcccccaaactcctgatctctgccgcatccgatttacacaatcgggtccatcgagtcagtgcagtgatcgtgggacagtattcactctacaccataagcagtctaggaacctgaagtatttaggaagtatacttctgtcaactagtacttaatacgtaacccgtactacgtttggacctagggaccaagcgtagagatcgaaacgcgaacgtggtacggctcgacaccatctgttcttaccg

SEQ ID NO: 292472 - DNA, 511 bp, Homo sapiens
  misc_feature: GYAE6OF01BMLYQ.33.68.G02.1.454.CMB.1.raw
tcagtacacacactcacgaccggtgctcgatttagtcgatagtgaagggaaagggggagtcagtctcagtcaggacacagcatggacatgagggtccccgctcagctcctggggctcctgctcctctggctccgaggtgccagatgtgacgtccagatgacccagtctccatcctccctgtcttcatctgtaggagacagagtcaccatcacttgccgggcaagtgagagcattagaacctatttgaattggtatcagcagagaccagggaaacgcccccaaactcctagatctctgccgcatccgatttacacaatgggtccatcgagttcagtgcagtgatcgtgggacagtatttcactctcacataagcagtctagaacctgaagtatttaggaagtatacttctgtacaacagtacttatagtaacccgtatacgttttggaccgagggaccaagcgtaggagatacgaagacgaacgtgtacgctcgcacctatcgttgtcttac

SEQ ID NO: 292473 - DNA, 510 bp, Homo sapiens
  misc_feature: GYAE6OF01A80YT.33.68.G02.1.454.CMB.1.raw
tcagtacacacactcacgaccggtgctcgatttagtcgatagtgaagggaaagggggagtcagtctcagtcaggacacagcatggacatgagggtccccgctcagctcctggggctcctgctcctctggctccgaggtgccagatgtgacgtccagatgacccagtctccatcctccctgtcttcatctgtaggagacagagtcaccatcacttgccgggcaagtgagagcattagaacctatttgaattggtatcagcagagaccagggaaacgcccccaaaactcctagatctctgccgcatccgatttacactaatcgggtcccatcgaggttcagtggcagtggatcgtgggacagtatttcactctcaccataacgcagtctaggaacctgaagtatttaggaagtatacttctgtacaacagtacttataacgtaacccgtactacgtttgacctagggaccaggctaggagatcgaagagaactgtgctagcacatctgtctc

SEQ ID NO: 292474 - DNA, 667 bp, Homo sapiens
  misc_feature: GYAE6OF01C9GI7.33.68.G02.1.454.CMB.1.raw
tcagtacacacactcacgaccggtgctcgatttagtcgatagtgaagggaaagggggagtcagtctcagtcaggacacagcatggacatgagggtccccgctcagctcctggggctcctgctcctctggctccgaggtgccagatgtgacgtccagatgacccagtctccatcctccctgtcttcatctgtaggagacagagtcaccatcacttgccgggcaagtgagagcattagaacctatttgaattggtatcagcagagaccagggaaagcccccaaatcctgatctctcgccgcatccgatttacacaatggggtcccagtcgaggttcagtggcagtgatcgtgggacaggatttcacgtctcacctataagctagtctaggaacctagtaaacgtagtttttacgggaaagtaactttaacctttacgttgttaccaaacgtaacgttaactttaagtaaacggttaaacccccggttaacctaccgttttttacgggacccggtaacgggggtacccaaaggtacccgtttagggaaacggtaacgttaaccggtaaaacggtaccgggtaaaaccgttacgggttacgggggtaccctttacgggtacccttaaaccccggtaatttcccgtttacggtttccccgtttttaaacccg

SEQ ID NO: 292475 - DNA, 513 bp, Homo sapiens
  misc_feature: GYAE6OF01BIJOM.33.68.G02.1.454.CMB.1.raw
tcagtacacacactcacgaccggtgctcgatttagtcgatagtgaagggaaagggggagtcagtctcagtcaggacacagcatggacatgagggtccccgctcagctcctggggctcctgctcctctggctccgaggtgccagatgtgacgtccagatgacccagtctccatcctccctgtctgcatctgtcggagacagagtcaccatctcttgccgggcaagtcagagcatcgtccgctatttaaaattggtaatcagcagaaaaccagggcaagcccctaaaactcctgatctaatgctgcgtccagtctgcaaagtgggtcccatcaaaggttcagtggcagtggatctgggacagatttcactctcaccatcaagcaagtctgcaacctgaagattttgctaaacttacttctgtctaacacaagttaacaaatctacccgtacaccttttggccgtaagggaaccgaaagcttaggagatcaggacgaaactgtaggctggctaacc

SEQ ID NO: 292476 - DNA, 683 bp, Homo sapiens
  misc_feature: GYAE6OF01A5T7U.33.68.G02.1.454.CMB.1.raw
  modified_base (197)..(197): a, c, t, g, unknown or other
  misc_feature (197)..(197): n is a, c, g, or t
  modified_base (223)..(223): a, c, t, g, unknown or other
  misc_feature (223)..(223): n is a, c, g, or t
tcagtacacacactcacgaccggtgctcgatttagtcgatagtgaagggaaagggggagtcagtctcagtcaggacacagcatggacatgagggtccccgctcagctcctggggctcctgctcctctggctccgaggtgccagatgtgacgtccagatgacccagtctccatccctccctgtcttcatctgtagganacagagtcaccatcacgttcgccggnaagtgagagcattagaaccttattgaattggtatcgagcagacgaccgaaggaaaccacccccaaactcctagactctctcgccgactactcgtatttacacgtaagtcgggtacctagtcgtaggttcgagtggacgtaggtgtactcggtagggaccagttactttaccacgttcctaccaacctaagtaacgccgtaacgttcgtaacggtaaccgttaggaaagtttaacgtttaggaaacgttacgttaccgtttactacgtaacgtaaacgtacgttaactttaacgttaacccgttaaaccccgtttacttaccggttttaccggacccggtaacggggtaaccacggttacgtagggaacgtaacgtaaccgtaaacggtaccgtaaacggttcggtaaggtacctaccggtaacccttaaccctacgtttccgttacgttcccttaacccg

SEQ ID NO: 292477 - DNA, 532 bp, Homo sapiens
  misc_feature: GYAE6OF01DZFCY.33.68.G02.1.454.CMB.1.raw
tcagtacacacactcacgaccggtgctcgatttagtcgatagtgaagggaaagggggagtcagtctcagtcaggacacagcatggacatgagggtccccgctcagctcctggggctcctgctcctctggctccgaggtgccagatgtgacgtccagatgacccagtctccatcctccctgtcttcatctgtaggagacagagtcaccatcacttgccgggcaagtgagagcattagaacctattgaattggtatcagcagagaccaggaaacgcccccaaactcctgatctctgccgcatccgatttacacaatcgggtccatcgagttcagtgcagtgatcgtgggacagattcactctcacataagcagtctaggaacctgaagtatttaggaagtatacttctgtacaactagtacttaataacgtaacccgtactacgttttaggaccgtaaggggtaccaaggcctaggacgtatacgaaggtacgaaacgtggtacggcgtacgctaaccattcctgtccttaccg

SEQ ID NO: 292478 - DNA, 569 bp, Homo sapiens
  misc_feature: GYAE6OF01CTKEO.33.68.G02.1.454.CMB.1.raw
  modified_base (445)..(445): a, c, t, g, unknown or other
  misc_feature (445)..(445): n is a, c, g, or t
  modified_base (465)..(465): a, c, t, g, unknown or other
  misc_feature (465)..(465): n is a, c, g, or t
  modified_base (516)..(516): a, c, t, g, unknown or other
  misc_feature (516)..(516): n is a, c, g, or t
tcagtacacacactcacgaccggtgctcgatttagtcgatagtgaagggaaagggggagtcagtctcagtcaggacacagcatggacatgagggtccccgctcagctcctgggctcctgctcctctggctccgaggtgccagatgtgacgtccagatgacccagtctccatccctccctgtcttcatctgtaggagacagagtcaccatcacttgccgggcaagtgagagcattagaaccttattagaattggtatcagcagacgaccgaagggaaacgacccccaaactcctagactcctcgtcgcccgcacttacccgtatttacaactaagtcggggtacccagtcggtaggttcaggtggacgagtggatcgtagggactagtattcactctcaacataacgctagtctagaacctagtaagtagtttaggaatatacttntagtacaactagtacttaanacgttaaccctacgttacgtttacggaccgtaagggacctaaggctagganagtacgaagtcgaacggtgtcggctacgcctaacctagttctcgttcttaccg

SEQ ID NO: 292479 - DNA, 511 bp, Homo sapiens
  misc_feature: GYAE6OF01BBBE9.33.68.G02.1.454.CMB.1.raw
tcagtacacacactcacgaccggtgctcgatttagtcgatagtgaagggaaagggggagtcagtctcagtcaggacacagcatggacatgagggtccccgctcagctcctggggctcctgctcctctggctccgaggtgccagatgtgacgtccagatgacccagtctccatcctccctgtcttcatctgtaggagacagagtcaccatcacttgccggcaagtgagagcattagaacctatttgaattggtatcagcagagaccagggaacgcccccaaactcctgatctctgccgcatccgatttacactaatgggtcccatcgagttcagtgcagtggatcgtgggacagatttcactctcacatagcagtctaggaacctgaagtattttaggaagtatacttctagtacaacagtacttataacgtaacccgtatacgttttggaccgtagggaccaagctaggagatacaacgcgaactggtaggctgaccacatcttgtcttac

SEQ ID NO: 292480 - DNA, 555 bp, Homo sapiens
  misc_feature: GYAE6OF01E12LK.33.68.G02.1.454.CMB.1.raw
  modified_base (195)..(195): a, c, t, g, unknown or other
  misc_feature (195)..(195): n is a, c, g, or t
  modified_base (284)..(284): a, c, t, g, unknown or other
  misc_feature (284)..(284): n is a, c, g, or t
tcagtacacacactcacgaccggtgctcgatttagtcgatagtgaagggaaagggggagtcagtctcagtcaggacacagcatggacatgagggtccccgctcagctcctggggctcctgctcctctggctccgaggtgccagatgtgacgtccagatgacccagtctccatcctccctgtcttcatctgtaggngacagagtcaccatcacttgccggcaagtgagagcattagaacctattgaattggtatcagcagagaccaggaacgcccccaaactccngatctctgccgcactccatttacactaagtcgggtcccagtcgacggttcagtggacagtggatcgtgggactagtacttcactctacaccataacgcagtctaggtaacctagtaacgtagtttaggaagtattacttcgtacgtacaacagtaacttaacgttaacgtaacccgttacttacgttttacggaccgtacgggaccaagcgtaggacgtaatacgaagtaccgaacgtcgtacgtctacgacctaccattcttgtcttacg

SEQ ID NO: 292481 - DNA, 557 bp, Homo sapiens
  misc_feature: GYAE6OF01CHC6P.33.68.G02.1.454.CMB.1.raw
  modified_base (220)..(220): a, c, t, g, unknown or other
  misc_feature (220)..(220): n is a, c, g, or t
tcagtacacacactcacgaccggtgctcgatttagtcgatagtgaagggaaagggggagtcagtctcagtcaggacacagcatggacatgagggtccccgctcagctcctggggctcctgctcctctggctccgaggtgccagatgtgacgtccagatgacccagtctccatcctccctgtcttcatctgtaggagacagagtcaccatcacttgccggnaagtgagagcattagaacctattgaattggtatcagcagagaccagggaacgcccccaaactcctgatctctgccgcatccgtatttacaactaagtcgggtacccatcgagttcagtggcagtgatcgtgggacagtatttcactctacacataagctagtcgtagaactagtaagtagtttaggaatattacttctagtacaacgtagtaactttaataacgttaacccgtacgttacgttttacggaccgtaacgggacctaacggtcgtaggagtacgtacgaaagtacgaacgtggtacggcgtacgtcctaactattcgttgttccttacc

SEQ ID NO: 292482 - DNA, 538 bp, Homo sapiens
  misc_feature: GYAE6OF01B1LP5.33.68.G02.1.454.CMB.1.raw
  modified_base (420)..(420): a, c, t, g, unknown or other
  misc_feature (420)..(420): n is a, c, g, or t
  modified_base (427)..(427): a, c, t, g, unknown or other
  misc_feature (427)..(427): n is a, c, g, or t
  modified_base (529)..(529): a, c, t, g, unknown or other
  misc_feature (529)..(529): n is a, c, g, or t
tcagtacacacactcacgaccggtgctcgatttagtcgatagtgaagggaaagggggagtcagtctcagtcaggacacagcatggacatgagggtccccgctcagctcctggggctcctgctcctctggctccgaggtgccagatgtgacgtccagatgacccagtctccatcctccctgtctgcatctgtaggagacagggtcaccatcacttgccgggcaagtcagagcataagcaacttatttaaattggtatcaaacagaaaaccagggaaacgcccctaaggtcctgatctatgctgcgtccagtttgcagagcgggtccatcgaaggttcagtggcagtggatcgtggacagtatttcactctcaccatcagctagtctgacaacgtgaagtatttacgactaacttactactntacaacngaacgtacaaccaacctacccctattaccacgtttccggcccgtacgggaccctacgtagtggactacgtaccaacgtacgtggtcgtactcgaccaccctntcgttaccg

SEQ ID NO: 292483 - DNA, 607 bp, Homo sapiens
  misc_feature: GYAE6OF01BDFAU.33.68.G02.1.454.CMB.1.raw
  modified_base (314)..(314): a, c, t, g, unknown or other
  misc_feature (314)..(314): n is a, c, g, or t
tcagtacacacactcacgaccggtgctcgatttagtcgatagtgaaggggaaagggggagtcagtctcagtcaggacacagcatggacatgacgggtccccgctcagctccgtggggctcctgctcctctggctccgaggtgccagatgtgacgtccagatgacccagtctccatcctccctgtcttcatctggtaggagacagagtcaccatcacttggccggcaagtgagagcaattagaaccttatttagaatttggtatcgagcaggacgaccgaaggggaaacgaccccccaaactccagtactcctcncgccgctactccgtatttacacaagtcgggccatcgaggtcagtggcagtgatcgtgggacagtatttcactctacactaatagcagtcgtacggtaacctagtaagttagttttagggaagttaacttacttgtacgtacaactaagtacttaacgttaacgttaacccgtaacttacgttttacggaccgtacggggaccaaggtccgtagggaacgtacgtacggaaacgtacggtaacgttcggcggtccgtacgtacctaacccgtatttccgttgttcctttaaccg

SEQ ID NO: 292484 - DNA, 522 bp, Homo sapiens
  misc_feature: GYAE6OF01B98IS.33.68.G02.1.454.CMB.1.raw
  modified_base (414)..(414): a, c, t, g, unknown or other
  misc_feature (414)..(414): n is a, c, g, or t
  modified_base (511)..(511): a, c, t, g, unknown or other
  misc_feature (511)..(511): n is a, c, g, or t
tcagtacacacactcacgaccggtgctcgatttagtcgatagtgaagggaaagggggagtcagtctcagtcaggacacagcatggacatgagggtccccgctcagctcctggggctcctgctcctctggctccgaggtgccagatgtgacgtccagatgacccagtctccatcctccctgtcttcatctgtaggagacagggtcaccatcacttgccggcaagtcagagcataagcaactatttaaatggtatcaacagaaaccaggaaagcccctaaggtcctgatctatgctgcgtctagtttgcagaggcgggtcccatcgaaggttcagtggcagtggatcgtggactagtatttcactctcacatcagcagtctagacaacgtgaagtatttgactaacttactacgtntacaacagacgtacaaccaaccaccctattcctacgttccgcctacggaccacgagtgactcgtaccaaccgtacgtcgtacggctacgcctacctntcgtgttaccc

SEQ ID NO: 292485 - DNA, 635 bp, Homo sapiens
  misc_feature: GYAE6OF01BEII1.33.68.G02.1.454.CMB.1.raw
  modified_base (198)..(198): a, c, t, g, unknown or other
  misc_feature (198)..(198): n is a, c, g, or t
  modified_base (623)..(623): a, c, t, g, unknown or other
  misc_feature (623)..(623): n is a, c, g, or t
tcagtacacacactcacgaccggtgctcgatttagtcgatagtgaagggaaagggggagtcagtctcagtcaggacacagcatggacatgagggtccccgctcagctcctggggctcctgctcctctggctccgaggtgccagatgtgacgtccagatgacccagtcctccatccctccctgtcttcatctgtagganacagagtcaccatcacttcggccggacaagtgagagctattaagaaccttagtttagaagtttggtatacagcaagacgaaccgaagggaaaccacccccaaactcctagactcctctaccgccgactacgtacccgtaatttaacgaactaacggtcgggtacccagttacgaggttcaggtcggcaggtgagtcgtagggactagtactttcaccttctaccaactaagtaacgactacgtacgtacggtaacctaggtaaagttagttttaaggaaagttacttacgtttcgtacgttacaaacgtacgttaactttaacgttaaccgttaaacccgttacgttaccggtttacgggaccgtaacggggtaccaaggtcgtaggatactacgaagtcgaacgtgtacgacgacgcaaccgtntcttgtctaccg

SEQ ID NO: 292486 - DNA, 645 bp, Homo sapiens
  misc_feature: GYAE6OF01ARRYA.33.68.G02.1.454.CMB.1.raw
tcagtacacacactcacgaccggtgctcgatttagtcgatagtgaagggaaagggggagtcagtctcagtcaggacacagcatggacatgagggtccccgctcagctcctggggctcctgctcctctggctccgaggtgccagatgtgacgtccagatgacccagtctccatcctccctgtcttcatctgtaggagacagagtcacatcacttgccgggcaagtgagagcattagaacctattagaattggtatcagcagagaccgagggaaacgacccccaaactcctgactcctcgtcgccgcacgtccgtactttacaactagtcgggtcccagtcgtagtcagtggcgagtgatcgtggacagtactttcacgtctactacctagtaacgtctagtcgttacggaaccgttagtaaagttagttttacgggaagttaacttacgtttcgtacgtacctaaacgtaagtaactttaacgtaaccggttaaacccgttaacgttaacgttttaccgggacccggtaacggggtaaccctaacggtacgtaacgggtaacgtaacgtaccgtaaacggtaccggtaacggttcggtagggtcccgttagaccctaaccgtactttacctggtttacccttaccg

SEQ ID NO: 292487 - DNA, 607 bp, Homo sapiens
  misc_feature: GYAE6OF01EVPY5.33.68.G02.1.454.CMB.1.raw
  modified_base (100)..(100): a, c, t, g, unknown or other
  misc_feature (100)..(100): n is a, c, g, or t
  modified_base (197)..(197): a, c, t, g, unknown or other
  misc_feature (197)..(197): n is a, c, g, or t
  modified_base (223)..(223): a, c, t, g, unknown or other
  misc_feature (223)..(223): n is a, c, g, or t
  modified_base (308)..(308): a, c, t, g, unknown or other
  misc_feature (308)..(308): n is a, c, g, or t
tcagtacacacactcacgaccggtgctcgatttagtcgatagtgaagggaaagggggagtcagtctcagtcaggacacagcatggacatgagggtccccntcagctcctggggctcctgctcctctggctccgaggtgccagatgtgacgtccagatcgacccagtctccatccctccctgtcttcatctgtagganacagagtcaccatcacttgccggganaagtgagagctaattagaaccttatttagaattggtatcagacagagaaccgaacgggaaacacccccaaactcctagactctcngccgctactccgtatttacactaagtcgggtaccagtcggtagttcgaggtggactggtgtatcgtgggactagtactttcacgtctaccaactactaagcaagttcgtacggaacctaggtaacgttagtttaaggaattacgttacttcgtacgtacaacgtacgtaacgtttaacgtaacgttaaacccgtacgttaacgttttacggaccggtaacgggtacctaaggtccgtaggtagaacgtacgaacgtacgtaacgtgtacggatcgacctacgtatccgttatccgttac

SEQ ID NO: 292488 - DNA, 779 bp, Homo sapiens
  misc_feature: GYAE6OF01CT7RN.33.68.G02.1.454.CMB.1.raw
tcagtacacacactcacgaccggtgctcgatttagtcgatagtgaagggaaagggggagtcagtctcagtcaggacacagcatggacatgagggtccccgctcagctccgtggggctcctgctcctctggctccgaggtgccagatgtgacgtccagatcgacccagtcctccatccctcctgtcttcatctgtaggagacagacgtcaccatcacgttggccggacaagtgagagctaattacgaaccttagtttagaattggtactacgagacaagaagaaccgaacgggaaaccgtaccccttaaaacgtccgtagaacttactaacgttcgacgttcggtaccttaccgtaagtttccgtacgaacggttaaaacgggttcccggggttaaccctaacgttaaccggtaaagggtttaccgtaaaggtaccggggtacgtaaggtttacggaacgttaccgggtagggaaacttaggttaacctttacgaccttacctaccaacctactacgacgtacgaacggtttctaacggtaaccgtaaacggttacggtaaacgttttagtttttaaccggaacctttaaacctttaacgtttaacgtaacttaacgaaaccgtagtaaccgttaaccctaaaccgaaaccccttaaccgttaaccttaccgttaacccggttaacggtcccccggtaacggtaaccctacggtaacggtacgtacgttacgtaacccgtaaccggtacgttcggaacgtcacgtaccgtacccgttacg

SEQ ID NO: 292489 - DNA, 727 bp, Homo sapiens
  misc_feature: GYAE6OF01EAGXV.33.68.G02.1.454.CMB.1.raw
  modified_base (197)..(197): a, c, t, g, unknown or other
  misc_feature (197)..(197): n is a, c, g, or t
  modified_base (230)..(230): a, c, t, g, unknown or other
  misc_feature (230)..(230): n is a, c, g, or t
tcagtacacacactcacgaccggtgctcgatttagtcgatagtgaaggggaaagggggagtcagtctcagtcaggacacagcatggacatgagggtccccgctcagctcctggggctcctgctcctctggctccgaggtgccagatgtgacgtccagatgacccagtctccatcctcctgtcttcattctgtagganacagagtcaccatcacttcgccggacaagtganagctaattacgaaccttattagaattggtatcaagcaagaacgaccgaacgggaaaccgaccccctaaaactcctaggtactccgtccgtagcccgacacgtaccgtaatttaacgaacgtaacggttccggggtacccctaagttccggtaacggttacgacggttacggccgtaaggttacggtaacttcggttacggggaactaacgggtttaactttacccaacctttcctaaccctaaccgtaacgttaaacgtccgttaacggttacgttaacggtaaacccgttaaggtaaaggtttacgtttttaacgggaaacgttaacctttacggtttaccttacggtactaaaccgtaagttaacgtttaacgttaaaccgttaacccgtacgttaacgtttcggaaccgtaaggggtaaccctaaggtccgtaggacagttaacgaagtacgaacgtggtacggtacctgtacccgactagttctgttcttacg

SEQ ID NO: 292490 - DNA, 660 bp, Homo sapiens
  misc_feature: GYAE6OF01D5H2G.33.68.G02.1.454.CMB.1.raw
  modified_base (229)..(229): a, c, t, g, unknown or other
  misc_feature (229)..(229): n is a, c, g, or t
  modified_base (260)..(260): a, c, t, g, unknown or other
  misc_feature (260)..(260): n is a, c, g, or t
  modified_base (643)..(643): a, c, t, g, unknown or other
  misc_feature (643)..(643): n is a, c, g, or t
tcagtacacacactcacgaccggtgctcgatttagtcgatagtgaagggaaagggggagtcagtctcagtcaggacacagcatggacatgagggtccccgctcagctcctgggctcctgctcctctggctccgaggtgccagatgtgacgtcagatgacccagtctccatcctccctgtcttcattctgtaggagacagagtcacatccacttgccggacaagggggtnagagctattacgaacttattgaattggtatnagacagacgaccgaagggaaacgaccccctaaacgtcctagtaacttcctacgtcgcccgactactaccgtaatttaacaacgtaagttccggggtacccagtcggtacggtcgtagtacggcgtagttggacttcggtaggggaactaggttactttcaccgttcctacaaccgtaagtacgtactacggtacgtacggtaacctaggtaaagttagttttacggaagtactttaaccgttgtacgtaacaacgttaacgtacgttaaactttaacccgtaaccgttacttaccgttttacggacccggtaacgggtacctaagtccgtaaggtagaactacgaacggtacgaacggttggacgtaccgagtacccgtaacngttcttcgttcttaccc

SEQ ID NO: 292491 - DNA, 717 bp, Homo sapiens
  misc_feature: GYAE6OF01B6FNS.33.68.G02.1.454.CMB.1.raw
  modified_base (101)..(101): a, c, t, g, unknown or other
  misc_feature (101)..(101): n is a, c, g, or t
  modified_base (200)..(200): a, c, t, g, unknown or other
  misc_feature (200)..(200): n is a, c, g, or t
  modified_base (225)..(225): a, c, t, g, unknown or other
  misc_feature (225)..(225): n is a, c, g, or t
tcagtacacacactcacgaccggtgctcgatttagtcgatagtgaagggaaagggggagtcagtctcagtcaggacacagcatggacatgagggtccccgntcagctccgtgggctcctgctcctctggctccgaggtgccagatgtgacgtccagatcgacccagtcctccatccctccctgtccttcatctgtagganacagaatcacatcacttggccgganaagtgagagactagttacgaacttagtttagtaagttaggtaatcgtagacgaagaacgaaccgaacgggaaaccccgacccccgaaaaccttcccgtagtaccttcctcgtcgacccgtacctaacgttacccgtaactttaaccaacgtaacgttccggggtaccctagtccggtacggttacaggtcggacgtaggtggacgtcggtagggaaccgtagttactttacaccgttactacctaccgtaagtaacgtactaacgtacgttaacggtaaccgtaaggtaaacgttaagtttaaggtaacgtaacttacgtttacttacgtactaactaacgtaacgttaacctaacttacccgttacccgttaacgttaccgttttacgaaccggtacgggaaccgtaacgtacgtacggtaagtacgtacgtaacggacggtaacgttcgggtacgtcgtaccgtactaacccgtacttccgtgttacccc

SEQ ID NO: 292492 - DNA, 734 bp, Homo sapiens
  misc_feature: GYAE6OF01AODPP.33.68.G02.1.454.CMB.1.raw
  modified_base (101)..(101): a, c, t, g, unknown or other
  misc_feature (101)..(101): n is a, c, g, or t
tcagtacacacactcacgaccggtgctcgatttagtcgatagtgaagggaaagggggagtcagtctcagtcaggacacagcatggacatgagggtccccgntcagctcctgggctcctgctactctggctccggaggtgccagatgtgacatccagatcgacccagtcctcccaccctcctgtctgctatctgtcggagacagagtccacattctcgttcggccgggactaacgtcaaggacgcctagttccgtccgtacttaattttaaagtggtatcgagaccaacggaaaccgagggacctaaaccgtaccccctaaaactccgtagtactactagtcgtccgttcggtccgttacccagttccgtacggtaaccgttaaacggggttcccgggtaccctaagttaaccggtaacgggtttccggaggttacggtacggtagggttacggtaacgttccgggtaaggggtaaccttaagtttaccgtttacctaacccgttcctaacccgaacctaacgtaccgtacgtaccgtacgttccgtacgtaacctaacgttaggtaacttactttacgaacctttactttacttcgtacgtactaaccgtaacgtacgttaacttaccttacccgttacccgttacgttaccgttaccgggaccgtaacgggacctacggtcgtaaggacttacgccgtaacggacgtacggtacggtacgcctcgaccttacg

SEQ ID NO: 292493 - DNA, 809 bp, Homo sapiens
  misc_feature: GYAE6OF01C5TXH.33.68.G02.1.454.CMB.1.raw
  modified_base (240)..(240): a, c, t, g, unknown or other
  misc_feature (240)..(240): n is a, c, g, or t
tcagtacacacactcacgaccggtgctcgatttagtcgatagtgaaggggaaagggggagtcagtctcagtcaggacacagcatggacatggacgggtcccccgctcagctccgtggggcctcctgcctcctctggctccgaggtgccagatgtgacgtcagatcgacccagtcctccatcccttccctgttccttcatctaggtaggagacagagtccactatctacgttcggccgganaaggtgagagactattaacgaacctttaagtttagtaagtttggtaactacgacgacgaaggaacgaaccgtaaacggggaaacccgaccccccgtaaacgttcccgtacgtactccgtccgtccgacccgtactaccgttaccgttaactttaaccaacgtacggtaccgggtaccagtcggtagtacgaggtacggacgtaggtacggtacgtaggtacgggacttaacgttactttaccgaccttacccgtaacctaaccgttaacgtaaacgtaccgttaacgttaccggttaaaccggttaaaccgttaagggttaaagttttaacggttttaagggaaacgtttaaccgtttactttacgttacgtaacccgtaaacggttacgtttaaaccgtttaacgttaaacccggttaacccggtttaacgtttacccgggtttacgggaacccggtaacggggtacctaaggtaccggtaacggaacgttaacgaacgaaaccggtaccgtaacgttcgggtacggtactaccgtacctaactagtttaccctcgttaccgttaccg

SEQ ID NO: 292494 - DNA, 664 bp, Homo sapiens
  misc_feature: GYAE6OF01EMN9D.33.68.G02.1.454.CMB.1.raw
  modified_base (101)..(101): a, c, t, g, unknown or other
  misc_feature (101)..(101): n is a, c, g, or t
  modified_base (239)..(239): a, c, t, g, unknown or other
  misc_feature (239)..(239): n is a, c, g, or t
tcagtacacacactcacgaccggtgctcgatttagtcgatagtgaagggaaagggggagtcagtctcagtcaggacacagcatggacatgagggtccccgntcagctcctgggctcctgctcctctggctccgaggtgccagatgtgacgtccagatcgacccagtcctccatccctccctgttcttcattctggtagagacagagtccaccatccacgttggccgggacaaggtgagngactaattacgaacttatttagaattggtatcagcagacgaccgaagggaaccacccccgtaaactcctagacttctctcgccgcactaccgtatttaccgacacgtcgggtacccagtcgtagtctagtggcagtgatcgtaggacagttacttacaccttacgtacctacctaagtacgacgtagttaccgtacgtaacgtaggtaaaggtttagtttagggtaacgtactttacgtttctaagtactaacgtacgttaactttaacgttaaccgttaacccgttaccgttaacgttttaccgggacccgtaacgggtaaccgtaacgtacggttaggacgtaacttaaccggaaacggtaccgtaaacggttcgggacgttactacggtaccctaacgttaccgttcttacgttccttaccg

SEQ ID NO: 292495 - DNA, 810 bp, Homo sapiens
  misc_feature: GYAE6OF01DZM91.33.68.G02.1.454.CMB.1.raw
  modified_base (271)..(271): a, c, t, g, unknown or other
  misc_feature (271)..(271): n is a, c, g, or t
tcagtacacacactcacgaccggtgctcgatttagtcgatagtgaagggaaagggggagtcagtctcagtcaggacacagcatggacatgagggtccccgctcagctccgtggggctcctgctcctctggctccgaggtgccagatgtgacgtccagatgacccagtctccatccctcctgtcttcatctgtagagacagatcacagtccacgttcggccgggacaagtgagagactaagttaagaaaccttagtttagtaattggttaancgagacgaagaacgaaaccgaaggaaaccgaacccccgtaaacttccgtagtaactccgtccgtcgacccgtactacgtacccgttaagtttaaccaacgtaacgttcgggtacccagttaccgtaggttacgaagtggtacgaggtacggtagttaccggtagggtaacgtacgtttaacttacctaccgtacctaaccgtaacccgtaaagttaacgacgttaacggttaccgttaaaccgggtaaaccgtttaaagggttaaaccgttttaaaggttttaacgggaaacgtttaaacgtttaccgtttacggttaccgttaaacgtaaaacgttacgttaaacccgttttaagtttaaacccggttaaaccccgttttaaccgtttaacccggtttttaaccggggaaccggtaaacggggaaaccccttaagggtacggtacggtaaactaaccggtaaacgtaaaccggaaccgtaaggtttcggacgtaccgttcggaacctaacgttacttcggttaacctcgttttaaccc

SEQ ID NO: 292496 - DNA, 808 bp, Homo sapiens
  misc_feature: GYAE6OF01CKCM0.33.68.G02.1.454.CMB.1.raw
  modified_base (140)..(140): a, c, t, g, unknown or other
  misc_feature (140)..(140): n is a, c, g, or t
tcagtacacacactcacgaccggtgctcgatttagtcgatagtgaagggaaagggggagtcagtctcagtcaggacacagcatggacatgagggtccccgctcagctccgtgggcctcctgctcctctggctccgaggtnccagatgtgacgtccagatcgacccagtcctccactcctccctgttccttcattctagtaggagacagtagtccaaccatctaccgttcggacccgggtacaaggtcggagtagtacctaagtttaacgaaaccgtttatttaggtaacgtttagggttaacttccgaagacgaaggacgaaccggaacgggtaaaaccccgaaccccccaaaacgttcccgtacggtaacttaccgttaacgtcgtcgttacggaccggttacctacggttctacggacggtaaacgggttccggggtaaccctacggtacgttaacggttcgtaagggtacggtacgtaagggttaggtaagttaccgggtaggggaacttacgttaacctttaccaccgttactacctaactacgtacgacgtctaacgtccgtacgtaaccgtaaccgtagttaagtttactttaccgtaactttaaccgtttacttacgtttacgtaaccgtaacgtaagtaccgtaacctaacccgtaaacccgtacccttaccgtttaccgttacccggtttaccccggtacccgttaccggtaaccgtacggtacggttacggtacctacccggttaaccgtaaacccggtacgttccgggtagtacctaccggacccgtacgttacccg

SEQ ID NO: 292497 - DNA, 721 bp, Homo sapiens
  misc_feature: GYAE6OF01AU5UH.33.68.G02.1.454.CMB.1.raw
  modified_base (140)..(140): a, c, t, g, unknown or other
  misc_feature (140)..(140): n is a, c, g, or t
  modified_base (477)..(477): a, c, t, g, unknown or other
  misc_feature (477)..(477): n is a, c, g, or t
  modified_base (654)..(654): a, c, t, g, unknown or other
  misc_feature (654)..(654): n is a, c, g, or t
tcagtacacacactcacgaccggtgctcgatttagtcgatagtgaagggaaagggggagtcagtctcagtcaggacacagcatggacatgagggtccccgctcagctcctggggctcctgcctcctctggctccgaggtnccagatgtgacgtccagatcgacccagtcctccactccctccctgtctgcatctgtcggagacaggatcacctatcctcgttggcccgggacaaggtgagtagactaatttaacgaaacctttagtttacgtaaagtttggttaactacgaggacgtaaggaacggaaccgaacggggtaaaacccgacccccccgtaaaacttccctaggtactccgttccgtccgaccgccttaacgtacccgtaactttaaccaacgtaacggttcggggtaccccacgttacggtaggtttacgaggttagcgtaggtgacgttacggtagggtactaagttnttaccgtacctactaccaaccgtaataacgcgtacgtacgtacgtaactagtaattaaggtttagaagttacttacgttactcgtaacaacgttaacgtacctttaaagtaaccgttaacccgttaaccgtttacggtttacggaacccgtagggaacctacggtacttacgggaanacgtaccgaagtaccggtaacgttaggtaccggctaccgtaccagttaccgttcgttcggttacccg

SEQ ID NO: 292498 - DNA, 705 bp, Homo sapiens
  misc_feature: GYAE6OF01BYCH5.33.68.G02.1.454.CMB.1.raw
tcagtacacacactcacgaccggtgctcgatttagtcgatagtgaagggaaagggggagtcagtctcagtcaggacacagcatggacatgagggtccccgctcagctccgtggggctcctgctactctggcctcccgaaggggaaagacgcccaccctctcctgcgagggccagtcagagtgctggcagctaacttagcctacggtaaccaaaacaaaaaccgtggaccagacctcccaggcctctacactcttaatgatcgacaactcccgaaccgacgggccctaacgcgggaccaacctccccagacccgtaaggttccaaggtggaccgtaagggttcgggtaccgttagggaccaagtcctttacacctcctaccaaccctatacgacggtacaacggtaccaaggtacgaccttaagggtaaatttactttttggaactttaagttttttaacttaccgttggtttaacgtggaccgttaaggtccgttaacggacctaaacgttaccggtaacccctaaacggttacccgttacggaacccggtaaacgggaccaacgtacgttacgggaaattaacgttaaacggtacgtggacgtcacgtaacacgtactcgttagttcttctacgtcctcccgatacgtctaggtgttcgtaggttcacgtgggacggtcgggacgtagccggtaaggcctaaag

SEQ ID NO: 292499 - DNA, 741 bp, Homo sapiens
  misc_feature: GYAE6OF01DTA3T.33.68.G02.1.454.CMB.1.raw
  modified_base (314)..(314): a, c, t, g, unknown or other
  misc_feature (314)..(314): n is a, c, g, or t
tcagtacacacactcacgaccggtgctcgatttagtcgatagtgaagggaaagggggagtcagtctcagtcaggacacagcatggacatgagggtccccgctcagctcctgggctcctgctcctctggctccggaggtgccagatgtgacgtccagatcgacccagtcctccacttcctccctgtctgtcttcgtcgtcggagacagacgtacaccactctacttcgccgaggacgaggtaggacggtaactacgtttaacggttaaaatttttttaagttcggtttacagtaacaacgaaaccgaaggaaccnccgtaacaccttctagtactacgaacggacgactaactaccgtaaacggttacggtaaacggttaccgggaaccctaagggtaacgttacgaagggtgggtaagggtggacgtcggtaggggaacctagtttaacctttacccgctaactactcgacgtcaccgtcgtacgcacgtccgtagaactgttactacgactaaacgtactttaacgtacgttactaacaagtttaaagttaaccttaaattacccttaccggttaacccgtaacccggtttggtttaaccgggaacggtaccgggtaacaacggtccggtagtaacgtaacctaacggaaacgttacgggtagtacccggtcgaacgtacccaagtttcccgtacgtttaccgttaaccctttctaaccccgtttcccgacccccgttac

SEQ ID NO: 292500 - DNA, 859 bp, Homo sapiens
  misc_feature: GYAE6OF01C1R5W.33.68.G02.1.454.CMB.1.raw
  modified_base (101)..(101): a, c, t, g, unknown or other
  misc_feature (101)..(101): n is a, c, g, or t
  modified_base (826)..(826): a, c, t, g, unknown or other
  misc_feature (826)..(826): n is a, c, g, or t
  modified_base (844)..(844): a, c, t, g, unknown or other
  misc_feature (844)..(844): n is a, c, g, or t
tcagtacacacactcacgaccggtgctcgatttagtcgatagtgaagggaaagggggagtcagtctcagtcaggacacagcatggacatgacgggtccccntcagcctcggtcggcctctgctctcgcgcgtcggtagcacgagtgtgtcgtacctcgagtcgtaccgaccgtgtcctcctaccttcccgttcgtcttaccttagtcgtggttaacggaggaccagtacgtactaccacgtaaccttcggtaccgtacgggaccggtaagaggtaggtaccgaagtaacttacgtttaaaccgttaatttaggtttaagtttacggttacgtaacttacgacgtaaacggaccggtaaacccggaaccgggaaaaccccgggtaaccccaaacccccggtaaccttccggtacttaccgttacccggtaccgtacccggaccgttaaccggttaaccctttaaccgttaaacgtttaaacccggaccggttttaacccgggaccgggttaacccttttaggggaaccggtttaccggtacggtaacggttacgggacggtttaaggggtccgttacccgttagggaacgttaccgtttacttaacccggttcttaacccgacctaaacgtacgttaacgtaaccggtaccgttacggtaccggtaaccgttaaggttaacggtaacgtttacggtaacgttaacgttacgttacgtacgtaacgtacgtaacgttacgttaacttaaccgttaacttacggttacgttacggaccgaggtaacgtacgtaacggtgtacgacgttacgagtaccgtacgtggtacngtaccgactacctattanccgttacttcgtccg

SEQ ID NO: 292501 - DNA, 843 bp, Homo sapiens
  misc_feature: GYAE6OF01AIBLJ.33.68.G02.1.454.CMB.1.raw
tcagtacacacactcacgaccggtgctcgatttagtcgatagtgaaggggaaagggggagtcagtctcagtcaggacacagcatggacatgagggtccccgctcagctcctggggctcctgctcctctggctccgaggtgccagatgtgacgtccagatgacccagtctccatccctccctgtcttcatctgtaggagacagatcaccatccgacgttcggaccgggactaaggtgaacggtacgactaaacgtttaacggtaaacctttagttttaaggaaagttttaggtaacgtacgtaacggacgtaaacggaaaccggaaacccggaaaacgggggtaaaacccccaacccccccgtaaaaccttcccgaacgtaaccttccgtaccgtccgacccgtacctaacgttaaccgttaactttaaccgaaaccggtaacggttacccggggtaccctaacggttccggttacggttacgaagggttcggaacgtagggttacggtacgttaccggtacggggtaactaacgtttactttaaccgtaccttaccgttaacccaaccgttaagtaaccgtacgtacggttaaccggttaaaccggtaacgttaacggttaaacgtttaaggtttaaggtaaacgtttaccttaccgttacgaacttaacgaaacttaccgttaaaccgtttaacgttaacccggttaacccgtacgttaccgttaccgggaaccgaacgggtaaccaaggtacgtaggaacgtaacgtaaacggtacgtaaccgggtacgttcgggtaccgtactaaccggactaacccgtacgttcttcgttcttaacccg

SEQ ID NO: 292502 - DNA, 728 bp, Homo sapiens
  misc_feature: GYAE6OF01APC5Z.33.68.G02.1.454.CMB.1.raw
  modified_base (102)..(102): a, c, t, g, unknown or other
  misc_feature (102)..(102): n is a, c, g, or t
  modified_base (264)..(264): a, c, t, g, unknown or other
  misc_feature (264)..(264): n is a, c, g, or t
  modified_base (703)..(703): a, c, t, g, unknown or other
  misc_feature (703)..(703): n is a, c, g, or t
tcagtacacacactcacgaccggtgctcgatttagtcgatagtgaagggaaagggggagtcagtctcagtcaggacacagcatggacatggagggtccccgntcagctccgtggggctcctgctcctctggctccggaggtgcctagatggtgaccgtccagatcgacccctagtcctccacgttccctccctgtccttcattctaggtaggagacgagacgtcaacctatcctacgttcggccggggtactaaggtggaggancgtaattaacgtaaccgttagttttagtaagtttggtaactacgaggtacgaagacggaaccccggaacggggaaaccccgacccccctaaaccctccgtacgtaccttccgtccgtccggccgacgtacttaccgtaatttaaccacgtaacgtccggggtacctgtacggtagttcgaggtcggtacgaggtcggtagtccggtaggtactagttacttccaccgttactaccgaaccgtaataccggactacggttacgtaacggtaacgttaggtaacggtttagttaaccgggtaacttacttaccggttacttacggtaacaacgtaacgttaactttaacgtaaccggttaccttacggtttaacgttcggaaccggtaaccgggaactacgacggttaggaacctgaacgacggtacgtacggtggaccgnacgtcacgtattgtcttaaccgtcg

SEQ ID NO: 292503 - DNA, 929 bp, Homo sapiens
  misc_feature: GYAE6OF01CCJV0.33.68.G02.1.454.CMB.1.raw
  modified_base (101)..(101): a, c, t, g, unknown or other
  misc_feature (101)..(101): n is a, c, g, or t
  modified_base (419)..(419): a, c, t, g, unknown or other
  misc_feature (419)..(419): n is a, c, g, or t
tcagtacacacactcacgaccggtgctcgatttagtcgatagtgaagggaaagggggagtcagtctcagtcaggacacagcatggacatgacgggtccccntcagctccgtggggcctcctgctcctctggctccggaggtcgccagatcggtacgtaccgtaccaaggacgtaccgacccgtagttccctacccgtacttcccttaccccgtggtttcccttacgactttcgtaggtaagggagacaggtacgtccaacctacgtcctacgtcgggccggtaacaagtcggagacgtacgtaattaaccgaacgttttagttaacgtaagtttcggtatccggagactaacgggaacgaacccggaacgggtaaacccctaacccccctaacggtccgtacggtaccttccgttaccnccggtacctacgttaccgtaccgttaactttaaccgaacggttaacggttcccgggttaacctggtaccggtacggttacgaggttcggaagttacggtcgggtacttaccgggtaacgtaaagtacgtttaacgttaccctaccggttactaaccgaaccgttaacgtacgttaacggtaaccgttcggtaaaccggtacgtttaaaccgggttaaggttttaacggttaacgggttaacgttaaccgttaaccggtttacgttaccggtaaaccttaaacggtaccgtttaacgttaaccggttttaacccggttaacccgttttaaccgttaaccggggtttaccggtaaacccgggtaacgggttaacccggtaaggttaccgggtaacgggtaacgttaccggtaaacccggttaacgggaacggttaccggttcggggttacctaccggtaaccgtaacccgttaccgtaaaccgtttccggttaccgtttacccttaacccgg

SEQ ID NO: 292504 - DNA, 529 bp, Homo sapiens
  misc_feature: GYAE6OF02IUXBV.33.68.G02.1.454.CMB.1.raw
tcagtacacacactcacgaccggtgctcgatttagtcgatagtgaagggaaagggggtaggtctagtctcagtcaggacacagcatggacatgaggtcccgctcagctcctgggctcctgctcctctggctccgaggtgccagatgtgacgtccagatgacccagtctccatcctccctgtcttcatcctgtacggagacagagtcaccattcacttgcccgggcaagtgagagcattagaacctatttgaattggtatcacgcgaggagaccagggaagccccaaactcctgatctctgccgcactccgatttacacaatgggtcccatcgagttcagtggcagtgatctggacagatttcaccttctacaccataagcagtctggaacctgaagtattttggaaagtatacttcttgtacaacagtacttatagttaacccgttactacttttggccctaagggaccaagcgtacggagactacgaacgtacgaactgtcggactcgacgaccatccttgtccttac

SEQ ID NO: 292505 - DNA, 516 bp, Homo sapiens
  misc_feature: GYAE6OF02IQDYO.33.68.G02.1.454.CMB.1.raw
tcagtacacacactcacgaccggtgctcgatttagtcgatagtgaagggaaagggggagtcagtctcagtcaggacacagcatggacatgagggtccccgctcagctcctggggctcctgctcctctggctccgaggtgccagatgtgacgtccagatgacccagtctccatcctccctgtcttcatctgtaggagacagagtcaccatcacttgccgggcaagtgagagcattagaacctatttgaattggtatcagcagagaccagggaaagcccccaaactcctgatctctgccgcatccgatttacacaatggggtcccatcgagttcagtggcagtgatctgggacagattcactctcaccataagcagtctggaacctgaagtattttaggaagtatacttctgtacaacagtacttatacgttaacccgtactacttttggacctaaggggacccaaagctagggagatacgaagaccgaactgtaggtctggacaccatctgtcttac

SEQ ID NO: 292506 - DNA, 522 bp, Homo sapiens
  misc_feature: GYAE6OF02GNXE3.33.68.G02.1.454.CMB.1.raw
  modified_base (275)..(275): a, c, t, g, unknown or other
  misc_feature (275)..(275): n is a, c, g, or t
tcagtacacacactcacgaccggtgctcgatttagtcgatagtgaagggaaagggggagtcagtctcagtcaggacacagcatggacatgagggtccccgctcagctcctggggctcctgctcctctggctccgaggtgccagatgtgacgtccagatgacccagtctccatcctccctgtcttcatctgtaggagacagagtcaccatcacttgccgggcaagtgagagcattagaacctatttgaattggtatcagcagagaccagggaaacncccccaaactcctgatctctgccgcatccgatttacacaagtcggggtcccagtcgaggttcagtggcagtggatcgtgggacagtatttcactctcaccataagcagtctaggaacctgaagtattttaggaagtatacttctgtacaacagtaacttataacgtaacccgtactacgttttcgaccgtagggaccaagtcgtaggagagtacgaagacgaacgtgtgctgcaccatctgtcttac

SEQ ID NO: 292507 - DNA, 515 bp, Homo sapiens
  misc_feature: GYAE6OF02IZ215.33.68.G02.1.454.CMB.1.raw
tcagtacacacactcacgaccggtgctcgatttagtcgatagtgaagggaaaggggagtcagtctcagtcaggacacagcatggacatgagggtccccgctcagctcctggggctcctgctcctctggctccgaggtgccagatgtgacgtccagatgacccagtctccatcctccctgtcttcatctgtaggagacagagtcaccatcacttgccgggcaagtgagagcattagaacctatttgaattggtatcagcagagaccagggaaagcccccaaaatcctgatctctgccgcatccgatttacacaatggggtcccatcgaggttcagtgcagtgatctgggacagatttcactctcacataagcagtctggaacctgaagtattttaggaagtattacttctgtacaacgtagtaacttaataacgtaacccgtactaacgttttggacctaaggggaccaagctaggagtatcgaaggcgaactgtaggctagccacatctgtcttc

SEQ ID NO: 292508 - DNA, 513 bp, Homo sapiens
  misc_feature: GYAE6OF02JXB5I.33.68.G02.1.454.CMB.1.raw
  modified_base (274)..(274): a, c, t, g, unknown or other
  misc_feature (274)..(274): n is a, c, g, or t
  modified_base (388)..(388): a, c, t, g, unknown or other
  misc_feature (388)..(388): n is a, c, g, or t
  modified_base (395)..(395): a, c, t, g, unknown or other
  misc_feature (395)..(395): n is a, c, g, or t
  modified_base (428)..(428): a, c, t, g, unknown or other
  misc_feature (428)..(428): n is a, c, g, or t
  modified_base (503)..(503): a, c, t, g, unknown or other
  misc_feature (503)..(503): n is a, c, g, or t
tcagtacacacactcacgaccggtgctcgatttagtcgatagtgaagggaaagggggagtcagtctcagtcaggacacagcatggacatgagggtccccgctcagctcctggggctcctgctcctctggctccgaggtgccagatgtgacgtccagatgacccagtctccatcctccctgtcttcatctgtaggagacagagtcaccatcacttgccggcaagtgagagcattagaacctatttgaattggtatcagcagagaccagggaaacnccccaaactccagactctatgctgcgtcagtctgacaagtcgggtccatcgaaggttcagtggctaggtggatcgtagggactaggtatttcacttcacacctatcagcagtcngactacngtaacgtatttgactaacttcttactgtacaanacgtataccactaaccacctattaccacgtttaccgcctaggacctacgtcgtgatcgtacaaccgatgcgtacncgacactacg

SEQ ID NO: 292509 - DNA, 553 bp, Homo sapiens
  misc_feature: GYAE6OF02G1L86.33.68.G02.1.454.CMB.1.raw
  modified_base (277)..(277): a, c, t, g, unknown or other
  misc_feature (277)..(277): n is a, c, g, or t
  modified_base (370)..(370): a, c, t, g, unknown or other
  misc_feature (370)..(370): n is a, c, g, or t
  modified_base (398)..(398): a, c, t, g, unknown or other
  misc_feature (398)..(398): n is a, c, g, or t
tcagtacacacactcacgaccggtgctcgatttagtcgatagtgaagggaaagggggagtcagtctcagtcaggacacagcatggacatgagggtccccgctcagctcctggggctcctgctcctctggctccgaggtgccagatgtgacgtccagatgacccagtctccatcctccctgtcttcatctgtcggagacagagtcaccatcacttgccaggcgagtgaggacattacggaaatttttaaattggtttcagcaagaaaccagggaaacncccctagactcctgattcacgaggcatccaattcggaaatacggggtccagaaggttcagtggaggtggagcgtgggacagtacttttacccncaccatcagcagcctgcagcctagaagntctgctacattattactgtacaactagtataataactcctaccgtactactttcggacctaaggggtaccaaggcgtaggagtaactacgaaacgtactggtacggcttacgacctacctattccttcgttaccttctacttcccgttccccgac

SEQ ID NO: 292510 - DNA, 582 bp, Homo sapiens
  misc_feature: GYAE6OF02IPY18.33.68.G02.1.454.CMB.1.raw
  modified_base (196)..(196): a, c, t, g, unknown or other
  misc_feature (196)..(196): n is a, c, g, or t
  modified_base (219)..(219): a, c, t, g, unknown or other
  misc_feature (219)..(219): n is a, c, g, or t
  modified_base (276)..(276): a, c, t, g, unknown or other
  misc_feature (276)..(276): n is a, c, g, or t
tcagtacacacactcacgaccggtgctcgatttagtcgatagtgaagggaaagggggagtcagtctcagtcaggacacagcatggacatgagggtccccgctcagctcctggggctcctgctcctctggctccgaggtgccagatgtgacgtccagatgacccagtctccatcctccctgtcttcatctgtaggancagagtcaccatcacttgccggnaagtgagagcaataagcaactatttaaattggtatacaaacagaaaccagggaaacncccctaaggtcctagatctatgctgcgtccagtttgcagagcgggtaccatcaaggtcagtgcagtggatcgtggacagtattcacgtctcacctatcgagtcacgtctcgaccgaaacgttgaaagttgttttacgaccttaaacttacgtacttagtaccaaacgtagtaaccgtactaacgtaaaccctacccctaagtttaccctaccgtttttccggaccccgtcgggtaaccacgtacggtgaacgttcgtaccgaaacccgtagtggtaccgtgtccgaactaacctcgttaccgttcg

SEQ ID NO: 292511 - DNA, 583 bp, Homo sapiens
  misc_feature: GYAE6OF02G83I5.33.68.G02.1.454.CMB.1.raw
tcagtacacacactcacgaccggtgctcgatttagtcgatagtgaagggaaagggggagtcagtctcagtcaggacacagcatggacatgagggtccccgctcagctcctggggctcctgctcctctggctccgaggtgccagatgtgacgtccagatgacccagtctccatcctccctgtcttcatctgtaggagacagagtcaccatcacttgccgggcaagtgagagcattagaacctatttgaattggtatcagcagagaccagggaaacgcccccaaactcctgactctctgccgcatccgatttacacaatggggtcccatcgaggttcagtggcagtggatcgtgggacagtatttcactctcaccataagcacgtctaggaacctgaagtagttttagggaagtattactttctgttacaaactagtaacttaataacgttaaaccccgtacttaaccgtttttagggacccgtaaggggacccaaaggtcgtagggacgtaagtaccgaaaggtccgaaacgttggtacggtcgtacggaccctaaccgtacgttccgttacggttccttaccg

SEQ ID NO: 292512 - DNA, 579 bp, Homo sapiens
  misc_feature: GYAE6OF02HDPPB.33.68.G02.1.454.CMB.1.raw
tcagtacacacactcacgaccggtgctcgatttagtcgatagtgaagggaaagggggagtcagtctcagtcaggacacagcatggacatgagggtccccgctcagctcctggggctcctgctcctctggctccgaggtgccagatgtgacgtccagatgacccagtctccatcctccctgtcttcatctgtaggagacagagtcaccatcacttgccgggcaagtgagagcattagaacctatttgaattggtatcagcagagaccagggaaacgcccccaaactccctgatctctgccgcatccgatttacacaagtggggtcccatcgaggttcagtggcaggtgatcgtgggacagtatttcactctcaccataacgcagtctaggaacctgaagtattttaggaagtattacttcgtagtcaaacagtaacttaagtaacgttaacccgtaactacgttttacggaccgtaacggggtaaccctaaaggtccgtagggacgtactaccgaaaggtaccgtaaacgttcggtacggtcgtacgaccgtaaccctaattccgttagttcctttaccg

SEQ ID NO: 292513 - DNA, 604 bp, Homo sapiens
  misc_feature: GYAE6OF02IV91C.33.68.G02.1.454.CMB.1.raw
  modified_base (196)..(196): a, c, t, g, unknown or other
  misc_feature (196)..(196): n is a, c, g, or t
  modified_base (394)..(394): a, c, t, g, unknown or other
  misc_feature (394)..(394): n is a, c, g, or t
  modified_base (420)..(420): a, c, t, g, unknown or other
  misc_feature (420)..(420): n is a, c, g, or t
tcagtacacacactcacgaccggtgctcgatttagtcgatagtgaagggaaagggggagtcagtctcagtcaggacacagcatggacatgagggtccccgctcagctcctggggctcctgctcctctggctcccagataccagatgtgacgtccagatgacccagtctccatccctcctgtctgcatcagtggganacagagtcaccatcacttgccgggcaggttcggacattttactatttttggccttggtatctagcagagagaaggggtaagtctagactcctagatctatggtgcatccactttgcatcagggtccatctcgctcagtgcagtgtattggactagatttcgactctcacgtcaactcgctggctacgctagtaacgtntttacgcttaaagtttacttaccgtntaaccgtaaaaggttataacggactacggtaccggtacccgcttaccgtaacccttttccggacccgtttacggggaaccttaaacgggtacggtaaaatacccggtaaaaacgtaacgttacggtacggttacgtaccggtacccgttaaaccctagtttacccgtacggtttacttaacccg

SEQ ID NO: 292514 - DNA, 625 bp, Homo sapiens
  misc_feature: GYAE6OF02G6KSL.33.68.G02.1.454.CMB.1.raw
  modified_base (275)..(275): a, c, t, g, unknown or other
  misc_feature (275)..(275): n is a, c, g, or t
  modified_base (293)..(293): a, c, t, g, unknown or other
  misc_feature (293)..(293): n is a, c, g, or t
  modified_base (367)..(367): a, c, t, g, unknown or other
  misc_feature (367)..(367): n is a, c, g, or t
tcagtacacacactcacgaccggtgctcgatttagtcgatagtgaagggaaagggggagtcagtctcagtcaggacacagcatggacatgagggtccccgctcagctcctggggctcctgctcctctggctccgaggtgccagatgtgacgtccagatgacccagtctccatcctccctgtcttcatctgtaggagacagagtcaccatcacttgccggcaagtgagagcattagaaccttatttgaattggtatcagcagagaccagggaaacncccccaaatcctgactcnctgccgcatccgatttacacaagtcggtcccagtcgaggttcagtgcagtgatcgtggacagtactttcacctntcacctataagcagtctaggaactgaagtattttaggaacttagttacttcgtagtacctaaacgtagttactttaacgtaaaccggttaacccgtaacgtttaacgttttcgggacccgtaacggggaaccctaaaggtccgttaagggaacggtacgttaaccgtaaacgggtaccgtaaaacggttcgggtaccggttaccgttacggtacccgtaaaccggtaaccgtccggtttacggttaccgtttaacccg

SEQ ID NO: 292515 - DNA, 709 bp, Homo sapiens
  misc_feature: GYAE6OF02IKHL7.33.68.G02.1.454.CMB.1.raw
tcagtacacacactcacgaccggtgctcgatttagtcgatagtgaagggaaagggggagtcagtctcagtcaggacacagcatggacatgagggtccccgctcagctcctggggctcctgctcctctggctccggaggtgccagatgtgacgtccagatgacccagtcctcccaccctccctgtctgcatctgtcggagacagatcaccatctcgttggccgggcaagtcagagcactccgtccgtcttaatttaaagttggtatacagacgaacgaaaccgagggaccaaccgaccccttaaaactccctagtacttactagtcgtcgtcgtccgtccagttccgtaggaccgtaaagggttcgggtacccagtacgtagggttactaggtcggactaggtaggtacgttcggtaagggtactaacgttagtttacccgactacctaccaacccgtactccgaacgtacgtacgttctaccgtaacctaaacccgttaggtaaacgtttacgttttaccgtaaccttaacctttttaccgttaccgttaacgttaacctaaacttaaccgttaagttaacctaccgtttaccgttaccccgttaacgttaccggtttaccgggaccggtaacgggtaccgtaaggtcgtagggtaactacgtaccggacggtaacgtacgttcggtacggactacggacctacctacg

SEQ ID NO: 292516 - DNA, 704 bp, Homo sapiens
  misc_feature: GYAE6OF02H08CO.33.68.G02.1.454.CMB.1.raw
  modified_base (138)..(138): a, c, t, g, unknown or other
  misc_feature (138)..(138): n is a, c, g, or t
  modified_base (195)..(195): a, c, t, g, unknown or other
  misc_feature (195)..(195): n is a, c, g, or t
tcagtacacacactcacgaccggtgctcgatttagtcgatagtgaagggaaagggggagtcagtctcagtcaggacacagcatggacatgagggtccccgctcagctcctggggctcctgctctctggctccgaggtnccagatgtgacgtccagatgacccagtctccatccctcctgtcttcatctgtagganacagagtccacatcacgttggccgggacaagtgagagctaattacgaaccttatttagaattggtatcgagacgaaggaacgaccggaacgggaaacccaacccccgtaaactccgtagtacttcctcgtccgcccgtactaccgttaccgtactttaacgaacgtacggtcccgggttacccagtcggtacggtcgtaggtcggacgtaggtacggtacgttcgggtacggaactacggttactttacctacttactaccaactaagtaacgctacgtacgtacggtaacgtagtaaggtttacggtttaagaacttacgttacttcgttacgtaacgtaacgtaacttaacgttaccgttaaaccgttaacccgttactttaaccggttaccgggaaccgtaccgggtaaacgtacgtacgtacggtacaacgttacgaaacggtaccgtaggttaggcgtaccgtaccgaccgtaaccttcggttacttacccgttcttaacccgg

SEQ ID NO: 292517 - DNA, 572 bp, Homo sapiens
  misc_feature: GYAE6OF02GE38V.33.68.G02.1.454.CMB.1.raw
tcagtacacacactcacgaccggtgctcgatttagtcgatagtgaagggaaagggggagtcagtctcagtcaggacacagcatggacatgagggtccccgctcagctcctggggctcctgctcctctggctccgaggtgccagatgtgacgtccagatgacccagtctccatcctccctgtcttcatctgtaggagacagagtcaccatcacttgccgggacaagtgagagcattagaacctattgaattggtatcagcagagaccagggaacaccccaaactcctagactctctgccgcactccgattacacaagtcgggtccagtcgaggttcagtggcagtgatcgaggacagtattcactctacacctataacgcagtcgtaggaacctaggaagttagttttaggaagttaacttacgtttctagtacaactagtaacttaataacgttaacccgtactacgtttcggaccgaaggggtaccaacggtcgtaggacgtactacggaaggaccgtaaacgtggtacggtactacggacctaaccgtagttccgttacgtcctttaccg

SEQ ID NO: 292518 - DNA, 727 bp, Homo sapiens
  misc_feature: GYAE6OF02HVTSR.33.68.G02.1.454.CMB.1.raw
tcagtacacacactcacgaccggtgctcgatttagtcgatagtgaagggaaagggggagtcagtctcagtcaggacacagcatggacatgagggtccccgctcagctcctggggctcctgctcctctggctccgaggtgccagatgtgacgtccagatgacccagtcctccatcctccctgtcttcattctggtaggagacagagtcaaccatcacgttggccgggacaaaggtgagagtctaattaacgaaaccttattttacggaatttaggtaacttacgaggtacaggaacgaaccgaaggggaaaaccgaccccccaaaacgtccctagaacttcctcgtcggcccgctacgtacccgtaattttaaccgaacgtaacgttcggggtacccaagttcggtaaggttcgtaaggtggactagggtaggtacgtcgtaggggaacctaggttactttcctaaccgtttcctacgaacctagtaacgcgtaagttccgtaacggtaaccgttaagaacggttaagttttacgggaaacttaactttacgttacgtagtaacgtaaacgtacgttaacgtttaaacgtaacccgttaaaccccgttactttaaccggttttcgggaaccggtaacggggtaccgtaaagtcgtaacggtacgacttaccgaaggtacgtaacgtggttcgccgtacgtaccgtactaacgtttctacttcttaccg

SEQ ID NO: 292519 - DNA, 707 bp, Homo sapiens
  misc_feature: GYAE6OF02IR7NF.33.68.G02.1.454.CMB.1.raw
  modified_base (222)..(222): a, c, t, g, unknown or other
  misc_feature (222)..(222): n is a, c, g, or t
  modified_base (286)..(286): a, c, t, g, unknown or other
  misc_feature (286)..(286): n is a, c, g, or t
  modified_base (675)..(675): a, c, t, g, unknown or other
  misc_feature (675)..(675): n is a, c, g, or t
  modified_base (690)..(690): a, c, t, g, unknown or other
  misc_feature (690)..(690): n is a, c, g, or t
tcagtacacacactcacgaccggtgctcgatttagtcgatagtgaagggaaagggggagtcagtctcagtcaggacacagcatggacatgagggtccccgctcagctcctggggctcctgctcctctggctccgaggtgccagatgtgacgtccagatcgacccagtctccatcctccctgtcttcatctgtaggacacagatcaccatcacttgccggganaagtgagagctaattagaaccttatttgaattggtatcagcaagacgaaccgaagggaaacccnccccctaaaacgtcctagtacttctccgtagcccgactacgtccgtttaaactttaaccgaaccgttaacgggttccgggggtaccctaacgtacgggtacggtttaccgagggtcgggaccgtagggtacggtagttcggtagggaacctaagttactttaccaccgtttctaccgaaaccttaagtaacgtcctaaggttaccgtaccggtaaaccgtttggtaaaacgtttaggttttacggaaagttccttttaaccgttcgttacttaacgtaactaacgtaacgtttaacgtaaccgtttaaaccctactttaacgtttacggaacccggtaagggaacctaaggcgtaaggatacgtaccgaagtacgtaacgttggacgtntacgtcctaaccgtnttacgttcgtacctacg

SEQ ID NO: 292520 - DNA, 629 bp, Homo sapiens
  misc_feature: GYAE6OF02I8MLC.33.68.G02.1.454.CMB.1.raw
  modified_base (404)..(404): a, c, t, g, unknown or other
  misc_feature (404)..(404): n is a, c, g, or t
tcagtacacacactcacgaccggtgctcgatttagtcgatagtgaagggaaagggggagtcagtctcagtcaggacacagcatggacatgagggtccccgctcagctcctggggctcctgctcctctggctccgaggtgccagatgtgacgtccagatgacccagtctccatcctccctgtcttcatctgtaggagacagagtcaccatcacttgcccgggcaagtgagagcattagaacctatttgaattggtatcgagcgaagacgaccgaagggaaccaccccaaactcctagactctctcgccgcactccgtatttacgactaagtcgggtaccctagtcgtaggttcaggtgacgagtggatcgtagggactagtatttcgactactacactaatacgntagtctacgtaactggtaagtagtttaggaagttatttaccttacgtacgtacctaacgtaacgtaactttagtaaccgttaaaccgtacctttacggtttaccggaaccgtaacggggaacccttaaaggccgtagggtactacgtaacgtaaggtaaccgtaaacgttcggtaacggtccgttaacggccctaactacgtttacgttccgttacctttaaccg

SEQ ID NO: 292521 - DNA, 623 bp, Homo sapiens
  misc_feature: GYAE6OF02HGIE9.33.68.G02.1.454.CMB.1.raw
  modified_base (197)..(197): a, c, t, g, unknown or other
  misc_feature (197)..(197): n is a, c, g, or t
  modified_base (362)..(362): a, c, t, g, unknown or other
  misc_feature (362)..(362): n is a, c, g, or t
tcagtacacacactcacgaccggtgctcgatttagtcgatagtgaagggaaagggggagtcagtctcagtcaggacacagcatggacatgagggtccccgctcagctcctggggctcctgctcctctggctccgaggtgccagatgtgacgtccagatgacccagtctccatccctccctgtcttcatctgtagganacagagtccaccatccacttggcccgggacaagtgagagcaagttaacgaaccttatttagaattggtatcgagcagagaccgaagggaaaccacccccaaactcctagtactctcctcgccgactactccgtatttacactaagtcgggtcccagtcgagttcngtgcagtgatgagacagtcttcactctacacctatacgcacgtacgtacgtaactagtaagttacgtttaggaagttactttacgttacgttagtacaaactacgttaacttaacgttaaccgttaacccgttacttacgttttaccggaccgtaacgggtaacctaaggtacgttaggactaagtaccgaacgtaaccgttaacgtcggtaccggtacgtacgacccgtaacttacgttaccgttacgttccttaacccg

SEQ ID NO: 292522 - DNA, 731 bp, Homo sapiens
  misc_feature: GYAE6OF02H39BA.33.68.G02.1.454.CMB.1.raw
  modified_base (140)..(140): a, c, t, g, unknown or other
  misc_feature (140)..(140): n is a, c, g, or t
  modified_base (196)..(196): a, c, t, g, unknown or other
  misc_feature (196)..(196): n is a, c, g, or t
  modified_base (229)..(229): a, c, t, g, unknown or other
  misc_feature (229)..(229): n is a, c, g, or t
tcagtacacacactcacgaccggtgctcgatttagtcgatagtgaagggaaagggggagtcagtctcagtcaggacacagcatggacatgagggtccccgctcagctcctgggctcctgctcctctggctccgagtgccngatgtgacgtccagatcgacccagtcctccatccctcctgtcttcatctgtagganacgagagtacaccagtccacgttcggccggganaaggtgaagacgataacttaacggtaaccttagtttagtattaggtatcgagtacgaagacgaaccgaacgggaaaccgaacccccaaaacgtcccgtagtacttccgtaccgtcggaccggtctaaccgtaccgttaactttaacgacgtaaacgtcggggtaccctagtcggtacgttcgaggtcggatacggtaggtacgtacggtcgggaactacgttacttactacgttactaccgaacctaagtaaccgctacggttacgacggtacgtagtaagttacgtttaggaagtacgtttactcgttacgtaacgtaactaacgttacttaacgttaaccgttaaccggttaccgtttaacggtttccggaaccggttaaccgggtaaccacgggttaccgtagggttacccgtagtaaccggtaacggtaaccggttaagccggttaacgtccgtaaccgtacccgaccgttccgtagtttaccgtaccgttttacccg

SEQ ID NO: 292523 - DNA, 766 bp, Homo sapiens
  misc_feature: GYAE6OF02G397P.33.68.G02.1.454.CMB.1.raw
tcagtacacacactcacgaccggtgctcgatttagtcgatagtgaagggaaagggggagtcagtctcagtcaggacacagcatggacatgagggtccccgctcagctccgtggggctcctgctctctggctcgaggtcgccagatgtgacgtccagatcgacccagtctaccatcctcctgtacctcactctaggtaggacgtacgagtactccacgtatccacgttcgggccggtacaaggtgaggacgtacaagttaacgtaacctttagttagtaagtttaggtaactcgaacggacaacggaacggaaccggaaacgggtaaaacccctaccccctaaaacgttcctaggtaccttccgtaccgtccgaccgtactaacgtacccggtttaacttaccgaacggtaccggttacgggtacccctaagttcggacggtttacacggttacgggcctaaggggttcgtaaccggttacggtacggggaacttaaggttacctttcgaacccttcgtaccctaacgtaagtacgtactacggtacgtacggaacttaagggtactttaggttaagtaattacttacgttcgtaactacgtaactagttaacttaacgttaaccgtaaccgttacgttacgtttaccgacggtaaaccggactaagggtaccgtaggtaacgtacgttaacggaacgtaaccggtacggttacgtcgggttacaccggtaaccgtaccgttacgtttacgttacgtacctttaccg

SEQ ID NO: 292524 - DNA, 582 bp, Homo sapiens
  misc_feature: GYAE6OF02FOMT8.33.68.G02.1.454.CMB.1.raw
  modified_base (101)..(101): a, c, t, g, unknown or other
  misc_feature (101)..(101): n is a, c, g, or t
  modified_base (225)..(225): a, c, t, g, unknown or other
  misc_feature (225)..(225): n is a, c, g, or t
  modified_base (233)..(233): a, c, t, g, unknown or other
  misc_feature (233)..(233): n is a, c, g, or t
  modified_base (258)..(258): a, c, t, g, unknown or other
  misc_feature (258)..(258): n is a, c, g, or t
  modified_base (260)..(260): a, c, t, g, unknown or other
  misc_feature (260)..(260): n is a, c, g, or t
  modified_base (463)..(463): a, c, t, g, unknown or other
  misc_feature (463)..(463): n is a, c, g, or t
tcagtacacacactcacgaccggtgctcgatttagtcgatagtgaagggaaagggggagtcagtctcagtcaggacacagcatggacatgagggtccccgntcagctcctgggctcctgctcctctggctccgaggtgccagatgtgacgttccagatcgaccctagtctccatcctccctgtcttcattctgtaggagacgagagtcaccatcacttgcccggnaagtgagngcattacgacctattgaattgtatnancagagactaagggaacaccccaaactcctgactctctcgccgacgtagtcccgatttaacactaacggtcgggtacccagtccgtacggttcaggtcggctaggtggatcgtagggactagtactttcactactccacctagtaacgcatcgtagtaactagaagtattcgtaacttaacttacttacttacgtactaccganactaccaacaaccctacccatttaccgtaccgtttccgacccgttaggacccacgagtacgtagttacgtaccgtaaccgtaacgtggtccggactacggacctactacgtctcgttac

SEQ ID NO: 292525 - DNA, 825 bp, Homo sapiens
  misc_feature: GYAE6OF02F3BX8.33.68.G02.1.454.CMB.1.raw
  modified_base (238)..(238): a, c, t, g, unknown or other
  misc_feature (238)..(238): n is a, c, g, or t
  modified_base (518)..(518): a, c, t, g, unknown or other
  misc_feature (518)..(518): n is a, c, g, or t
tcagtacacacactcacgaccggtgctcgatttagtcgatagtgaagggaaagggggagtcagtctcagtcaggacacagcatggacatgagggtccccgctcagctcctggggctcctgctcctctggctccgaggtgccagatgtgacgtccagatcgacccagtctaccactccctcccttgtccttcattcgtgtaggagacagtacgtcaccatccgtacttcggacccgganaaggtgacgagacctaagttaaccgtaacctttaagttttagtaaagtttaggttaacttacgaaggtaccgaacggtaacggaacccggaaacgggggtaaacccccgaaacccccccgttaaaccgttacccgtacggttaacttcccgttacgtaccgcccgtacctaacgttacccgttaacgtttaaccgaacgttaacggttcccggggtacctaacggtaccggtaggttacgacggttacggacgtaggtaggtacgtacggtaggtaacgngttaaccttcgacctttaccgtacaaccgtagtaacgtacgtcggttaccgacggtaaccgtaggtaaacggttacggttttacggtaaacgttacttaccgtttacgttaccgtaacgtaaaccgttacgttaaccgtttaacgtaaccggtttaaccccgttacgttttaccgttaaccgggaccgggttaacgggaacctaacgggtacgttaacgggtagtaacgtaccggaaggtaaccttacgggtacgttacgggtccttacggaccctacgttaacgttctttacgttacccgttacgg

SEQ ID NO: 292526 - DNA, 666 bp, Homo sapiens
  misc_feature: GYAE6OF02G00JE.33.68.G02.1.454.CMB.1.raw
  modified_base (221)..(221): a, c, t, g, unknown or other
  misc_feature (221)..(221): n is a, c, g, or t
tcagtacacacactcacgaccggtgctcgatttagtcgatagtgaagggaaagggggagtcagtctcagtcaggacacagcatggacatgagggtccccgctcagctcctgggctcctgctcctctggctccgaggtgccagatgtgacgtccagatcgacccagtctccatccctcctgtcttcatctgtaggagacagatcaccatcacttggccgggnaagtgagacgctaatttaacgaaccttattttagtaaagtttggtaatcaagacaaggacgaaccgaaagggaaaccgaccccctaaaactcctaggacttccgtcgtcgaccgacctaacttccgtaactttaacaaccgtaaggttccggggtaccctagtccggtagtttcgaggtcgggacaggtacggtattcggtagggactacgtatttccacttcctactaccaagtaacgtacgtacgtactacggtaactagtaacgttaagttttaggaagtacgttacttagttcgtactaactacgtaacttaacgttaacttaaaccgttacttaacgtttacggaccgtaacggggaacctaacggtcgtacggtagtacgtacgaacggtacgtaacgtcggtacggtgtacgtaccacgtcgtacgttcttcgttacc

SEQ ID NO: 292527 - DNA, 746 bp, Homo sapiens
  misc_feature: GYAE6OF02JC071.33.68.G02.1.454.CMB.1.raw
  modified_base (226)..(226): a, c, t, g, unknown or other
  misc_feature (226)..(226): n is a, c, g, or t
  modified_base (417)..(417): a, c, t, g, unknown or other
  misc_feature (417)..(417): n is a, c, g, or t
tcagtacacacactcacgaccggtgctcgatttagtcgatagtgaagggaaagggggagtcagtctcagtcaggacacagcatggacatgagggtccccgctcagctcctgggctcctgctcctctggctccgaggtgccagatgtgacgtccagatgacccagtctccatcctcctgtcttcatctgtaggagacagagtcacatctcttgcccggcaagtcagncatcgtccgcctatttaaacttggtatcgagtacagaaacctaggacacgaccccgtagacctcctgtacttacgacgaaggctactacccgaaagtttaccggaaaagttacggggtacccccaacggtaacggttcgacggtgggaagggtcggaggtcgttaggggactaaggtacgtttttaccccnccgtaccacgtcgaacgccgtacggcccttgtaccgaacggtccttaagggaaagtaccgtttcgttacggacctaaacgtaacttagttttaaccttacggactaaacgtaagtttaaactaaaccgttttaaagttaccccttaacccccggtttatttaaaccccggtttttcggtaaaccccgggtaaacggggtaaaccctaaccgggttactaccgggggttaacaaccgtttaacccgtaaaaaccggttacgttaggggttaccgtaccggtcgtaacccgtacccgtaccgtttacggttacgggtttaccctttacccg

SEQ ID NO: 292528 - DNA, 682 bp, Homo sapiens
  misc_feature: GYAE6OF02HSH4V.33.68.G02.1.454.CMB.1.raw
  modified_base (185)..(185): a, c, t, g, unknown or other
  misc_feature (185)..(185): n is a, c, g, or t
  modified_base (196)..(196): a, c, t, g, unknown or other
  misc_feature (196)..(196): n is a, c, g, or t
  modified_base (238)..(238): a, c, t, g, unknown or other
  misc_feature (238)..(238): n is a, c, g, or t
  modified_base (340)..(340): a, c, t, g, unknown or other
  misc_feature (340)..(340): n is a, c, g, or t
  modified_base (420)..(420): a, c, t, g, unknown or other
  misc_feature (420)..(420): n is a, c, g, or t
tcagtacacacactcacgaccggtgctcgatttagtcgatagtgaagggaaagggggagtcagtctcagtcaggacacagcatggacatgagggtccccgctcagctcctgggctcctgctcctctggctccggaggtgccagatgtgacgtccagatcgacccagtctccatcctcctgtcttnatctgtagganacagagtccaacattccacgttggaccgggcaaaggtgaagngctaagttaacgtaaccttatttagtaagtttgtatcgagcaaggtacgaaccggaagggtaaacccacccccaacttcctagtacttccgtcgtccgcccncacgttcctaattaaccaacgtaggtcggtccagttcggtaggttctaggtcgcgtaggtgatgtaggactagtcttacnctactccaccgtaccaccgtacgcgcgtcggacttagtagttacttttcgaacgtttacttagttactttaagaacgttaaaagttccgtagaaccgtagggtaccccggtcccttacttacccgtttaacccggtttcccgggtaaaccggtaaccgggaaacttaacgggttaacgtaaacctaacgggtaaaacctacggttacggtacggtccgtaccgtacaaccggttctttccgttacgttccttaccgtacccg

SEQ ID NO: 292529 - DNA, 631 bp, Homo sapiens
  misc_feature: GYAE6OF02HC9MT.33.68.G02.1.454.CMB.1.raw
  modified_base (219)..(219): a, c, t, g, unknown or other
  misc_feature (219)..(219): n is a, c, g, or t
  modified_base (234)..(234): a, c, t, g, unknown or other
  misc_feature (234)..(234): n is a, c, g, or t
  modified_base (254)..(254): a, c, t, g, unknown or other
  misc_feature (254)..(254): n is a, c, g, or t
  modified_base (624)..(624): a, c, t, g, unknown or other
  misc_feature (624)..(624): n is a, c, g, or t
tcagtacacacactcacgaccggtgctcgatttagtcgatagtgaagggaaagggggagtcagtctcagtcaggacacagcatggacatgaggtccccgctcagctcctggggctcctgctcctctggctccgaggtgccagatgtgacgtccagatgacccagtctccatcctccctgtcttcatctgtaggagacagagtcaccatcacttgccggnaagtgagagcattanacttattgaattgtatcagnagagacagggaacaccccaactcctagactctctgccgctacgtccgtattaccaacgtaagtcggggtacccagttacgaaggttccgaggtcggacgtaggtggtattcggtagggactaagttacttacaccttctaccacactcgacgactacggttactacgaccctaaacgttacggtaaagttacgttttacgtaccttaaccgttttaacttccttaacgtaacctaaactaacttaacgttacctaacttcccgttaacccgttactttacggtttaccgaccggtaaccgggtacctacggacgttacgggatacctaggaccgtaacgtacggttcgtacggtctaccgaccttacgtnttacccg

SEQ ID NO: 292530 - DNA, 779 bp, Homo sapiens
  misc_feature: GYAE6OF02JHXLS.33.68.G02.1.454.CMB.1.raw
  modified_base (203)..(203): a, c, t, g, unknown or other
  misc_feature (203)..(203): n is a, c, g, or t
  modified_base (236)..(236): a, c, t, g, unknown or other
  misc_feature (236)..(236): n is a, c, g, or t
tcagtacacacactcacgaccggtgctcgatttagtcgatagtgaagggaaagggggagtcagtctcagtcaggacacagcatggacatgagggtccccgctcagctcctggggctcctgctactctggctccgaggtgccagatgtgacatccagatcgacccagtcctcccaccctccctgtcctgcctatcgtgtcgganacagtacgtcacctatccgtctcggcccggganaagtccaggacgctacgtccgtccgtattaatttaaagttggtactacgagaccaacggtaaaccgacgggtaccaaccgtaccccttaaacgtcctagtactacttagtacgtcgtacggtcccgtaccgtagttccgtacggtaccggtaaacgggttcccggggtaccctaggtacggttaacggttccgagggtacggacgtacggtggttaacgttcggtacgggaacgtagttacgtttacctaccgtttaccaccgtaaccctagtaccgacgtacgttacgtccgttaccgaacctaacgtaggttaacgtttaacgttttaccgaacctttaaccgtttaccgtcttaacgtaaccctaagttaaaccgttaacgtttacctaacccgtttcccgttaaacccggttaacctttaccgggtttaaccggacccgggtaacgggttaacccaacgggttcgggaacgtaacgttaccggaccggtaacggtaccggtaacggttcggtaacgtccgttaccgaacccggttaccg

SEQ ID NO: 292531 - DNA, 683 bp, Homo sapiens
  misc_feature: GYAE6OF02IC8DX.33.68.G02.1.454.CMB.1.raw
  modified_base (101)..(101): a, c, t, g, unknown or other
  misc_feature (101)..(101): n is a, c, g, or t
  modified_base (172)..(172): a, c, t, g, unknown or other
  misc_feature (172)..(172): n is a, c, g, or t
  modified_base (255)..(255): a, c, t, g, unknown or other
  misc_feature (255)..(255): n is a, c, g, or t
  modified_base (611)..(611): a, c, t, g, unknown or other
  misc_feature (611)..(611): n is a, c, g, or t
  modified_base (626)..(626): a, c, t, g, unknown or other
  misc_feature (626)..(626): n is a, c, g, or t
  modified_base (654)..(654): a, c, t, g, unknown or other
  misc_feature (654)..(654): n is a, c, g, or t
tcagtacacacactcacgaccggtgctcgatttagtcgatagtgaagggaagggggagtcagtctcagtcaggacacagcagtggacatgagggtccccgntcagctcgtgggctccgtgcctctccgtggctccggaggtgccagatcgtgacgcagactgaccctgtccncatcctccgtgtctacatcgtaggagacgacagacggtccaaccgatccgtaccgttaggccgggaactaagtggaagaccgntaaggtttaaccgacgttattaggtaaccgttaggtactacgagtaccgaaggacggaaccgtaacggggaaccaacccccggtaactaccgttacggtaacttacgtccttacggccacgtactacggtacttagacctaacggtacgggtacccaaggttcgaacgttcgaacgtcggacgaggtaacgcgttacggacggtaatacggtaacttccggtaaacgttcctacgaccgttaagacgtacgtacgtaagtaacggactagtaacgtagtttacggattacgtatacgtacgaataccgatttacgtaacgtaccgtaactacgttacgtacgtacgaccggtaaanacgtagagtacgtanaacggtaacgacgtagtacggtacgtancgacgtactacgttacgttaccgtacgtc

SEQ ID NO: 292532 - DNA, 799 bp, Homo sapiens
  misc_feature: GYAE6OF02FK0ZB.33.68.G02.1.454.CMB.1.raw
  modified_base (185)..(185): a, c, t, g, unknown or other
  misc_feature (185)..(185): n is a, c, g, or t
  modified_base (204)..(204): a, c, t, g, unknown or other
  misc_feature (204)..(204): n is a, c, g, or t
tcagtacacacactcacgaccggtgctcgatttagtcgatagtgaagggaaagggggagtcagtctcagtcaggacacagcatggacatgagggtccccgctcagcctcctggggctcctgctcctctggctccgaggtgccagatgtgacgtccaagatcgacccagtcctccactccctcctntcttcacttcgtagagganacagatccaccatccacgttcggccggacaagtgacgagacgtaattacgtaaccttagtttagtaagttggtaactcgacgacaggaacgaaccggaacggggaaaccccaacccccgtaaactcccgtagtacctaccgttccgtacgacccggtacctaacgttaccccgttaattttaaccgaaccgtaacggttaccgggggtacccaagtttaccggtacgggtttacgtacggggtacggtacgtagggtcggtaacggttcgtacgggtacgtaacgttacttaccacctttcgtaccctaacgtaacgaaaccggttcctaaacggttaccggtaacggtaaaccgttaggtaacgttttaaggtttaacggaaacttacgtttaccgttacggtaccgttaactaaacggtagttaaccgttttaaacgtaaacccggtttaacccgttaccttttacggtttaaccggaccgggtaaacggttaacccggaagttcgggtaaggacgtacggtaaccgtaacggtaccgtacgttacggtacgacgtaccgacgttacccgtatttccgttacgttaccttacg

SEQ ID NO: 292533 - DNA, 744 bp, Homo sapiens
  misc_feature: GYAE6OF02J1HHN.33.68.G02.1.454.CMB.1.raw
  modified_base (195)..(195): a, c, t, g, unknown or other
  misc_feature (195)..(195): n is a, c, g, or t
  modified_base (200)..(200): a, c, t, g, unknown or other
  misc_feature (200)..(200): n is a, c, g, or t
  modified_base (230)..(230): a, c, t, g, unknown or other
  misc_feature (230)..(230): n is a, c, g, or t
  modified_base (395)..(395): a, c, t, g, unknown or other
  misc_feature (395)..(395): n is a, c, g, or t
tcagtacacacactcacgaccggtgctcgatttagtcgatagtgaagggaaagggggaggtcagtctcagtcaggacacagcatggacatgagggtccccgctcagctcctgggctcctgctcctctggctccgaggtgccagatgtgacgtccagatgacccagtctccatcctcctgtcttcatctgtagganacagngtcacctatcacgttgccgggacaagtganagcattacgaaccttattagagttgtatcacgacagaacgtacgaacgggaaaccacccccgtaaactccgacgtactcctactacggaccgtaccaaccgttacccgtactttaacccgaaccgtacgttaccgggggtaccctaagtaccggtaaggtttacncgggttacggtaccgtaaggggttacggtaacgttccggtacggggtaaactagttaacgttttaccgaaccttccgtacctaaccgtaacgtaacgtacgtacggtaccgtacggtaaccgtaagttaaggtaacgtttaggaacgttaacttaccgttacgtacgttactaacgtaacgttaacgttaacgttaacggttaacccgtttaacgttaaccggttttacggaacccgggttaacgggaacctaacggtcgtacggtacggttataaccggtaaccgagttaacggtcggttacggtacgttcccgaacgttacctaacgtccgttacgtaccgtttacc

SEQ ID NO: 292534 - DNA, 684 bp, Homo sapiens
  misc_feature: GYAE6OF02GFES7.33.68.G02.1.454.CMB.1.raw
  modified_base (149)..(149): a, c, t, g, unknown or other
  misc_feature (149)..(149): n is a, c, g, or t
  modified_base (186)..(186): a, c, t, g, unknown or other
  misc_feature (186)..(186): n is a, c, g, or t
  modified_base (200)..(200): a, c, t, g, unknown or other
  misc_feature (200)..(200): n is a, c, g, or t
  modified_base (228)..(228): a, c, t, g, unknown or other
  misc_feature (228)..(228): n is a, c, g, or t
  modified_base (239)..(239): a, c, t, g, unknown or other
  misc_feature (239)..(239): n is a, c, g, or t
  modified_base (277)..(277): a, c, t, g, unknown or other
  misc_feature (277)..(277): n is a, c, g, or t
tcagtacacacactcacgaccggtgctcgatttagtcgatagtgaaggggaaagggggagtcagtctcagtcaggacacagcatggacatgagggtccccgctcagctcctcggggctcctgctactctggctccgaggtgccagatgngacatccagatcgacccagtcctccaccctcctgtcngcatctggtcgganacagctcacctatctcttcggccggganaaggtcaaggngcatccgtccgctaatttaattggtatcagcagaaacnggacaacgaccctaaactacctgtaactatactgctggctccagtctgactaaaggtcggggtaccagtacgtaaacggttctacggtacgagtaggtacggtaacgttcggtacggggaactaggttaacttttaccaccggttactaccgtaactaaactccgtaagaccgtagtacggtcggtacgccttaaggtaacgttatttacgaccttaagggttacgttaacgtttacgtacgttacacggtacggtaacgtttaacggttaactttaccgtacgtcccgtttacccggtacggtttcccgggaacggtaaccgggtaacccggtaaaggggttacgtaaaacgttaaccgaaagtaaccggtggttaaccgtcggtaccgtaccacccgtttaacgg

SEQ ID NO: 292535 - DNA, 739 bp, Homo sapiens
  misc_feature: GYAE6OF02GJX6T.33.68.G02.1.454.CMB.1.raw
  modified_base (224)..(224): a, c, t, g, unknown or other
  misc_feature (224)..(224): n is a, c, g, or t
tcagtacacacactcacgaccggtgctcgatttagtcgatagtgaagggaaagggggagtcagtctcagtcaggacacagcatggacatgagggtccccgctcagctcctggggctcctgctcctctggctccgaggtgccagatgtgacgtccagatcgacccagtctccatcctccctgtcttacatctgtaggagacagagtcaccatcacttcgccgganaagtgagagactagttaacgaaccttagtttacgaagtttggtactacgacgactaaggaacgaaccggaaacggggaaacccgacccccctaaaactcccgtacggtacttccgtacgtccggacccgtacctaacgtaccttaacgtttaaccaacgtaacggttccggggtaccctagtacggtagttaccgaggtacgggcgtaggtggaacgttcggtagggtaactacgttactttcccacttaccgtacctactaacgttcgacgtacgtacgtcgttacgaccgtaaccgttagtaagtttacgtttacgtaacttaaccgtttaccgttacgtaccttaacgaaccttaagttaaccttacgtaaccgtttacccgttaacccgttacgttacggtttaccggaacccgggtaacgggaccgttaacgtcgggttaacggaacgtaccggtacggaaccggtacgttaagttcggtcgtacgtaccgtacctaccgttattaccgg

SEQ ID NO: 292536 - DNA, 224 bp, Homo sapiens
  misc_feature: GYAE6OF01DERVY.13.13.B02.1.454.CMB.1.raw
  modified_base (221)..(224): a, c, t, g, unknown or other
  misc_feature (221)..(224): n is a, c, g, or t
tcagtcacgtactacacgaccggtgctcgatttagtctagcgactttgactcctggggccagggaaccctggtcaccgtctcctcagcttccaccaagggcccatcggtcttcccctggcgccctgctccaggagcacctctgggggcacagcggccctgggctgcctggtcaaggactacttcctagtacgtgactgagcgggctggcaaggcgcatagnnnn

SEQ ID NO: 292537 - DNA, 226 bp, Homo sapiens
  misc_feature: GYAE6OF01A48AU.13.13.B02.1.454.CMB.1.raw
  modified_base (221)..(226): a, c, t, g, unknown or other
  misc_feature (221)..(226): n is a, c, g, or t
tcagtcacgtactacacgaccggtgctcgatttagtctagcgactttgactcctggggccagggaaccctggtcaccgtctcctcagcttccaccaagggcccatcggtcttcccctggcgccctgctccaggagcacctctgggggcacagcggccctgggctgcctggtcaaggactacttcctagtacgtgactgagcgggctggcaaggcgcatagnnnnnn

SEQ ID NO: 292538 - DNA, 224 bp, Homo sapiens; identical to SEQ ID NO: 292536
  misc_feature: GYAE6OF01B4BIC.13.13.B02.1.454.CMB.1.raw
  modified_base (221)..(224): a, c, t, g, unknown or other
  misc_feature (221)..(224): n is a, c, g, or t

SEQ ID NO: 292539 - DNA, 232 bp, Homo sapiens
  misc_feature: GYAE6OF01EMMUH.13.13.B02.1.454.CMB.1.raw
  modified_base (222)..(232): a, c, t, g, unknown or other
  misc_feature (222)..(232): n is a, c, g, or t
tcagtcacgtactacacgaccggtgctcgatttagtctagcgactttgactcctggggccagggaaccctggtcaccgtctcctcagcttccaccaagggcccatcggtcttcccctggcgccctgctccaggagcacctctgggggcacagcggccctgggctgcctggtcaaggactacttcctagtacgtgactgagcgggctggcaaggcgcagtagnnnnnnnnnnn

SEQ ID NO: 292540 - DNA, 221 bp, Homo sapiens
  misc_feature: GYAE6OF02H1794.13.13.B02.1.454.CMB.1.raw
  modified_base (220)..(221): a, c, t, g, unknown or other
  misc_feature (220)..(221): n is a, c, g, or t
tcagtcacgtactacacgaccggtgctcgatttagtctagcgactttgactcctggggccagggaaccctggtcaccgtctcctcagcttccaccaagggcccatcggtcttcccctggcgccctgctccaggagcacctctggggcacagcggccctgggctgcctggtcaaggactacttcctagtacgtgactgagcgggctggcaaggcgcatagnn

SEQ ID NO: 292541 - DNA, 226 bp, Homo sapiens; identical to SEQ ID NO: 292537
  misc_feature: GYAE6OF02GW1MD.13.13.B02.1.454.CMB.1.raw
  modified_base (221)..(226): a, c, t, g, unknown or other
  misc_feature (221)..(226): n is a, c, g, or t

SEQ ID NO: 292542 - DNA, 536 bp, Homo sapiens
  misc_feature: GYAE6OF01CO33S.48.26.C04.1.454.CMB.1.raw
  modified_base (208)..(208): a, c, t, g, unknown or other
  misc_feature (208)..(208): n is a, c, g, or t
  modified_base (245)..(245): a, c, t, g, unknown or other
  misc_feature (245)..(245): n is a, c, g, or t
  modified_base (250)..(250): a, c, t, g, unknown or other
  misc_feature (250)..(250): n is a, c, g, or t
tcagagtatacatacacgaccggtgctcgatttagtctagcgactttgggtttggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccntctcctgcactggaaccagcagtgacgttggtgttanaactntgtctcctggtaccaacagcacccaggcaaacgcccccaaagtcatgatttatgaggtcagtaacgcggccctcgacggggtccctgactcgcttctctggctccgaagtctggcaacgacggccctcctgaccgtctcgtgggcctccgaggctgaggatgaggctagtattagttactgcagctacatatgcaggcagacaaactatgtagttagttcgggcggaagggaccaagcgtagacccgtctaggtcaacggcccaaggcctccgccccgtggtaccc

SEQ ID NO: 292543 - DNA, 541 bp, Homo sapiens
  misc_feature: GYAE6OF01DQ44Z.48.26.C04.1.454.CMB.1.raw
tcagagtatacatacacgaccggtgctcgatttagtctagcgactttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcaccaggcaaacgcccccaaagtcatgatttatgagtcagtaagcggcctcgagggtccctgactcgcttctctgctcaagtctggcaacacggccctccctgacccgtctcgtgggcctccgaggctggaggatggaggctgatttattattgctgctcatatgcgtaggtgtacttacgttgggttcgttcggctaggacgggaccaaggtctaggacccgttccgtaggtcacggacccaaggcctccgcccccgtggtaccc

SEQ ID NO: 292544 - DNA, 542 bp, Homo sapiens
  misc_feature: GYAE6OF01EG59H.48.26.C04.1.454.CMB.1.raw
  modified_base (326)..(326): a, c, t, g, unknown or other
  misc_feature (326)..(326): n is a, c, g, or t
  modified_base (365)..(365): a, c, t, g, unknown or other
  misc_feature (365)..(365): n is a, c, g, or t
  modified_base (416)..(416): a, c, t, g, unknown or other
  misc_feature (416)..(416): n is a, c, g, or t
  modified_base (425)..(425): a, c, t, g, unknown or other
  misc_feature (425)..(425): n is a, c, g, or t
  modified_base (455)..(455): a, c, t, g, unknown or other
  misc_feature (455)..(455): n is a, c, g, or t
tcagagtatacatacacgaccggtgctcgatttagtctagcgactttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtgttataactatgtctcctggtaccaacagcacccaggcaaacgcccccaaagtcatgtatttatgaggtcagtaagccggccctnaggtctttctaatcgcttctctggctcaagtctgcaacncgcctcctgacatctctgggctcaggctgacggcgaggctgattattattnctgctcatngcagggtcgtacttacgttgggtgttcggngaggagggaccaagctacggaccgttccgtaggtccacggaccccgaagggtcctaccggtccccccgttcggtcctaccgttcccg

SEQ ID NO: 292545 - DNA, 593 bp, Homo sapiens
  misc_feature: GYAE6OF01B0T2K.48.26.C04.1.454.CMB.1.raw
  modified_base (303)..(303): a, c, t, g, unknown or other
  misc_feature (303)..(303): n is a, c, g, or t
  modified_base (324)..(324): a, c, t, g, unknown or other
  misc_feature (324)..(324): n is a, c, g, or t
tcagagtatacatacacgaccggtgctcgatttagtctagcgactttgggtttggggggtcgtcaggaggcagcgctctcaggacgtcaccaccatggcctgggctctgctcctcctcaccctcctcactcaggcacagggtcctgggcccagtctgccctgactcagcctccctcgcgtccgggtctcctggacagtcagtcaccatctcctgcactggaaccagcagtgacgttggtgttataactatgtctcctggtaccaacagcacccaggcaaacgcccccaaagtcatcgatttangaggtcagtaacgcggccctnagggtccctgatcgcttctctggcctacaagtctaggactaacgaccggccctaccctcgacccgttctcgtcgggaccttccgaaggtccttggacggagtggaacggctgaatttattactggtcagtcctactatatgacaggccagacaaacgtaattgtagttacgttcggacggacgggaaccaaggtccttacggacccggttccggtacggtacccgaacggtccccgaacggtccgtacccgtcccccgttcgggtaccc

SEQ ID NO: 292546 - DNA, 535 bp, Homo sapiens
  misc_feature: GYAE6OF01AZ7RX.48.26.C04.1.454.CMB.1.raw
  modified_base (308)..(308): a, c, t, g, unknown or other
  misc_feature (308)..(308): n is a, c, g, or t
  modified_base (362)..(362): a, c, t, g, unknown or other
  misc_feature (362)..(362): n is a, c, g, or t
  modified_base (367)..(367): a, c, t, g, unknown or other
  misc_feature (367)..(367): n is a, c, g, or t
  modified_base (381)..(381): a, c, t, g, unknown or other
  misc_feature (381)..(381): n is a, c, g, or t
  modified_base (385)..(385): a, c, t, g, unknown or other
  misc_feature (385)..(385): n is a, c, g, or t
  modified_base (393)..(393): a, c, t, g, unknown or other
  misc_feature (393)..(393): n is a, c, g, or t
tcagagtatacatacacgaccggtgctcgatttagtctagcgactttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtgttataactatgtctcctggtaccaacagcaccaggacaaacgcccccaaagtcatgatttangaggtcagtaacgccggccctcgaggggtccctgatcgcttctctgctcagtcngcacncgcctcctgccgtntcgnggctccgngctgagatggaggtctgtatttatactgcacgtctacatagtcgcgaggcagacaaacgtatcggtggtacgtccgggacggacgggactaaggctcggacccgtcgtacgtacgacgacccgaacgtcctccggtcccccg

SEQ ID NO: 292547 - DNA, 642 bp, Homo sapiens
  misc_feature: GYAE6OF01B8YMF.48.26.C04.1.454.CMB.1.raw
  modified_base (270)..(270): a, c, t, g, unknown or other
  misc_feature (270)..(270): n is a, c, g, or t
  modified_base (306)..(306): a, c, t, g, unknown or other
  misc_feature (306)..(306): n is a, c, g, or t
  modified_base (462)..(462): a, c, t, g, unknown or other
  misc_feature (462)..(462): n is a, c, g, or t
tcagagtatacatacacgaccggtgctcgatttagtctagcgacttttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtgttataactatgtctcctggtaccaanagcaccgaggacaaacgccccaaagtcatgatttangagtcagtagcgcctgacgggtcctgatcgcttctcgtgcctaccgaagtctggaccaaaccgccggtcccttcccgtacgacccgttctcgtcgggcctccgaggctaggaggtatggaacgtcttagtaatttacttaccgtgaccagtcctanaattagtggaccgaagggcaaacggacctaaaacgtaggtttcgggtacggttaaccggttcggggaaccgggtaaacggggaacccaaagggtccgttaaccggaccccggttcgttaacgggtacccaaccggtaccccgaacgggtccccttacccggccccccggttgggtacccc

SEQ ID NO: 292548 - DNA, 506 bp, Homo sapiens
  misc_feature: GYAE6OF01EXNTJ.48.26.C04.1.454.CMB.1.raw
  modified_base (305)..(305): a, c, t, g, unknown or other
  misc_feature (305)..(305): n is a, c, g, or t
  modified_base (324)..(324): a, c, t, g, unknown or other
  misc_feature (324)..(324): n is a, c, g, or t
tcagagtatacatacacgaccggtgctcgatttagtctagcgactttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccaggcaaagcccccaaactcatgatttangatgtcagtaatcggcctnagggtttctaatcgcttctctggctccaagtctggcaacacggcctccctgaccatctctgggctccaggctgaggacgaggctgattatactgcacctcatatacaagcagcagcactctcgtgtattcggcggaggaccaagcgtgaccgtctaggtcagcccaaggctgcccctgctac

SEQ ID NO: 292549 - DNA, 514 bp, Homo sapiens
  misc_feature: GYAE6OF01B7JF0.48.26.C04.1.454.CMB.1.raw
tcagagtatacatacacgaccggtgctcgatttagtctagcgactttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctcgtgggctccgaggcctgaggatggaggctgattattactgcagctcatatgcaggcagcaacatgtggtattcgggcggaggaccagctgacccgtctaggtcagcccgaggcctcgcccccgtggtcc

SEQ ID NO: 292550 - DNA, 542 bp, Homo sapiens
  misc_feature: GYAE6OF01CD5OO.48.26.C04.1.454.CMB.1.raw
  modified_base (305)..(305): a, c, t, g, unknown or other
  misc_feature (305)..(305): n is a, c, g, or t
  modified_base (454)..(454): a, c, t, g, unknown or other
  misc_feature (454)..(454): n is a, c, g, or t
tcagagtatacatacacgaccggtgctcgatttagtctagcgactttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaaccaacagcaccaggcaaacgccccaaagtcatgatttangagtcagtaagcggcctcgagggtccctgatcgcttctctcggctccaagtctggacaacaccgcctcctgacctctcgtcgggctccgaggctgaggatggaggctagtatttattacgtgcagctacgatagtgcaggcagtacaanaagttgtagtagttcggacggacgggaccaaggtcgtagacccgttcgtaggtccacgacccgaaggcctaccgcccccgtggtaccc

SEQ ID NO: 292551 - DNA, 695 bp, Homo sapiens
  misc_feature: GYAE6OF01DPUYQ.48.26.C04.1.454.CMB.1.raw
  modified_base (253)..(253): a, c, t, g, unknown or other
  misc_feature (253)..(253): n is a, c, g, or t
tcagagtatacatacacgaccggtgctcgatttagtctagcgactttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactntgtctcctggtaccaacagcacccaggcaaacgcccccaaagtcatgatttatgaggtcagtaagcggcctcgacggggtccctgactcgtcttctcgtcggtcctaccgaagtctggaccaacgaccggtccctcccgtcgacccgttctcgtcgggtcctaccgacggcgtaggaggtagtggacggtcttagtactttacgttacgtcgtacctacgtccttacgtaacttagtcggaccgaacgggaccgtaacggtaacctaaacgttaagtttagggttacgggtttaaccggtttaccggggaccggggtaaacggggtaacccgaaacgggttcccgttaaccggtaccccggttaccggtaaccgggtacccgaacccggtaccccggaaacgggtcccctttaccccgggccccccgttacgggttaccccg

SEQ ID NO: 292552 - DNA, 679 bp, Homo sapiens
  misc_feature: GYAE6OF01EA2JB.48.26.C04.1.454.CMB.1.raw
tcagagtatacatacacgaccggtgctcgatttagtctagcgactttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtgttaataactatgtctcctggtaccaacagcacccaggaccaaaacgcccccaaagtcatgtatttatgagtcagtaagccggccgtcggggtcctgatcgtcttctcgtgcctcgaagtctggacaacgaccggtcctccctgacctatcctcgtcgggcctaccgtacggctagaacgtattacgaggtctagtatttacgttactcgtaccgtttcgtttacgtttactttttacgtaacgttttttccctttttttaggttaccgtttaccgggtaaccgtttcggggtaacccggttaaggttcccgtacccggtttaccgtaaggtccctaaccggaccccgtaaccgggtaccccctaaacccgtccgtacgttaccctacccttcgtttcccgttacccccgtacccctttccgttccttacgttaacg

SEQ ID NO: 292553 - DNA, 821 bp, Homo sapiens
  misc_feature: GYAE6OF01DHNPR.48.26.C04.1.454.CMB.1.raw
  modified_base (311)..(311): a, c, t, g, unknown or other
  misc_feature (311)..(311): n is a, c, g, or t
tcagagtatacatacacgaccggtgctcgatttagtctagcgactttgggtttgggggctggggtctcaggaggcagcgctctcaggacgtcaccaccatggcctgggctctgctcctcctcaccctcctcactcagggcacagggtcctgggcccagtctgccctgactcagccctccctccgcgtccggtctccgtggacagtcagtcaccatctctgcactgaacagcagtgacgttggtgttataactatgtctccgtaggtaaccaacagccaccgaggacaaacgaccccaaagtcatgatttangagtacagtaacgccgcctacgacgggtcctgactcgtactttccgtcgtggtcctaccgtaaggtcgtacggaacctaaccgacccggtcccctaccgtaccggacccgtttccttccggtcggggtcccttaccggaacgggtccttaagggaacggtacgttacgggaaacgggttccgttaagggttaaactttttaaaccgtttaccggttacgggtaacccgttaacggtaccctttaaccggtaagtttaaccggttaccggaacccggttaacgggggtaacctaaacgggaaccccttaaaaacgttaaggttacggggtttaacggggttaaccgggtttacccgggggaacccggggaaaacggggtaaacccccggttaaagggtccccggttaaccggggtaacccccgggtttaaccggttaaacccggggaccgtaaaccccgggtaacccccgggtaaaccgggttccccggttccccccggtacccccccggg

SEQ ID NO: 292554 - DNA, 682 bp, Homo sapiens
  misc_feature: GYAE6OF01BEPB2.48.26.C04.1.454.CMB.1.raw
tcagagtatacatacacgaccggtgctcgatttagtctagcgactttgggtttggggggggtctcaggaggcagcgctctcaggacgtcaccaccatggcctggctctgctcctcctcaccctcctcactcagggcacagggtcctgggcccagtctgccctgactcagcctccctccgcgtccgggtctcctggacagtcagtcaccatctcctgcactggaaccagcagtgacgttggtgttataactatgtctcctggtaccaacagccacccaggaccaaacgacccccaaagtccatgtatttagtgtaggtcaggtaacgccggccctcgacggggtccctagtactcgtcttcctcgtcggtcctaccgaagttccgtacggacctaaaccgaccggtcccctcccgtacggtacccgttccgtccggtcgggtcctccgtaggtccgttaggaacgggtacgttacgggaacgggtcgttaggtaacttttagtttaccgtacggtacctacggtccttactaacgttacgtcggaccgtaacggaccgtacgaacctaaacgtagttcggtacggttacgttccggggacgggacggaaccgtaacggtcgtaccgtacccggtcgtacggtaccacgtacccgacggcccgtcccggccccgtcggtacccc

SEQ ID NO: 292555 - DNA, 676 bp, Homo sapiens
  misc_feature: GYAE6OF01A3PWZ.48.26.C04.1.454.CMB.1.raw
  modified_base (228)..(228): a, c, t, g, unknown or other
  misc_feature (228)..(228): n is a, c, g, or t
  modified_base (252)..(252): a, c, t, g, unknown or other
  misc_feature (252)..(252): n is a, c, g, or t
  modified_base (308)..(308): a, c, t, g, unknown or other
  misc_feature (308)..(308): n is a, c, g, or t
  modified_base (366)..(366): a, c, t, g, unknown or other
  misc_feature (366)..(366): n is a, c, g, or t
tcagagtatacatacacgaccggtgctcgatttagtctagcgactttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgacgttggtgttataactntgtctcctggtaccaacacgcaccaggacaaacgacccccaaagtcatgtatttangaggtcagtagccggccctgacgggtccctgactcgtcttctcgtcggctaccagtcnggaccaacgccggccctccgtcgaccgtctcgtcggcctccgagtctaggaggatcggaggctagtatttacttacgtgacgtagtctacattacgtgacgtagggactaacgaccgtaaacgtacggttcgggtaacgggttaccgggttaccggggtaacggggaaaccggggtaacccgtaaagggtcccggttaccgggtaaccccgggtttacccggttaacgggtaacccgaacccgggtaacccccggtaacggggtcccccgttaacccccgggtcccccccggttaccgggttaacccccg

SEQ ID NO: 292556 - DNA, 586 bp, Homo sapiens
  misc_feature: GYAE6OF01AS8P7.48.26.C04.1.454.CMB.1.raw
  modified_base (307)..(307): a, c, t, g, unknown or other
  misc_feature (307)..(307): n is a, c, g, or t
  modified_base (365)..(365): a, c, t, g, unknown or other
  misc_feature (365)..(365): n is a, c, g, or t
  modified_base (441)..(441): a, c, t, g, unknown or other
  misc_feature (441)..(441): n is a, c, g, or t
tcagagtatacatacacgaccggtgctcgatttagtctagcgacttttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtgttataactatgtcctcctggtaccaacagcacccaggcaaacgcccccaaagtcatgatttangagtcagtaagcggccctgacgggtccctgatcgcttctctggctcaagtctgcaacncggtcctcctgaccgtctcgtgggcctccgaggcctggaggtatggacgctgatttagttactgcagctcattagngcgaggacaaggaccaaagtagttgggtacgttaacgttccgggacgggaacgggaacccaaggtccgttaggacccggttaccgtacgggtacccgaccggtaccccgtaaggtccccttccggtccccccgttcgggtacccc

SEQ ID NO: 292557 - DNA, 635 bp, Homo sapiens
  misc_feature: GYAE6OF01CD4ZL.48.26.C04.1.454.CMB.1.raw
tcagagtatacatacacgaccggtgctcgatttagtctagcgactttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtgttataactatgtctctggtaccaacagcaccaggacaaacgcccccaaagtcatgatttatgagtcagtaagcggccctcgaggggtccctgagtcgtcttctcgtggcctccaagtctggacaacgaccggcctcccgtcgacccgttctcgtcgggcctccgaggtccgtggaggatggacggctggtatttaagttactggcacgtcctacattaagcggtacgaagggcaacggacctaaaacgtaagttgggttagggttacgttaccgggggacgggtaacggggaacccgtaacggtccgtaccgggtacccggttacccgttaacgggtaccaaccggtaccccgaaacgggtcccgtacccgtccccccggttcggttaccccg

SEQ ID NO: 292558 - DNA, 552 bp, Homo sapiens
  misc_feature: GYAE6OF01CUY01.48.26.C04.1.454.CMB.1.raw
  modified_base (251)..(251): a, c, t, g, unknown or other
  misc_feature (251)..(251): n is a, c, g, or t
  modified_base (307)..(307): a, c, t, g, unknown or other
  misc_feature (307)..(307): n is a, c, g, or t
tcagagtatacatacacgaccggtgctcgatttagtctagcgacttttgggtttggggggggtctcaggaggcagcgctctcaggacgtcaccaccatggcctggctctgctcctcctcaccctcctcactcagggcacagggtcctgggcccagtctgccctgactcagcctcctccgcgtccgggtctcctggacagtcagtcaccatctcctgcactggaaccagcagtgacgttggtgttataactntgtctcctgtaaccaacagccacccaggacaaacgcccccaaaagtcatgatttangaggtcagtaagccggccctcgacggggtccctgactcgtcttctctggcctaccgaagtctcggacaaccgaccggtccctcccgtcgacccgttctcgtcgggctccgagctggagagtggagtctagtactttatactgcagtcctgatatgcgagcaagcaactagtgtagtagttcgggacggacggacagctagacccgtcgtacggtcaccgtaccacgcctccgccccgtggtaccc

SEQ ID NO: 292559 - DNA, 521 bp, Homo sapiens
  misc_feature: GYAE6OF01DRYTH.48.26.C04.1.454.CMB.1.raw
  modified_base (247)..(247): a, c, t, g, unknown or other
  misc_feature (247)..(247): n is a, c, g, or t
  modified_base (367)..(367): a, c, t, g, unknown or other
  misc_feature (367)..(367): n is a, c, g, or t
  modified_base (431)..(431): a, c, t, g, unknown or other
  misc_feature (431)..(431): n is a, c, g, or t
tcagagtatacatacacgaccggtgctcgatttagtctagcgactttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtgttanaactatgtctcctggtaccaacagcacccaggcaaacgcccccaaagtcatgatttatgaggtcagtaagcggccctcgacgggtccctgatcgcttctctggctccaagtctggcaacncggccctccctgaccgtctcgtgggcctccgaggctgaggatgaggtctgatttattactgacngctcatatgcaggcagcaacatggtgtagtcggcggaggacaagctgaccgtctagtccacgcccgaacggcctccgcccccgtggtacc

SEQ ID NO: 292560 - DNA, 653 bp, Homo sapiens
  misc_feature: GYAE6OF01DL2JB.48.26.C04.1.454.CMB.1.raw
  modified_base (312)..(312): a, c, t, g, unknown or other
  misc_feature (312)..(312): n is a, c, g, or t
tcagagtatacatacacgaccggtgctcgatttagtctagcgactttgggtttgggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtgttataactatgtctcctggtaaccaacagccacccaggacaaacgacccccaaagtcatgtatttanggagtcagtaacgccggccctcgacgggtccctgactcgtcttctcgtggcctaccgtaagtcgtaggaccaaccgaccggcccttcccgtcgacccgtcgtcgtcgggtcctccgaggtctaggagtagtggagtctagtatttacttacgtgctacgtctacaattagtcgacgtacgggacctacggtaaccaaagttaagttgggttagggttacgttaccggggacgggaaccgggtaaccaacgggtccgtaccgggtaaccccggttccgttaacgggtccaaccgggtccccgaaacggtccccgttacccggtcccccgttcgggttacccc

SEQ ID NO: 292561 - DNA, 541 bp, Homo sapiens
  misc_feature: GYAE6OF01B5OLF.48.26.C04.1.454.CMB.1.raw
  modified_base (231)..(231): a, c, t, g, unknown or other
  misc_feature (231)..(231): n is a, c, g, or t
  modified_base (255)..(255): a, c, t, g, unknown or other
  misc_feature (255)..(255): n is a, c, g, or t
  modified_base (301)..(301): a, c, t, g, unknown or other
  misc_feature (301)..(301): n is a, c, g, or t
  modified_base (308)..(308): a, c, t, g, unknown or other
  misc_feature (308)..(308): n is a, c, g, or t
  modified_base (336)..(336): a, c, t, g, unknown or other
  misc_feature (336)..(336): n is a, c, g, or t
  modified_base (394)..(394): a, c, t, g, unknown or other
  misc_feature (394)..(394): n is a, c, g, or t
  modified_base (436)..(436): a, c, t, g, unknown or other
  misc_feature (436)..(436): n is a, c, g, or t
  modified_base (439)..(439): a, c, t, g, unknown or other
  misc_feature (439)..(439): n is a, c, g, or t
  modified_base (442)..(442): a, c, t, g, unknown or other
  misc_feature (442)..(442): n is a, c, g, or t
  modified_base (454)..(454): a, c, t, g, unknown or other
  misc_feature (454)..(454): n is a, c, g, or t
tcagagtatacatacacgaccggtgctcgatttagtctagcgactttgggtttggggggggtctcaggaggcagcgctcctcaggacgtcaccaccatggcctgggctctgctcctcctcaccctcctcactcaggcacagggtcctgggcccagtctgcccttgactcagtcctccctccgcgtccgggtctcctggacagtcagtcaccatctccgtgcactggaaccngcagtgacgttggtgttataactntgtctcctggtaccacagccaccaggcaaacgcccccaaagtcatntatttangagtcagtacgccggcctgacgggtccngacgtcgcttctctggcctccaagtcctaggcaacgacgccctccgtgaccgtctcgnggacctccgagtctgagatggagctgattatactgcagtctnatncgnacgcagaccaanagtgtacgtacgtcggacggtacggaaccgagtcctaggaccgttcgacgttcaccggaccgtaggcctcccgtccccgtggtaccc

SEQ ID NO: 292562 - DNA, 572 bp, Homo sapiens
  misc_feature: GYAE6OF01DDKKG.48.26.C04.1.454.CMB.1.raw
  modified_base (351)..(351): a, c, t, g, unknown or other
  misc_feature (351)..(351): n is a, c, g, or t
tcagagtatacatacacgaccggtgctcgatttagtctagcgactttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttaataactatgtctcctggtaccaacagccacccaggcaaacgcccccaaagtcatgtatttatgaggtacagtaagcggcctcgacggggtccctgatcgcttcnctcggctccaagtcgtggacaacgacggccctcccgtgacccgtctcgtgggcctccgaggctgaggagtgaggtctagtatttattactgactacgcttacatatgcgagacgagtaccaaacagttgtaggtacgttccgggacgggacgggacgagccgtagtacccggtcgtaacgggcacggtcccgaaggtccctcccggccccgtcggtacccg

SEQ ID NO: 292563 - DNA, 708 bp, Homo sapiens
  misc_feature: GYAE6OF01BHCDF.48.26.C04.1.454.CMB.1.raw
  modified_base (306)..(306): a, c, t, g, unknown or other
  misc_feature (306)..(306): n is a, c, g, or t
tcagagtatacatacacgaccggtgctcgatttagtctagcgactttgggtttggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatcctcctgcactggaaccagcagtgacgttggtgttataactatgtctcctggtaccaacagcaccaggacaaacgaccccaaagtcatgtatttangacggtcagtaagccggtccctacgacggggttccctggacttccgtcttcctcgtcggccgtaccaacggtcctaggaccaacgacccggtcccttacccgtagaacctaacgtccttacggtcggggccttacccgagggtccgttaggaacgggacggtacggtcttacgttaatttaacttacgtggtaccttgccttactaattacgtgaccgtaagtaacgttaacgggttacgacctaccgtagtacgtttacggttcgggttaacggttccggggaaccggggtaaacgggtaacccgtaacgggtccggttaccggtaccccggttaccggttaacgggtacccgtaaccggaaccccggtaacgggttcccgttccccgggtacccccccgg

SEQ ID NO: 292564 - DNA, 692 bp, Homo sapiens
  misc_feature: GYAE6OF01CUXFU.48.26.C04.1.454.CMB.1.raw
  modified_base (267)..(267): a, c, t, g, unknown or other
  misc_feature (267)..(267): n is a, c, g, or t
  modified_base (338)..(338): a, c, t, g, unknown or other
  misc_feature (338)..(338): n is a, c, g, or t
tcagagtatacatacacgaccggtgctcgatttagtctagcgactttgggtttggggggggtctcaggaggcagcgctctcaggacgtcaccaccatggcctgggctctgctcctcctcaccctcctcactcagggcacagggtcctgggcccagtctgccctgactcagccctccctccgcgtccgggtctccgtggaccagtcacgtcaccatccgtcctgcacgtcggaacccagcaggtgtacggtttgggtagttataactnttgtcctcgtcggtaaccacacgccaccgacggacaaaccgacccccaagtcagtgtatttagtgtaggtntaaggacgccggaccgtcgacggggtccctagactcgtccttcgtcctcggtcctacgtaacgttcgtacggaaccaaccggtccgcccttccgtcgtacccgtctccggtacggccctaccgacggtccgtaggaggtacgtggtacggtctagttaactttacgtactcggactacgtctactataacgtcgtaaccgaggtaccgagtaacctaacgtagttcggttaggttacgttaccgggggaacggaccgggaaaccgtacgggtaccgtacggttaacccggtcgttacggacccgtaccgtacccggtaacgggtcccgtaccccgtccccggttcgtacccccg

SEQ ID NO: 292565 - DNA, 704 bp, Homo sapiens
  misc_feature: GYAE6OF01BS9RC.48.26.C04.1.454.CMB.1.raw
  modified_base (263)..(263): a, c, t, g, unknown or other
  misc_feature (263)..(263): n is a, c, g, or t
  modified_base (284)..(284): a, c, t, g, unknown or other
  misc_feature (284)..(284): n is a, c, g, or t
  modified_base (327)..(327): a, c, t, g, unknown or other
  misc_feature (327)..(327): n is a, c, g, or t
  modified_base (360)..(360): a, c, t, g, unknown or other
  misc_feature (360)..(360): n is a, c, g, or t
tcagagtatacatacacgaccggtgctcgatttagtctagcgactttgggtttggggggggtctcaggaggcagcgctctcaggacgtcaccaccatggcctggctctgctcctcctcaccctcctcactcagggcacagggtcctgggcccagtctcgccctgactcagcctccctccgcgtccgggtctccgtggacagtcagtccaccatcctcctgccacgtaggaacccagcaggtgacgtttggtagttactaactntcgtctccgtggtaaccaacncgcacccgaggaccaaacgccccaaagtcaagtgtactttagngagtcaggtacgccgtccgtacgacgggttccngtacgtcgtaccttcgtcgtcggctaccgtaaggtctacggaccaacgccggtcccttccgacactacttccgtacgtccgggtcctccgaggtcgtacggacgggtattacgggacgttcgtaagttaatttacgttacgtcgtctacggtccttagtaattacgtacggacgtaacgggtctaacgttaccttaacggtttacgggtttacgggtaaccggttaccggggaacgggtacggtaacctaacgggtccgttaaccgggtacccgttacgggtaacggtaccgaccggtaacccggtacggtacccgtccccgggttaccccgttcgggtaaccc

SEQ ID NO: 292566 - DNA, 645 bp, Homo sapiens
  misc_feature: GYAE6OF01C2OPP.48.26.C04.1.454.CMB.1.raw
  modified_base (424)..(424): a, c, t, g, unknown or other
  misc_feature (424)..(424): n is a, c, g, or t
tcagagtatacatacacgaccggtgctcgatttagtctagcgactttgggtttgggggctggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtgttataactatgtctcctggtaccaacagcacccaggacaaacgcccccaaagtcatgattatgagtacagtaagccgccctcgacgggtccctgatcgcttctcgtcggctccgtaagtctacggcaacgccggcctcccgtacgacccgtctcgtcggcctccgaggctggacggngtaggacggtctagtactttaagttacgtcgtacgactcttactatacgtggaccgagggtaccagaacctaaacgtagttacggtaggtttaacggttccggggtaacggggtaaacgggaacccgtaagggacccgttacggtaacccccggttacgtaacgggttacccgaacggtaccccggaaacccggggtccgtacccccggttaccccccggg

SEQ ID NO: 292567 - DNA, 811 bp, Homo sapiens
  misc_feature: GYAE6OF01CX8ZL.48.26.C04.1.454.CMB.1.raw
  modified_base (236)..(236): a, c, t, g, unknown or other
  misc_feature (236)..(236): n is a, c, g, or t
  modified_base (286)..(286): a, c, t, g, unknown or other
  misc_feature (286)..(286): n is a, c, g, or t
  modified_base (611)..(611): a, c, t, g, unknown or other
  misc_feature (611)..(611): n is a, c, g, or t
tcagagtatacatacacgaccggtgctcgatttagtctagcgactttgggtttggggtggggtctcaggaggcagcgctctcaggacgtcaccaccatggcctgggctctgctcctcctcaccctcctcactcgaggcacgagggtcctggcccagtctcgccctgactcacgccctccctccgcgtccgggtctccgtggacagtcacgtcaccatcctcctgcacgtggaaccngctagtgtacgttggtagttaactaatgttgttcctacctggtaaccaanacgaccaacccgaacggacaaaaccgaccccctaaaagtcctaattacgtattttaacgtaggacgtacgtaggtaacgtcccggtacctacgggtaccgggttcctggtacgttccgttcgttccgtaccggttcggacccttaccgtaaagttccggttagaaccgtaaaccggttaacccgggtccccttaacccgtaccggtacccgtttccgttccgggttccggggacccttaccggtaacgggtcccgtaagggtaacgggtaacggtccggggttaacggtaccggtttaagttaacgttttaaccggtttaaccgnggttaacccgtaacggttcccttaagtaacgttacgtaacggtaccggaacgggtaaccaacgtaacgtaaaccgttagggttacgggttacgggttacggttaccggggacgggtaaaccgaaccggtacggtccggtaacgtcccgttaccgtaacgtccgaaccgaacccgaggtccctcccggcccgttacccggg

SEQ ID NO: 292568 - DNA, 594 bp, Homo sapiens
  misc_feature: GYAE6OF01EZ9QU.48.26.C04.1.454.CMB.1.raw
  modified_base (234)..(234): a, c, t, g, unknown or other
  misc_feature (234)..(234): n is a, c, g, or t
  modified_base (257)..(257): a, c, t, g, unknown or other
  misc_feature (257)..(257): n is a, c, g, or t
  modified_base (275)..(275): a, c, t, g, unknown or other
  misc_feature (275)..(275): n is a, c, g, or t
  modified_base (313)..(313): a, c, t, g, unknown or other
  misc_feature (313)..(313): n is a, c, g, or t
  modified_base (342)..(342): a, c, t, g, unknown or other
  misc_feature (342)..(342): n is a, c, g, or t
  modified_base (412)..(412): a, c, t, g, unknown or other
  misc_feature (412)..(412): n is a, c, g, or t
tcagagtatacatacacgaccggtgctcgatttagtctagcgactttgggtttgggggctgggggtctcaggaggcagcgctctcaggacgtcaccaccatggcctgggctctgctcctcctcaccctcctcactcagggcacagggtcctgggcccagtctgccctgactcagccctccctccgcgtccgggtctccgtggacagtcagtcaccatctcctgcactggaaccngcagtgacgttggtgttatactntgtctccgtgtaccaacncgcaccgaggacaaaccgccccaaagtcatgtattagngaggtcagtacgccgccctgacgggtccngactcgtcttctctggctacgagtcgtcgaccaacgcccgtccctcgtcgtccgtcgtcgtcgtcctcgnggtctaggagtcgtaggacgtactagttattactcgtcgacgcgtactcgtatgtacgacgtgacagacaagtagtggtaacggtcgtaccgggacgggtaacgacctaggtaccgtacggtacccgttacgggtaccgtacggaacccgaccggtaacgtcccctaccccgggtaccccgg

SEQ ID NO: 292569 - DNA, 795 bp, Homo sapiens
  misc_feature: GYAE6OF01DAIRA.48.26.C04.1.454.CMB.1.raw
  modified_base (230)..(230): a, c, t, g, unknown or other
  misc_feature (230)..(230): n is a, c, g, or t
  modified_base (259)..(259): a, c, t, g, unknown or other
  misc_feature (259)..(259): n is a, c, g, or t
  modified_base (331)..(331): a, c, t, g, unknown or other
  misc_feature (331)..(331): n is a, c, g, or t
tcagagtatacatacacgaccggtgctcgatttagtctagcgactttgggtttggggggggtctcaggaggcagcgctctcaggacgtcaccaccatggcctgggctctgctcctcctcaccctcctcactcagggcacagggtcctgggcccagtctcgccctgactcagccctccctccgcgtccggtctcctggacagtcagtcaccatctcctgcacgtggaaccngcagtgacgtttggtaggtttaataactntcgtcttccgtcggtaaccaacacgccaacccgaggaccaaaccgacccccaaaagtccattgtattttagngtaggtacaaggtaacgccggtccctcggtacgggttccctagactcgtctttctcgtcggtacctaccgtaagtccgtaggaccaaccgtacccggtcccctcccgtacggtaccccgttcgttccggtcgggtcccttaccgacggtcctagggtaaggtacgttacgggacggtacttaggttaacttttacgttaacgtcggtaccgtacgtccttaactaagtttacgcggacggtaacgggaccctaacgtaacctaaaacgttaggtttacggggtttacgggttaacgggttacccggggacgggggtaaaccgggtaaacccgtaacgggttcccgttaacccgggttaccccggtttaacccgggttaaccgggttaccccgaaacccgggtaaccccggtaaaggggtccccctttacccccgggtcccccccggttacgggttaaccccccg

SEQ ID NO: 292570 - DNA, 625 bp, Homo sapiens
  misc_feature: GYAE6OF01CNAFP.48.26.C04.1.454.CMB.1.raw
  modified_base (232)..(232): a, c, t, g, unknown or other
  misc_feature (232)..(232): n is a, c, g, or t
  modified_base (252)..(252): a, c, t, g, unknown or other
  misc_feature (252)..(252): n is a, c, g, or t
tcagagtatacatacacgaccggtgctcgatttagtctagcgactttggggtttggggggggtctcaggaggcagcgctctcaggacgtcaccaccatggcctgggctctgctcctcctcaccctcctcactcagggcagagggtcctgggcccagtctgccctgactcagcctccctcgcgtccggtctccgtggacagtcagtcaccatccgtcctgcacgtcggaaccngcagtgacgttggtagttanactgtgtctccgtaggtaccacagccaccaggacaacgaccccaaagtcatgtattatgagtcgaagtacgccggccgtcgacgggtcctgactcgtacttctcgtcgtactaccgtaagtcgtcggacaaccgtaccggtcccttcccgtcgacccgttcgtccggtcggtaccctaccgaggtctaggacggtatcggacgtgtagtactttatacgtgactacgtctacatagtcggacgacggacacgtacaagtagttcggttaggtaacgtcgggacggtacggtaacgacggtccgtacggtacccggttcggtaacgtacccgacgtacccggtaacgtccgtacccgtccccgtggttaccccg

SEQ ID NO: 292571 - DNA, 773 bp, Homo sapiens
  misc_feature: GYAE6OF01CCJI2.48.26.C04.1.454.CMB.1.raw
tcagagtatacatacacgaccggtgctcgatttagtctagcgactttgggtttggggggggtctcaggaggcagcgctctcaggacgtcaccaccatggcctgggctctgctcctcctcaccctcctcactcagggcacgagggtcctgggcccagtctgccctgactcagcctcctcgcgtccggtctctggacagtcagtcaccgatcctctgcactggaaccagcagtgacgttggtagttaatactgtgtcctctggtaccaacaacacgcaggcaaacgccccaaactcactgtatttaatgtatcgtactaacgtaacgcggaccctcggtacgggtccctagccttccgctttccgtcgtcggtacctcgtaacgttccgtaggtaaccgtaaccgacccggggtccctacccgtacggtaacccctaacgttccgttccggttaccggggtacccttacccggaacgggtcctaacgggtaaacggtaacggttcggaacgggttaccgttaggtaacttttaacgtttcgtaccgtcgttacgtacttacctaagttaacgtaccgtaccgtacgtaacccttaaactttacgtttaagttcccgttaccgttaacgggtaaaccgttacgggtaaaccggtaacccggtaaaccggttacccgttaaacccgggtttccgttaaaccgggtcccgttaaacccgggtaccccgaaaccgggtaaccccccgaaaccccctttaggtacccggttaaaccccgg

SEQ ID NO: 292572 - DNA, 653 bp, Homo sapiens
  misc_feature: GYAE6OF01CYDYG.48.26.C04.1.454.CMB.1.raw
  modified_base (308)..(308): a, c, t, g, unknown or other
  misc_feature (308)..(308): n is a, c, g, or t
  modified_base (355)..(355): a, c, t, g, unknown or other
  misc_feature (355)..(355): n is a, c, g, or t
tcagagtatacatacacgaccggtgctcgatttagtctagcgactttgggtttggggtggggtctcaggaggcagcgctctcaggacgtcaccaccatggcctgggctctgctcctcctcaccctcctcactcagggcacaggtcctgggcccagtctgccctgactcagcctccctccgcgtccgggtctcctggacagtcagtcaccatctcctgcactcggaaccagcagtgacgttggtggttaataactatgtctccgtgtaccaacagcaccagacaaacgccccaaagtcatgtatttagngagtcaggtaagccgcccgtcgacggggtccctgactcgtctttccncgtggctaccgaagtctaggaccaacgacccggtccctcccgtcggtacccgttcgttacgtcgggtaccctccgacgggtcgttagggaaggtagtacggaggtaccgttgtaactttaacttaccgtggacctagtcctataagttagtcgacgaggacgtacgaacctaaaagtaggttaggtacgggttacgttaccggggacgggacgggaaccctaagggtccgttacggacccggttaccgtacggtaccgtaaccggacccgaacggtccgtcccggtcccccgttacgg

SEQ ID NO: 292573 - DNA, 652 bp, Homo sapiens
  misc_feature: GYAE6OF01CF8C0.48.26.C04.1.454.CMB.1.raw
tcagagtatacatacacgaccggtgctcgatttagtctagcgactttgggtttggggtggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttatactatgtctcctggtaccaacagcaccaggacaaacgcccccaaagtcatgatttatgatgtcagtaagcggccctcgacgggtccctagactcgccttctcgtggctccgaagtctaggcaacgaccggtccctcccgtagaccattcctacgtcgggccttccgagggtcctaggaaggtactgggacggtctagttaatttaacgttactcggtctcgtctacgaattacgtcggacgtacgggctaacgtaccgttaacgtacgggtttcggggttacggttccggggacggggaaccggggtaaccctaagggtcccgtacgggtaccccggttaccgttaacgggtacccgaacccggaccccggaaacgggtcccgttccccgggtacccccccgg

SEQ ID NO: 292574 - DNA, 741 bp, Homo sapiens
  misc_feature: GYAE6OF01BDSZ7.48.26.C04.1.454.CMB.1.raw
  modified_base (236)..(236): a, c, t, g, unknown or other
  misc_feature (236)..(236): n is a, c, g, or t
  modified_base (267)..(267): a, c, t, g, unknown or other
  misc_feature (267)..(267): n is a, c, g, or t
  modified_base (328)..(328): a, c, t, g, unknown or other
  misc_feature (328)..(328): n is a, c, g, or t
tcagagtatacatacacgaccggtgctcgatttagtctagcgactttgggtttggggggggtctcaggaggcagcgctctcaggacgtcaccaccatggcctggctctgctcctcctcaccctcctcactcagggcacagggtcctgggcccagtctcgccctgactcacgccctcccgtccgcgtccggtctccgtaggacagtcacgtcacctatctcctgacacgtggaaccngctaggtcgtacgtttggtagttaatacgtntcgtcctcgtagtaaccaacgacgccaccgagaccaaccgaccccaagtcagtgtaattgngtagtacagtacggccgtccgtacggtacgggtcctgtacgtcgtcttcgtcgtcgtcctacgtagtctacggaccaacgtccgtccctcgtcggtaccgttccgtcggtcgggtccttaccgggacggtcgtacgggtaacggtacgtacgggtaacggttacgtttaggttaaactttttacggttaccgtacgggtacctaacgggttcccttacggttaaacgttcgggaccgtaccgggttaacggaccctaacgggtaaacttaaacggttacgggttacggttacgggttacccgggtacgggaaccgggaccggtaaacgtaccggtcggttaaccggtcccggttacggaccggtaccggaacccggtccggtacgtcccggaccccgttccggttcgtacccg

SEQ ID NO: 292575 - DNA, 781 bp, Homo sapiens
  misc_feature: GYAE6OF01DIPT4.48.26.C04.1.454.CMB.1.raw
  modified_base (229)..(229): a, c, t, g, unknown or other
  misc_feature (229)..(229): n is a, c, g, or t
  modified_base (253)..(253): a, c, t, g, unknown or other
  misc_feature (253)..(253): n is a, c, g, or t
  modified_base (347)..(347): a, c, t, g, unknown or other
  misc_feature (347)..(347): n is a, c, g, or t
  modified_base (400)..(400): a, c, t, g, unknown or other
  misc_feature (400)..(400): n is a, c, g, or t
tcagagtatacatacacgaccggtgctcgatttagtctagcgactttgggtttggggtggggtctcaggaggcagcgctctcaggacgtcaccacatggcctgggctctgctcctcctcaccctcctcactcgagggcacgtacgggtcctcgggccctagtctcgaccctgactcagcccttcccgtccgtccggtccggtctcgtggactacgtcacgtccaacctntcctcgtgcctacgtacggaaccngtcgtaggtgtacggtttggtagtaactactgtacgtcctccgtagtaccacgcgaccaccgagaccgaactaccccgaagtcattgtattagngtacgtcacggtacgtccgtccgtaggtacggtcctagacgtccggtcttccncgttcggacctacgtagtcgtacgaccgacctaccggtcccttacccggtacggtacccgttcgtacccggttcggggtaccctacggggacgtaccggtaggtaacgggtacggttgggtaaccggttacgtttacgggttaacttttaaccggtaccggtaccgtacgtttaacggtaccctttaacggtagtaccggtcgggttaacaccggtacgaacctaaaccggtacgtttaacggttacgggttacggttaacccgggtcggggtaaaccgaaccggggtactacgggttaccccgtacggttaccggccgttaaccggtaccgtaacccggggtcctaaccgggtccccgtcccggttcccgtttaaccggg

SEQ ID NO: 292576 - DNA, 751 bp, Homo sapiens
  misc_feature: GYAE6OF01D910L.48.26.C04.1.454.CMB.1.raw
  modified_base (325)..(325): a, c, t, g, unknown or other
  misc_feature (325)..(325): n is a, c, g, or t
tcagagtatacatacacgaccggtgctcgatttagtctagcgactttgggtttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcacgtggaaccagcagtgacgttggtagttaatactatcgtctcctacggtaaccaacgacgaccaaccgaggaccaaaccgacccccaaagtcattagtatttagnggtacggtacaagtacgccgcctacgacgggtcctagtactcgtcttcgtcgtcgcctacgaacgtcgtcgacaaaccgccgtaccctcccgtcgtacccgtcgtcggtcgggtacctccgacggtacgtacggaaggtacgtcggacggtacgttagttaactttaacgtttaacgtcggtacctacggtacctacgtaacgttacgtacggacgaaccgggtaccggaacgtaacccgtaaaagttaacggttcgggttaacgggttacggtttacccgggggaacgggttaaaccgggaaaccgtaaccgggttacccggttaccggttaaccccggttaccggttaaaccgggtacccgaacccggttaccccggaaaccggtccccgttcccccgggtaacccccggttcggttaaccccg

SEQ ID NO: 292577 - DNA, 776 bp, Homo sapiens
  misc_feature: GYAE6OF01CJ8B1.48.26.C04.1.454.CMB.1.raw
tcagagtatacatacacgaccggtgctcgatttagtctagcgactttgggtttgggggggggtctcaggaggcagcgctctcaggacgtcaccaccatggcctgggctctgctcctcctcaccctcctcactcagggcacgagggtcctgggcccagtctcgccctgactcacgccctccctccgcgtccgggtctcctggacagtcagtcaccatcctcctgcacgtggaaccagctagtgacggttggtgttaataactatgtctcgtcgtaaccaacacgaccacccgaggaccaaaccgaccccaaagtcatagtatttagtggacggtacaacggtacggccggtcccgtacggacgggttccctagacgttccgtaccgtttcgtccgttcggtcccttaaccgtaacggttccgtacgggaaccgaaacccgtaccccgggtcccttaccccggtacgtaccccggtttccttaccgggtccgggtacccttacccggtacgggtcggttaacggacgggtaacgtacgggtaacggtcttaagttaacgttttaacgttaccgttgaccgtacgtaccttacgtacttaagtcgaacgtacggaccgaacgtaacctaaacgttagttacgggtttacgggttaacggttcccggggacgggaaaccgggaccgtaaacggtccgtaaccgggtaccccggttcggttaccgtacgaacccggtacccgtaacgggtcccgtttaccccgccccggttacggtacccg

SEQ ID NO: 292578 - DNA, 691 bp, Homo sapiens
  misc_feature: GYAE6OF01EM3Z2.48.26.C04.1.454.CMB.1.raw
  modified_base (352)..(352): a, c, t, g, unknown or other
  misc_feature (352)..(352): n is a, c, g, or t
  modified_base (386)..(386): a, c, t, g, unknown or other
  misc_feature (386)..(386): n is a, c, g, or t
  modified_base (412)..(412): a, c, t, g, unknown or other
  misc_feature (412)..(412): n is a, c, g, or t
  modified_base (428)..(428): a, c, t, g, unknown or other
  misc_feature (428)..(428): n is a, c, g, or t
  modified_base (449)..(449): a, c, t, g, unknown or other
  misc_feature (449)..(449): n is a, c, g, or t
  modified_base (461)..(461): a, c, t, g, unknown or other
  misc_feature (461)..(461): n is a, c, g, or t
tcagagtatacatacacgaccggtgctcgatttagtctagcgactttgggtttgggggggggtctcaggaggcagcgctctcaggacgtcaccaccatggcctgggctctgctcctcctcaccctcctcactcagggcacgagggtcctgggcccagtctgccctgactcagccctccctccggcgtccgggtctccgtggacagtcagtccacctatcctcctgcctacgtcggaacctgcagtcggtacggtttgggtaggttaattacgtagtcgtccttccgtacggtaaccaacgacgacccgaaccgagtaccgaaaaccgccccaaagtcaagtacgtatttagnggacggtacaggtacgcgtcctagtacgggtccngtactcgtctctcgcgactcagtcgngacacgcgtcctccgngtacctcgtcgtcggtcacgngtcgtagaggtntacggagtcgtagttacttacgtacgtacgctacgtcgttactaagttcgcggtaacgaacggtacaacgtaacgttaaacgttcggttaggttaacgggtacggttacccgggggaacggtaccgggaaaccggttacggtaccggttaccggtacccggttacggtacggtaccgaacccggtaccggacggttacccccgtcccggtacccgttacccggttacccg

SEQ ID NO: 292579 - DNA, 677 bp, Homo sapiens
  misc_feature: GYAE6OF01AS45O.48.26.C04.1.454.CMB.1.raw
  modified_base (309)..(309): a, c, t, g, unknown or other
  misc_feature (309)..(309): n is a, c, g, or t
tcagagtatacatacacgaccggtgctcgatttagtctagcgacttttgggtttggggggggtctcaggaggcagcgctctcaggacgtcaccaccatggcctgggctctgctcctcctcaccctcctcactcaggcacagggtcctgggcccagtctgccctgactcagcctccctccgcgtccggtctcctggacagtcagtcaccatctcctgcactggaaccagcagtgacgttggtgttataactattcgtctcctggtaccaacacgcaccaggacaaacgcccccaaagtcatgtactttangaggtcagtaacgcggccctcgagggtccctgtactcgtcttctcgtcggcctacgtaagtcgtaggacaaccgaccggccctacccgtgtacccgttctcggtaccgggccttaccgacggccgttaggacggatggacgggtcttaggttaaattacgtttactcggtacctacgtacttacgaagttagtcgggaacaagggtaccaaacggtaacccgtaaagttacggtttagggtacgggtttacgttaacccgggggacgggtaaaccgggacccgtaaaggtccgttaacggacccggttaccggacggttacccgacgtacccgaacgggtccctaccccggtccccgttggtaacccc

SEQ ID NO: 292580 - DNA, 647 bp, Homo sapiens
  misc_feature: GYAE6OF01BUHPM.48.26.C04.1.454.CMB.1.raw
  modified_base (197)..(197): a, c, t, g, unknown or other
  misc_feature (197)..(197): n is a, c, g, or t
  modified_base (210)..(210): a, c, t, g, unknown or other
  misc_feature (210)..(210): n is a, c, g, or t
  modified_base (229)..(229): a, c, t, g, unknown or other
  misc_feature (229)..(229): n is a, c, g, or t
  modified_base (253)..(253): a, c, t, g, unknown or other
  misc_feature (253)..(253): n is a, c, g, or t
  modified_base (268)..(268): a, c, t, g, unknown or other
  misc_feature (268)..(268): n is a, c, g, or t
  modified_base (355)..(355): a, c, t, g, unknown or other
  misc_feature (355)..(355): n is a, c, g, or t
tcagagtatacatacacgaccggtgctcgatttagtctagcgactttgggtttgggggggtctcagggaggcagcgctctcaggacgtcaccacatggcctggctctgctcctctcaccctctcactcagggcacagggtcctgggcccagtctcgccctgactcacgccctccgtcgcgtccggtctccgtggacngtcacgtcacctntcctcctgcactggaaccngcagtgacgttggtgttataactntcgtctctcgtacancgcaccaggacaacgccctaaagtcagtcgatttagaggacgtacagtacgccgtaccgtcggaacgggtcccagtactcgtcttcncgtcgctacgagtcaggtaccaacgtccggtcccttaccgtcgtaccgtctcgtcggtacctcgaggtctacggacggtattggaacgttccgttagtaacgtttacgttacgtcggactaggtaccttacgtagtacgtcgcgaacggtaccaagtacctaaacgttcgtacgggttacgttaaccggtcgggaacgggtacggaaccgtaacggtcgtaaccgtacccggtttacggacgtaccaaccggtcccggtaacgtccccgttaccggccccgtttcggtaccg

SEQ ID NO: 292581 - DNA, 731 bp, Homo sapiens
  misc_feature: GYAE6OF01EKPYL.48.26.C04.1.454.CMB.1.raw
  modified_base (280)..(280): a, c, t, g, unknown or other
  misc_feature (280)..(280): n is a, c, g, or t
tcagagtatacatacacgaccggtgctcgatttagtctagcgactttgggtttgggggctgggggtctcaggaggcagcgctctcaggacgtcaccaccatggcctgggctctgcctcctcctcaccctcctcactcgagggcacgagggtcctgggcccagtctcgccctgactcacgccctccctccgcggtccggtctccgtgacagtcagtcacctatctccgtgcacgtacggaaccagcgtaggtcggtacggttggttaggttaataacgttntcgtccttccgtacggtaaccaacgacgaccaaccgacggaaccaaacccgtaccccaaagtccaagttaggttaatttaggtaggacgtacgaacggtacggcccggtacctcgggtaccgggttcctagtaccgttccgtcctttccgcggtccgtactaccgtaaggtccgtacggaccaaccgtccgtccctaccgtacgtaccgttcgtcgtcgggtccctaccggaggttcgtacgggtaggtagtacggggacgttacgttaagttacgtttaactcgcgtacgcgttactactagtacgtcggaacgacgtacctaaggtaaactaacggagtttacgggcggttaccgggtcgggaacgggtaccgaccgtaaggtccgtaccggaaccgttcggaacgtcccgtaaccggtaaccggaccgtcccggtccccgtacccggg

SEQ ID NO: 292582 - DNA, 582 bp, Homo sapiens
  misc_feature: GYAE6OF01CZVTK.48.26.C04.1.454.CMB.1.raw
  modified_base (250)..(250): a, c, t, g, unknown or other
  misc_feature (250)..(250): n is a, c, g, or t
tcagagtatacatacacgaccggtgctcgatttagtctagcgactttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttgtgtataactntgtctcctgtaccaacacgccaccgagacaaacgaccccaaagtcatgtattatgaggtcaagtaacgcggtcctcgacgggtccagactcgtctctctgctcaacgtctgacaacacgtccctcctgaccgtctacgtcgggtctaccgacggccgtaggacggagtcgggacgtcgtagtagtttacttaacgtcgcacgtctacatagtgacgaggtacgagacaactaagttcggttacgttagttcgggacggacggtacgacggtcgtacggacccgttcgtacggtacaccgaccgaacggtcctacccgcccgttcggtacccg

SEQ ID NO: 292583 - DNA, 796 bp, Homo sapiens
  misc_feature: GYAE6OF01EUBC6.48.26.C04.1.454.CMB.1.raw
  modified_base (255)..(255): a, c, t, g, unknown or other
  misc_feature (255)..(255): n is a, c, g, or t
tcagagtatacatacacgaccggtgctcgatttagtctagcgactttgggtttgggggggtcgtcaggaggcagcgctctcaggacgtcaccaccatggcctggctctgctcctcctccaccctctcactcagggcacgagggtcctgggcccagtctgcctgactcagccctccctcgcgtccggtctcctggacagtcagtccaccatcctcctgcacgtggaaccagcagtcgacgttggtgttataacgtntcgtctcctacggtaaccaacgacggccacccgaggaccaaaccgccccctaaaagtcacgtagtaattttaacgtcggtaacggtacgaacggttaacggcccggtcccgtacggtaccgggtccctaggtaacgttccgtccgtttctcgttacggcctaccgtaaggttcctacgggtaacctaaccgtacccggtcccttaccccgtacggtaacccgttccgtcggttaccggggacccttacccggaacgggtcccgttagggaacggtaacgttcgggaacgggttcttaagttaacgttttaacgttaccgtacggtaccgtaacggttaccttacgttaacgttcgtacggtaccccgaacgggtaacctaacccggtaacccgtaaagttaaccggttaggttacggtttaacggttacccggggacgggtaaacggtaaccgtaacggtcgtacccggtaaacccggttcgtaacggacgtacccggtacccgtaacggtcccttccccggtaccccgttcggtaccccg

SEQ ID NO: 292584 - DNA, 694 bp, Homo sapiens
  misc_feature: GYAE6OF01BVJU2.48.26.C04.1.454.CMB.1.raw
  modified_base (348)..(348): a, c, t, g, unknown or other
  misc_feature (348)..(348): n is a, c, g, or t
  modified_base (401)..(401): a, c, t, g, unknown or other
  misc_feature (401)..(401): n is a, c, g, or t
tcagagtatacatacacgaccggtgctcgatttagtctagcgactttggggtttgggggggggtctcaggaggcagcgctctcaggacgtcaccaccatggcctgggctctgctcctcctcaccctcctcactcagggcacgagggtcctgggcccagtctgccctgactcacgccctcctccggcgtccgggtctccgtggacagtcagtccacctatcctacctgcctacgtacggaaacctaggaccgtaggtcggtacggtttggtaggttataactgtcgtactccgagtaaccacacgaccaaccgaggacaaccgaccccaagtcctagtacgtatttagnggtacgtcgaagtacggccgtccgtacggtaccggtctagtactcgtcttcgngtcgactacgacgtcgtcgaacctaaccgtccgtacccttaccgtaggtacccttacgtcggtcgtacccgtacgacggtccgaggtaggacgtaggagtcgtaagttacttaacttcgaacggtctaacggtactataacgttcgcgaacgtacgaacgacggtaaccaaggttcgttagggtacgttaccggtacgggaacgggtaccggtaacgtacggtaccggtacggtacggttacgacggttaccgaccggtaccgacgtacccggttcccgcccgtcggttaccc

SEQ ID NO: 292585 - DNA, 775 bp, Homo sapiens
  misc_feature: GYAE6OF01BQZBD.48.26.C04.1.454.CMB.1.raw
  modified_base (587)..(587): a, c, t, g, unknown or other
  misc_feature (587)..(587): n is a, c, g, or t
tcagagtatacatacacgaccggtgctcgatttagtctagcgactttgggtttgggggggggtctcaggaggcagcgctctcaggacgtcaccaccatggcctggctctgctcctcctccaccctcctcactcgagggcacgacgggtcctcgggcccagtctcgccctgacctcacgccctcccgtccgccggtccggtctccgtggacagtcgactccacctatcctccgtcgcacgtacggaaccagaccgaggtcggtacggttgggttagttataacgtagttcgtctaccgtacggtaaccaacgacgaccaaccgacggaaccaacccgaacccccgaagtacctagtagttaatttagtacggtaagtaccgtaaggaccgcccggtaccgttaccgggtaccgggtccctaaggtcctaccgtcttccgtcgtcgtacgtacgtacgtcgacgacgtacgtaccgcccgttaccgtcgtacccgttccgtccggttacgggcccgtacgtacgggtcgttagggaaccgtgggtaccggtaacggttcgtaacttaagtttccgtaacgtaggtaccncgttacgtacgaacgtttcgacgtaccgggacacgggaaacctaaccgttaaaattcgggttaagggtccgttaccgggaggggaaccgggtaccgaaccggtccggtaaacggtcccgttaacggttcgaccccgtaacggtaccgacccgggtaatcccccgggtacccgtccgtaccggtacccc

SEQ ID NO: 292586 - DNA, 651 bp, Homo sapiens
  misc_feature: GYAE6OF01AVUSQ.48.26.C04.1.454.CMB.1.raw
  modified_base (197)..(197): a, c, t, g, unknown or other
  misc_feature (197)..(197): n is a, c, g, or t
  modified_base (250)..(250): a, c, t, g, unknown or other
  misc_feature (250)..(250): n is a, c, g, or t
  modified_base (298)..(298): a, c, t, g, unknown or other
  misc_feature (298)..(298): n is a, c, g, or t
  modified_base (328)..(328): a, c, t, g, unknown or other
  misc_feature (328)..(328): n is a, c, g, or t
tcagagtatacatacacgaccggtgctcgatttagtctagcgactttgggtttggggggggtctcaggaggcagcgctctcaggacgtcaccaccatggcctgggctctgctcctcctcaccctcctcactcagggcacagggtcctgggcccagtctgccctgactcagcctccctcgcgtccggtctcctggacngtcagtcaccatctcctgcactggaaccagcagtgacgttggtgttaatactntgtctctgtaccaacagcaccagacaacgacccaaagtcatgatttangtagtcagtaacgccgacctgacgggtccngactcgcttctctcgctacagtctaggacaacgtaccggccctaccgtcgtaccgtcgtccgtcggtacctccgaggtctacgggaggtacgtggaacggtctagttactttagttactgtacacgtctactatagtacgacgtaacggccgtaacgaccgtaagtaagttacgggttacgtaaccgggttcgggaaccggggtacggaacccgtaacggtcccgttacgggtaaccccggttacggtaccgggttacccgtaacccggtaaccccggtaacgggtcccctaccccgggttacccccgtccgggttaaccccg

SEQ ID NO: 292587 - DNA, 759 bp, Homo sapiens
  misc_feature: GYAE6OF01EIF0N.48.26.C04.1.454.CMB.1.raw
  modified_base (619)..(619): a, c, t, g, unknown or other
  misc_feature (619)..(619): n is a, c, g, or t
tcagagtatacatacacgaccggtgctcgatttagtctagcgactttggggtttgggggggggtctcaggaggcagcgctctcaggacgtcaccaccatggcctgggctctgctcctcctccaccctcctcactcagggcacgagggtcctgggcccagtcctcgccctgactcacgtccctccctccgcgttccgggtctccgtaggactacgtcacgtccaacctctcctcctgactacgtcgaaccagctagtcgtacggttggtagttaactaacgtacttcgttccgttaccgtacggtaaccaaacgtacgacccaaccggaacggaaccgaaacccgtaacccccgaaaagtccaagtttagttactttaggacggtaacggtacgaacggtaacggtcccggtcccgtacgggtaccggtccgtagtcgttccgtcttcgtcgtcgtaccttacgacgttcggacgaaccgaaccgtccggtcccttacccgtacgtcccgttcgtaccggtacggtccgtaccggtacggtacgagggtaggtacgtggtaccggtacttaacggtttaacttacggtaccgtcggtaacgtcgtaccttatacgttcgngtaaccggagacctacgtaaaccgagttgtagggttaccgcgggtaacgggtacgggacgtaacctcggtacgttaccgtacggttccgaacggtccgaaccgtaccggacgtcccgtccgtaaccccggtcggtacccg

SEQ ID NO: 292588 - DNA, 760 bp, Homo sapiens
  misc_feature: GYAE6OF01C14L0.48.26.C04.1.454.CMB.1.raw
  modified_base (207)..(207): a, c, t, g, unknown or other
  misc_feature (207)..(207): n is a, c, g, or t
  modified_base (522)..(522): a, c, t, g, unknown or other
  misc_feature (522)..(522): n is a, c, g, or t
  modified_base (572)..(572): a, c, t, g, unknown or other
  misc_feature (572)..(572): n is a, c, g, or t
tcagagtatacatacacgaccggtgctcgatttagtctagcgactttgggtttggggggggtctcaggaggcagcgctctcaggacgtcaccaccatggcctgggctctgctcctcctcaccctcctcactcagggcacgagggtccgtgggcccagtctcgccctgactcagccctccctccgcgtccgggtctcctggacagtcncgtcaccactcctcctcgcacgtacggaaccagctagtgtacggttggttagttaataacgttagttcgtccttccgtacggtaaccaacgtacgccaacccgaggaaccaaaccggaccccctaaaagtccaattacggttaattttacggacgggtaacggtactaaacggtaccggtcccggtacccgttacgggtaaccgggttaccctggtacctccgttccttttcgcgttcgaccttaccgtaagtcgacggtaacctacccggaccgtaccccttcgacccggtcctccgttacggcgggttacccncggacggtggtaggagtacgtcggtaggtcttaggttatttacgtaccgngtaccgtattaccgacttagtcgacggctaacgggaccaagttaaccaacgtttggtacggttacggttaccggtcgggacccgggaaggttaccgcgttaaccggtaccgtacccggtcccggttaggaaccccgtacggaaccccggtacgtcccccgtttacccggccccccggtgttaaccccg

SEQ ID NO: 292589 - DNA, 795 bp, Homo sapiens
  misc_feature: GYAE6OF01DM9VX.48.26.C04.1.454.CMB.1.raw
  modified_base (259)..(259): a, c, t, g, unknown or other
  misc_feature (259)..(259): n is a, c, g, or t
  modified_base (710)..(710): a, c, t, g, unknown or other
  misc_feature (710)..(710): n is a, c, g, or t
  modified_base (735)..(735): a, c, t, g, unknown or other
  misc_feature (735)..(735): n is a, c, g, or t
tcagagtatacatacacgaccggtgctcgatttagtctagcgactttgggtttgggggtggggtctcaggaggcagcgctctcaggacgtcaccaccatggcctgggctctgctcctcctcaccctctcactcgagggcacgcgggtccgtcgggcccagttcgtcgcccttagactccgacgtccccttcccgtccggtccggttcccgggttcctaccggtggacctagtccgtacgtccaacctcttccttaccgngacctaacggacgaacctggtcctaggttaggttaccggttggtttaagttaacgttaacgtcgttcgtacccgtaccgttacggtaaaccacggacgacccaccgtacggaaaccaaaccgacccgtaaagtctagttacgtaagtttacggtacgaaggttacacgggtaaccgtcccggtaaccgttcggtaccgggtactggaccgtttcggtactttcgcgttacggaccttacgtaggtccgtagaacccgtacgtccccgtcgttaccggtcgtaccgtcgtaccgggtcgaccctgggtagtaccggtgaacgggttcgtaggacttacgtttagttaaccttcgttaacgcggtactacgttcgaagttcctaagggcgtaaccggtacgaacgttaacgaagtttacgtccgggtaggttacccgagggtaaaccgggtanacccggtttagaccgggtttaccgngttcccgggtaaacgcctaaccgggtaccacccggttcgttcccccgaaggtttacccgg

SEQ ID NO: 292590 - DNA, 725 bp, Homo sapiens
  misc_feature: GYAE6OF01BMWH5.48.26.C04.1.454.CMB.1.raw
  modified_base (225)..(225): a, c, t, g, unknown or other
  misc_feature (225)..(225): n is a, c, g, or t
  modified_base (250)..(250): a, c, t, g, unknown or other
  misc_feature (250)..(250): n is a, c, g, or t
  modified_base (305)..(305): a, c, t, g, unknown or other
  misc_feature (305)..(305): n is a, c, g, or t
tcagagtatacatacacgaccggtgctcgatttagtctagcgactttgggtttgggggggtctcaggaggcagcgctctcaggacgtcaccaccatggcctggctctgctcctcctcaccctcctcactcagggcacagggtcctgggcccagtctgccctgactcagcctccctcgcgtccgggtctcctggacagtcagtcaccatctcctgcactggaaccngcagtgacgttggtagttataactntcgtctcctggtaccaacagccaccaggacaaacgccccaaagtcatgatttagngagtcagtacgccggcctacgacgggtccctgacgtccgtcttctcgtcggcctacgaagtccgtaggcctaaacgaccggtccctacccgtcgtaacccgtcgtccggtcggccgtaccgacggtcgttacggaaggtagtacccccccggtaggtaccgttagtaacgtttaacgtttaccgtacggtaccgtacgtaccgtactaacgttaacgtcgtacggtacggaccgtaacgtacgtaaacgtaacgttaggttacgggttacggttaccgggtaaccggggtaaccgggtaacccgtaaacggtaccggttaaccggttaccccggttacccgttaaccgggtacccgtaacccggtaacccggtaaccggtaccccgtaccccggtaccccccggttccggttaaccccgg

SEQ ID NO: 292591 - DNA, 770 bp, Homo sapiens
  misc_feature: GYAE6OF01C4703.48.26.C04.1.454.CMB.1.raw
  modified_base (252)..(252): a, c, t, g, unknown or other
  misc_feature (252)..(252): n is a, c, g, or t
tcagagtatacatacacgaccggtgctcgatttagtctagcgactttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtgttataactntgtctcctggtaaccaacagccaacccgaggacaaacgacccccaaagtcatcgtaattttatagacggtacaagtaacgccggtcctggacgggtccctgactcgtcttctcgtcggtactacgtaacgtcgtacggaccaaaccgtacccggcccttcccgttacgtacccggttcgttccggtcggggtacccgtcccggtacggtccgttacgggacggtaaggttacgggtaacgggtacctttaggtaactttttaacgtttaccgtacgtaccgtacgttcccttaacgtaacgttaacgttcgaacgtaacgggacaacgtaaccgtaaacgttaagtttacgggttacgggttacggtttaccggggaaccggggaaaccggggtaacccgaaacgggttaccgttaaccgggtaccccggtttacggttaaccgggttacccggaacccggtaaccccggtaaacgggcccggtttaccccggtaccccccggttccggttaaccccg

SEQ ID NO: 292592 - DNA, 612 bp, Homo sapiens
  misc_feature: GYAE6OF01D6F0X.48.26.C04.1.454.CMB.1.raw
  modified_base (212)..(212): a, c, t, g, unknown or other
  misc_feature (212)..(212): n is a, c, g, or t
  modified_base (230)..(230): a, c, t, g, unknown or other
  misc_feature (230)..(230): n is a, c, g, or t
  modified_base (320)..(320): a, c, t, g, unknown or other
  misc_feature (320)..(320): n is a, c, g, or t
  modified_base (498)..(498): a, c, t, g, unknown or other
  misc_feature (498)..(498): n is a, c, g, or t
tcagagtatacatacacgaccggtgctcgatttagtctagcgactttgggtttgggggctggggtctcaggaggcagcgctctcaggacgtcaccaccatggcctgggctctgctcctcctcaccctcctcactcagggcacgagggtcctgggcccagtctgccctgactcagcctccctcgcgtccggtctcctggacagtcagtcaccntctcctgcactggaaccngcagtgacgttggtaggttataactatgtcctcctggtaaccaacagccaccgaggaccaaaccgcccctaaagtcaagtgtactttagnggtacgtcaggtaacgccgcccgtagacgggtcccagtactcgtcttcgtcgtcggtcctaccgagtctcggaccacgacccgtcctcccgtagacccgttctcggtcggcctacgcggtcgtagaacggtgcggtagtcgtagtaacgtttacgtacgtgacgtagtactacgtaangtacacggagtaccacggtacaacgtgttggtaggtcgttacgggacggtacggaaccagtccggtacggaccgtacgtacggtccacggaccgtacggcctacccggtccccg

SEQ ID NO: 292593 - DNA, 810 bp, Homo sapiens
  misc_feature: GYAE6OF01DAQLO.48.26.C04.1.454.CMB.1.raw
  modified_base (144)..(144): a, c, t, g, unknown or other
  misc_feature (144)..(144): n is a, c, g, or t
  modified_base (594)..(594): a, c, t, g, unknown or other
  misc_feature (594)..(594): n is a, c, g, or t
tcagagtatacatacacgaccggtgctcgatttagtctagcgactttggggtttgggggggggtctcaggaggcagcgctctcaggacgtcaccaccatggcctgggctctgctcctcctcaccctcctcactcgagggcacgngggtcctgggcccagtctcgccctgactcacgccctccctccggcgttccgggtcctccgtggacagtcacgtccacctcgttcctcctgcctacgtacggaaccagcgtaggtcgtacggttggtagttaactactgtcgttctaccgtacgtaaccacgacgaccaccgaggaaccaaaccggacccctaagtctagtacgttaatttacgtaggtaggtactaacgggaaccggtcccggtaccgtagggtaccgggttccctaggtactaccggtcctttacgtcgtcggtacctacgtaaacggttccgacggaaccctaaccggcccgtccccgtacccgttacggtccttccggttcggtacggtaccctcggaacggtcgtaagggacgtaaggtgggaacgtttgtaacggtttaacttacgtttcgacgtacgttacctntaacgttacgtcgtacggtaacggacgaccgtaaagtaacgttaaacgttacgggtttcgggtacgggttacggtaacccgggggcggtaaaccggtaaccccgtagttacccgggaaccgggtttaacccgttaagggtacccggtaaccccgacccgggtaaacccggttacccggtccccgttaaccccgggtccccgtttaacgggtacccc

SEQ ID NO: 292594 - DNA, 625 bp, Homo sapiens
  misc_feature: GYAE6OF01AFYLU.48.26.C04.1.454.CMB.1.raw
  modified_base (228)..(228): a, c, t, g, unknown or other
  misc_feature (228)..(228): n is a, c, g, or t
  modified_base (242)..(242): a, c, t, g, unknown or other
  misc_feature (242)..(242): n is a, c, g, or t
  modified_base (271)..(271): a, c, t, g, unknown or other
  misc_feature (271)..(271): n is a, c, g, or t
tcagagtatacatacacgaccggtgctcgatttagtctagcgactttgggtttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcacatcgcctgcacgtggaaccngcagtgatattggntcttactaacttgtctcctggtaccaacnctccaccaggcaacgtccccaaggtctattatttatgtatgtactactaacgcgggtccccgttacggggtccctgtactcgtcttctcgtcgctcacgtctgcacgcgccctcctacgaccactctcgtcggcctcgacggctagaacgatcgacgtcgtagactttactacgtcgtcttcgttctttactttacttacgttttccgttttgttaccgttcggttaacgtccgggtaaccggtacggtaccgtacccgttccgtacggtacccgtacgacccgtaaccggtacccctaaccccgtcgttaccggtaccctacccttcccggttcccgttccccgttacccccg

SEQ ID NO: 292595 - DNA, 678 bp, Homo sapiens
  misc_feature: GYAE6OF01CICQ1.48.26.C04.1.454.CMB.1.raw
  modified_base (234)..(234): a, c, t, g, unknown or other
  misc_feature (234)..(234): n is a, c, g, or t
  modified_base (251)..(251): a, c, t, g, unknown or other
  misc_feature (251)..(251): n is a, c, g, or t
  modified_base (285)..(285): a, c, t, g, unknown or other
  misc_feature (285)..(285): n is a, c, g, or t
  modified_base (305)..(305): a, c, t, g, unknown or other
  misc_feature (305)..(305): n is a, c, g, or t
  modified_base (324)..(324): a, c, t, g, unknown or other
  misc_feature (324)..(324): n is a, c, g, or t
  modified_base (334)..(334): a, c, t, g, unknown or other
  misc_feature (334)..(334): n is a, c, g, or t
  modified_base (346)..(346): a, c, t, g, unknown or other
  misc_feature (346)..(346): n is a, c, g, or t
  modified_base (353)..(353): a, c, t, g, unknown or other
  misc_feature (353)..(353): n is a, c, g, or t
  modified_base (373)..(374): a, c, t, g, unknown or other
  misc_feature (373)..(374): n is a, c, g, or t
tcagagtatacatacacgaccggtgctcgatttagtctagcgacttttgggtttgggggtggggtctcaggaggcagcgctctcaggacgtcaccaccatggcctgggctctgctcctcctccaccctcctcactcgagggcacgcgggtcctcgggcccagtctcgccctgactcacgccctccctccggcggtcccgggtctccgtaggacagtcacgtccaccatctccgngacctacgtaggaaccnggcaggtcgacggtttgggttacgttaataactntcgtcctcgtacgaccaacncgccaaccgagaccaaacnccccgtaaancatagatttagngacgtanagacgccgccaggccggtcnngtcgtctctgcgctacgacgtcgacgaccacgcgtccctccttacgcccgtttgccgggtcggacctcggtaggtcgaggtacggtaggtacggcggttatagttacgttaacgttcacggtcacggtcctattaacggatacgaccggtaagacgtaacgaaaccgtaagtttacggagggttacggtaagggttcccggggaaacggtccggaaaccgtcgtacccggtacggtcccggtttacggaccgtacgaaccccgggtaccgtaccggtccccctcccgggtcccccttacccggg

SEQ ID NO: 292596 - DNA, 678 bp, Homo sapiens
  misc_feature: GYAE6OF01B1QLY.48.26.C04.1.454.CMB.1.raw
  modified_base (232)..(232): a, c, t, g, unknown or other
  misc_feature (232)..(232): n is a, c, g, or t
  modified_base (254)..(254): a, c, t, g, unknown or other
  misc_feature (254)..(254): n is a, c, g, or t
  modified_base (258)..(258): a, c, t, g, unknown or other
  misc_feature (258)..(258): n is a, c, g, or t
  modified_base (274)..(274): a, c, t, g, unknown or other
  misc_feature (274)..(274): n is a, c, g, or t
  modified_base (311)..(311): a, c, t, g, unknown or other
  misc_feature (311)..(311): n is a, c, g, or t
  modified_base (384)..(384): a, c, t, g, unknown or other
  misc_feature (384)..(384): n is a, c, g, or t
  modified_base (492)..(492): a, c, t, g, unknown or other
  misc_feature (492)..(492): n is a, c, g, or t
tcagagtatacatacacgaccggtgctcgatttagtctagcgactttgggtttggggggggtctcaggaggcagcgctctcaggacgtcaccaccatggcctgggctctgctcctcctcaccctcctcactcagggcacagggtcctgggcccagtctgccctgactcagcctccctccggcgtccggtctccgtggacaggtcagtcaccatctcctgccactcggaaccngcagtgacgtttggtagttaanactntgtcctctgtaccaancgccaccgaggacaacgcccccaatcgatgtacttgngagtcagtagccggcctcgacgggtcctggtatccgtcgttctcgttacggctaccgtagtcgtcgacgaacnccggtcctccgtcgtaccgttccgtcggtcggtcctacggacgtcgtagggtacgataggacgtccgtattactttacgtaccgtgactacgtctaccgtaagttcgngacccgtagggaccaaacggtacccgtaaagttaggttcccgggttaagggttccggttaaccgggggaaccgggtaaacgtacccggtaaacgttcccgggtacgttaacccccggtcggtaagacccggaaacccggtccgtacccgggtaccctaccccccggtttcccgaaggtttcccccg

SEQ ID NO: 292597 - DNA, 728 bp, Homo sapiens
  misc_feature: GYAE6OF01BQVQZ.48.26.C04.1.454.CMB.1.raw
  modified_base (210)..(210): a, c, t, g, unknown or other
  misc_feature (210)..(210): n is a, c, g, or t
  modified_base (246)..(246): a, c, t, g, unknown or other
  misc_feature (246)..(246): n is a, c, g, or t
  modified_base (276)..(276): a, c, t, g, unknown or other
  misc_feature (276)..(276): n is a, c, g, or t
  modified_base (340)..(340): a, c, t, g, unknown or other
  misc_feature (340)..(340): n is a, c, g, or t
tcagagtatacatacacgaccggtgctcgatttagtctagcgactttgggtttggggggggtctcaggaggcagcgctctcaggacgtcaccaccatggcctgggctctgctcctcctccaccctcctcactcgagggcacgacgggtcctcgggcccagtctcgccctgactcacgccctccctccgccggtccggtctccgtggaacngtcagtccacctatccgtctgccacgtacggaaccngctagtacggtggttggtagttaataattntcgttacctccgtacggtaaccacacggaccaaccgacgaccgaaaccaccccgtaatctagtntattgacgtagtacgagtacggccgtaccgtaggtccggtcctggtactccgtcgttacgccgtacgtaccgtacgtacgtacgtaccgaacgacccgtcggtaaccccttccggtaccgtaccgttccgtcgttcgggacctacggtggtacgtaggtacgtacgtacgaggtacttacgttacgttcgtacgtcgtacggtataccgtatagttacgaacgtcgaacggacaccggtaaactaagggttactaacgggtggtaccggttcggggaaccggtaccgggtacgtacgggttccgtacggttaacccggtacgtttacggacccgaacccgggtacgtaacccgtaccccggtttccccggacccgtaccgttaccccg

SEQ ID NO: 292598 - DNA, 648 bp, Homo sapiens
  misc_feature: GYAE6OF01B3K0S.48.26.C04.1.454.CMB.1.raw
  modified_base (252)..(252): a, c, t, g, unknown or other
  misc_feature (252)..(252): n is a, c, g, or t
tcagagtatacatacacgaccggtgctcgatttagtctagcgactttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtgttataactntgtctctgtaccaacagcaccaggacaaacgcccccaaagtcatgatttatgaggtcagtaagccggccctcgacggggtccctgactcgtcttctcgtggcctaccaagtcgtcggacaaccgaccggtccctccctcgtacccgtctcgtgggccttcccgaggtctagggacggtagtggacggtcttagtactttacttaacgtcggactacggtccttacgtaattacgtcggacgtagggaccaacgtacaaacgtaagtttcggtacggttacggtttcggggaccgggagggtaacccgaaggtccgttacgggacccgttccgttaacgggtccgaccggtaccccgtaacgggtcccgttcccggtccccccgttcgggttacccg

SEQ ID NO: 292599 - DNA, 656 bp, Homo sapiens
  misc_feature: GYAE6OF01EWP1H.48.26.C04.1.454.CMB.1.raw
  modified_base (250)..(250): a, c, t, g, unknown or other
  misc_feature (250)..(250): n is a, c, g, or t
  modified_base (255)..(255): a, c, t, g, unknown or other
  misc_feature (255)..(255): n is a, c, g, or t
  modified_base (271)..(271): a, c, t, g, unknown or other
  misc_feature (271)..(271): n is a, c, g, or t
  modified_base (304)..(304): a, c, t, g, unknown or other
  misc_feature (304)..(304): n is a, c, g, or t
tcagagtatacatacacgaccggtgctcgatttagtctagcgactttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtgttanaactntgtctctgtaccaacngcaccagacaaacgccccaaagtcatgatttangagtcagtaacgcggcctgagggtccctgactcgcttctcgtcggctccgaagtcgtcggaccaacgaccggcccttacccgtcggtacccgttcgtcgtcgggcccttacccggaaggtccgttaggaaacggtattcgggaacggtaccttaggtaaacttttaacgtttaccgtacggtaccgtaagtcccgttactaagttaacgtcggaccgtaagggtaccaacgggaacctaaacgtaagttcgggttacggttaacggttcggggtaggaacgggtaaccaaggtccgtacgtacccgttacgtacgtacgaccggtaacccgaaggtccctccggtacccccg

SEQ ID NO: 292600 - DNA, 991 bp, Homo sapiens
  misc_feature: GYAE6OF01C2Q0T.48.26.C04.1.454.CMB.1.raw
  modified_base (232)..(232): a, c, t, g, unknown or other
  misc_feature (232)..(232): n is a, c, g, or t
  modified_base (756)..(756): a, c, t, g, unknown or other
  misc_feature (756)..(756): n is a, c, g, or t
tcagagtatacatacacgaccggtgctcgatttagtctagcgactttgggtttgggggctggggtctcaggaggcagcgctctcaggacgtcaccacatggcctgggctctgctcctcctccaccctctcactcgaggcacgagggtcctggcccatctcgccccgtgaacctcacgtccctcccgcggtccggtccggtctcgtaggacactcgagtccaccattcctccngacctacgtacggaacctagaccgtggttgtacgggtttaggtacgttactaaacgtacgttcgttccgtaccgttaacggttaacccgaaaaccgaacgccccgaaaccggtaacgggtaaaccccaaaaacccggtaaaccccccgtaaaaggttaacccgttaaacggtttaagtttaaaaccgtttttacggtaaggggttaacccggtaaccggttttaaaaccggtaaccgggacccccgggttaacccccgggttttaacccgggaacccggggggttttccccaacggttaaccggttttccgttccgttttcccgtttaaccggtcggttaacccccgttaacgttaaccgggttaccggtaaccgggtaaacccgtaacccggtaccccgttcccgtaacccggttaacgtcccggttaccgtaaccgggtccgttacccgacggtacggtacgtacgggaagtaccggttagggtaaccttggtttaactttacgtttaaccggttaaacggnttaacccggttaataccggtttaccaacggtttcgaacggtaccggttaaggacccgtaagggaacccttaaacggtttaaggcggtttaacggggtccgtaacggggtaacccggggtaagtaaaccccggtacggtccggtaaacccgttacccggttaaacccgggttcggaaacccgggtaaaacgtcccccggggtaaacttcccccggtcccggttaaacccccccggg

SEQ ID NO: 292601 - DNA, 633 bp, Homo sapiens
  misc_feature: GYAE6OF01CISI4.48.26.C04.1.454.CMB.1.raw
  modified_base (332)..(332): a, c, t, g, unknown or other
  misc_feature (332)..(332): n is a, c, g, or t
  modified_base (474)..(474): a, c, t, g, unknown or other
  misc_feature (474)..(474): n is a, c, g, or t
tcagagtatacatacacgaccggtgctcgatttagtctagcgacttttggggtttggggggggtctcaggaggcagcgctctcaggacgtcaccaccatggcctgggctctgctcctcctcaccctcctcactcagggcacagggtcctgggcccagtctgccctgactcagccctccctccgcgtccgggtctccgtggacagtcagtcaccatctcctgcactggaaccagcagtgacgttggtagttataacgtattcgtccttcctaggtaacccaacgacgccacccgaggaccaaacgacccccaaagtcatgtatttatgacgtnagtaacgccggcctcgacgggtccctgactccgtcttactcgtcggcctacgagttcgtcggacaaccgaccggtccctcccgtgtacccgttctcggtcggcctccgaggtctaggagatcggagtctagtattagttacngactcgctacgatacgtcgcgaagaccaagactaaacacggttggtacggtttaacggtcggggacggaaccgggtaaccgaagtccgtaacggtacccggtacgtacggtaccaccggtacccgaacggtcccgtcccgtcccccggttggtaacccc

SEQ ID NO: 292602 - DNA, 780 bp, Homo sapiens
  misc_feature: GYAE6OF01DMY8X.48.26.C04.1.454.CMB.1.raw
  modified_base (231)..(231): a, c, t, g, unknown or other
  misc_feature (231)..(231): n is a, c, g, or t
tcagagtatacatacacgaccggtgctcgatttagtctagcgactttgggtttggggggggtctcaggaggcagcgctctcaggacgtcaccaccatggcctgggctctgctcctcctcaccctctcactcagggccacaggggtcctgggccccagtctcgccctgactcagcctccctccgcgtccggtctcctggacagtcagtcaccatcctcctgcactggaaccngctagtgacgttggtagttaataacgtattcgtacttaccgttggttaaccaacgaacggaccaccctaagggaccaaacgaccccctaaagtccaagttagtacttttagagtaacggtcgtaagttaacggccggtccgtacgaacggggttccctaggtactcgtcttctacgtcggtaccttcgtaaacgtccgttacgaccgaaaccggaccggtaccccttccggtacgaaccgtaaacttccgtacggttacgggaccttaccggacggtacgtagggtaaacgggacggacggtaccttagtaacgttttacgttacgtttcgaccgtttgaccgttacaagtttacgtcggtaacgtacgggtttaacggttaaccgtttacgggttcgggttcgtttaccgggacggtaagggaaaccgggtacctaacggtaccgttacgtaaacccggttccggtaggtaacccaccgggtaccccgtaaacgggtcccgtttaaccccggtcccccggttacggtacccgttcccgttacccccgg

SEQ ID NO: 292603 - DNA, 813 bp, Homo sapiens
  misc_feature: GYAE6OF01DJLMA.48.26.C04.1.454.CMB.1.raw
  modified_base (203)..(203): a, c, t, g, unknown or other
  misc_feature (203)..(203): n is a, c, g, or t
  modified_base (208)..(208): a, c, t, g, unknown or other
  misc_feature (208)..(208): n is a, c, g, or t
  modified_base (277)..(277): a, c, t, g, unknown or other
  misc_feature (277)..(277): n is a, c, g, or t
tcagagtatacatacacgaccggtgctcgatttagtctagcgacttttggggtttgggggggggtctcaggaggcagcgctctcaggacgtcaccaccatggcctgggctctgctcctcctcaccctcctcactcgagggcacgacgggtcctgggcccagtctcgccctgactcacgccctccctccgcgtccgggtctcgnggacngtcagtcaccatcctcctgccacgtacggaaccagctaggtcggtacggtttggttagttaactaactnttacgtcctcgttacggaaccaacgacgaccaccgaacggaaccaaaacccggaccccgtaaagtctaagttgttaattttaggacggtacggttacgaacggtaccggtcccggtacccgtacgggtaccgggttaccctggtacccgttccgtcctttccgtcgtcgtacccgtaacgtacggtcgtacggaacccaaccgtcccggtccccttccgtaccgggtacccttcggttcggtcgggcctaccggaggtcgtacggaggtacgtaggtacgtacgttagttaacgttacgttacggctaacggcttaccgtacgttagtacggtacggcggtacggacgtaaaccgtaacttaaaacgggttgttaacgggttacgggtaaccgggttaccggggtaaccgggaaaccggtaaacccggttacggttaccgtaaccccgggtttaaccggtccggttaaaccggccccggtaaacccgtaccgggttcccgaccccgtttaccccgggaccccgtttcgtaaccccg

SEQ ID NO: 292604 - DNA, 734 bp, Homo sapiens
  misc_feature: GYAE6OF01AB3JM.48.26.C04.1.454.CMB.1.raw
  modified_base (177)..(177): a, c, t, g, unknown or other
  misc_feature (177)..(177): n is a, c, g, or t
  modified_base (210)..(210): a, c, t, g, unknown or other
  misc_feature (210)..(210): n is a, c, g, or t
  modified_base (228)..(228): a, c, t, g, unknown or other
  misc_feature (228)..(228): n is a, c, g, or t
  modified_base (252)..(252): a, c, t, g, unknown or other
  misc_feature (252)..(252): n is a, c, g, or t
tcagagtatacatacacgaccggtgctcgatttagtctagcgactttgggtttggggggggtctcgaggaggcagcgctctcgaggacgtcaccaccatggcctggctctgctcctcctcaccctctcactcaggcacagggtcctgggcccagtctgccctgactcacgcctcccncgcgtccggtctacgtggacagtcagtcacctntctcctgcacgtggaccngcagtgacgttggtgttaatactntcgttcctccgtaggtaccaacgtcgccaaccgtacggtaccaaaaccggccccctaaaggttccaattagtaacttttagtacgtacggtactaaggttaaccggccggtaccccgttaggaccgggttccctagtaccttccgtacgtttcgtcggtacggtccttaacccgtagggttcccgtggaacccgtaaaccgtcccgggtaccccttcccgtaacggtacccttagtacccggttcggtccgggtccttaccgacggtaccgtaaggacgggtaacgtacgggtacgtccgttaagttaccgttttaacgtccgtggtaccgttatccgttaactacgttacgttcggacgtaacgtacgttaacgcgtttaacgtcgggtttcgtaccgggttcggacgggtaacgacgtacgtcgtaacggtcctcggtaccgcctacggacggttacgcccgtcccgtcggtcttacccg

SEQ ID NO: 292605 - DNA, 752 bp, Homo sapiens
  misc_feature: GYAE6OF01DXKNV.48.26.C04.1.454.CMB.1.raw
  modified_base (605)..(605): a, c, t, g, unknown or other
  misc_feature (605)..(605): n is a, c, g, or t
tcagagtatacatacacgaccggtgctcgatttagtctagcgactttgggtttggggggggtctcaggaggcagcgctctcaggacgtcaccaccatggcctggctctgctcctcctcaccctcctcactcagggcacagggtcctgggcccagtctgccctgactcacgccctcctccgcgtccgggtctcctggacagtcacgtcacctatcctcctgccacgtcggaacccagcaggttcgtacggttgggttagttaataactagtcgtcctccgtacggtaaccaacacgaccaacccgaggaccaaaccgacccccaaagtcctaagtctaatttagtcggtaacggttacgtaacggtaacggcccggtacccgtacgggtaaccggggttccctacggtaccgttcccgtaccgtttccgtccggttacggtccccttaaccgtaacggttcccgttacggaaccgtaaacccgtcccgggttcccccttcccggtaccgtaccccgttccgttccgggcgggtcctaccggacggtacgtacgggaggtagtcggtacggtacttagtaaacgttttctacgtcggcctacgtctntaagcgtcgacgacggctaacgactaacgtagtcggttaggtacgtcgggacggtaccggaaacgtgtaccgtccgtaaacccggttcgaaccggtacgaccggtaacccgtacggtacccctccccggtccccgttacggtacccg

SEQ ID NO: 292606 - DNA, 973 bp, Homo sapiens
  misc_feature: GYAE6OF01BGY7K.48.26.C04.1.454.CMB.1.raw
  modified_base (131)..(131): a, c, t, g, unknown or other
  misc_feature (131)..(131): n is a, c, g, or t
  modified_base (223)..(223): a, c, t, g, unknown or other
  misc_feature (223)..(223): n is a, c, g, or t
tcagagtatacatacacgaccggtgctcgatttagtctagcgactttgggtttggggggggtctcaggaggcagcgctctcaggacgtcaccaccatggcctggctctgctcctcctcaccctcctcactnagggcacgagggttcctcgggcccagtctcgccctagacctcacgccctccctccgcgttccgggtctccgtggactagtcacggtcacctntcctccgtcgacacgtacgaaccagcaggtcgtacggtttggtgttaactaacttcgtccgttcgttaccgtacggtaacccaacgtaccggccctaacccgacggaccaaaaccccgacccccgtaaagtccgtaagttacgttaacgttttacggtaggtaacggtacggtaaacggtaaccggtcccggtccgtaaccggggtacccgggttacccgttagggttaccctccgttccggttaccggttcccggtaccggttacccttaaacgggttaaccggttccgggtaaccggtacccgaaaacccgggttaccccgggtttccccccgtttacccgggttaacccgggttacccccgtttacccgggggtccgggtttacccgggttacccccgttacccgggtacgggttaccggttaacggggtaacggttaaaccgggttgggttaacgggttacccgttaaggttaacttttaacccgttttacggaccggttacgtaacggttccccgtttaaagttaaccggttacgtaccgggttaacggtaacctaaccgggaaacccgttaaccgttaaaaccgttgggttttaacccggttaacgggttaaccggcggggtaaaacccgggttcgggaaaaccccgttacggtaccgttacccggtaacggtccgttaaacccggaggtttaccccgaccggtacccggtaccgttccccccgggactttcgggtaacccccc

SEQ ID NO: 292607 - DNA, 678 bp, Homo sapiens
  misc_feature: GYAE6OF01B8RF4.48.26.C04.1.454.CMB.1.raw
  modified_base (232)..(232): a, c, t, g, unknown or other
  misc_feature (232)..(232): n is a, c, g, or t
  modified_base (251)..(251): a, c, t, g, unknown or other
  misc_feature (251)..(251): n is a, c, g, or t
  modified_base (255)..(255): a, c, t, g, unknown or other
  misc_feature (255)..(255): n is a, c, g, or t
  modified_base (257)..(257): a, c, t, g, unknown or other
  misc_feature (257)..(257): n is a, c, g, or t
  modified_base (270)..(270): a, c, t, g, unknown or other
  misc_feature (270)..(270): n is a, c, g, or t
  modified_base (310)..(310): a, c, t, g, unknown or other
  misc_feature (310)..(310): n is a, c, g, or t
tcagagtatacatacacgaccggtgctcgatttagtctagcgactttgggtttggggggggtctcaggaggcagcgctctcaggacgtcaccaccatggcctgggctctgctcctcctcacccctcctcactcagggcacagggtcctgggcccagtctgccctgactcacgcctccctccgcgtccgggtctccgtggacagtcagtcaccatcctcctgcacgtgaaccngcagtgacgttggtgttanactntntctctgtacaacngccacccaggacaaacgacccccaaagtcatgtattttanggtagtcgaagtagcccggcctcggtacggggtccctagtacctcgtacttccgtcgtcgtcctaaccgagttccgtggacctaaccgccggtcccctcccgtacgtaccgtccgtcgtcgggcctaccgaggtcgtaggaacggtagtcggaacggttctacggttaatttaacgttaccgtcgtacctaagtccttacgtaactacgtcgtaccgaggactaaacgacccttaaagtagttagggtttcggttaggtaccgggaacgggacggaaccgtaaacggtcctaccgggtacccgttacggtaacccgttacgacccgtaccgggaacgtcccctacccggtcccccgtaccgttacccg

SEQ ID NO: 292608 - DNA, 819 bp, Homo sapiens
  misc_feature: GYAE6OF01A41ET.48.26.C04.1.454.CMB.1.raw
tcagagtatacatacacgaccggtgctcgatttagtctagcgactttggggtttgggggggggtctcagggaggcagcgctctcaggacgtcaccaccatggcctgggctctgctcctcctcaccctcctcactcagggcacagggtcctcgggcccagtctgccctgactcacgccctccctccggccggttccgggtcctccgtggacagtcacgtccacctatcctcctgacacgtacggaaccagactagtacggtacggttggttagttaataacttatcgtcgttccgtacggtaacctaacacgtaccaccgaacggaccaaaccgacccctaaaggtcagttacgtatttacgtgggaacgttacgtaaggaacggtccgtaccggtcggacggggttacctacggtacttccggtcttccggtcgtacggtacctacgggtacgtccgagtaacccgaaccgtaccgtacccgtccgtaactaccggtcgttaccggcgggtacccgtacggagggttccgtaacggggtaggaacgttcgggtaaccggttaagttacgttaacgtttaccgttactacgggtaccacgttcctagtactacgtaccggacggtacgtaccgtaagtaacccgtaaaaggttcggtaacgggttacgggtttacggggacccgggtaaaaccggggtcgtaaaacccggtacgggttaaccggtacccgtttaaccgggtaacggtaacccgggtaacccgaccgggtaaacccggacggttaccccgggtcccgttaacccccggttacggtaccccg

SEQ ID NO: 292609 - DNA, 634 bp, Homo sapiens
  misc_feature: GYAE6OF01BD1MU.48.26.C04.1.454.CMB.1.raw
  modified_base (194)..(194): a, c, t, g, unknown or other
  misc_feature (194)..(194): n is a, c, g, or t
  modified_base (230)..(230): a, c, t, g, unknown or other
  misc_feature (230)..(230): n is a, c, g, or t
  modified_base (254)..(254): a, c, t, g, unknown or other
  misc_feature (254)..(254): n is a, c, g, or t
  modified_base (311)..(311): a, c, t, g, unknown or other
  misc_feature (311)..(311): n is a, c, g, or t
  modified_base (616)..(616): a, c, t, g, unknown or other
  misc_feature (616)..(616): n is a, c, g, or t
tcagagtatacatacacgaccggtgctcgatttagtctagcgactttgggtttggggggggtctcaggaggcagcgctctcaggacgtcaccaccatggcctgggctctgctcctcctcaccctcctcactcagggcacagggtcctgggcccagtctgccctgactcagcctccctccgcgtccggtctccgnggacagtcagtcaccatcctcctgcacgtggaaccngcagtgacgttggtagttatactntcgtctcgtgtaccaacacgcaccgaggacaaacgaccccaaagtcatgtatttagngtagtacaaggtacgccggtccgtacggtacgggtccctagtacgtcctcgttccgtcgtcgtcctacgtaacgtcgtacggaccaaccgtccgtacccttcccgtacggtacgtcccgtcggtcgggtcctaccggtacgtacgtacggacggtagtcggaacgtcgtaagttaacttacgtacgtcgaccgtacgtacgtacgtagtacgcgacgacgtaccagaactaactaggtcggtacgtacggtcggacggtacgacctacggcgtacgtccgtcgacgacgaccgaccgtacggccncccgttccgtcgtacccg

SEQ ID NO: 292610 - DNA, 970 bp, Homo sapiens
  misc_feature: GYAE6OF01EVI2B.48.26.C04.1.454.CMB.1.raw
  modified_base (477)..(477): a, c, t, g, unknown or other
  misc_feature (477)..(477): n is a, c, g, or t
  modified_base (576)..(576): a, c, t, g, unknown or other
  misc_feature (576)..(576): n is a, c, g, or t
tcagagtatacatacacgaccggtgctcgatttagtctagcgactttggggtttgggggggggtctcaggaggcagcgctctcaggacgtcaccaccatggcctgggctctgctcctcctcaccctcctcactcagggcacgagggtcctgggcccagtctgccctgactcacgccctcccgtccggcgtccgggtctaccgtggactgtcacgtcacctatctcctgcctacgtacggaaccagcctaggttcggtacggtttgggttacggttaactaacgttagttcggttaccttaccgtacggtaaacccaacgtacgacccgaaccgaacgggaacccaaaaacccggtaccccccgtaaaaggtcctaaagttacggttaacgttttaggacgggttaacggtacgtaacggttaaccggcccggtacccgtacggtaccggggttacctacgtactccgttcgtttacncggtacgtaccgtaccgtaaggttccggtacggtaacccaaccggtaccggtccctacccggttccgtacccgttcgtcggttaccggcccgttaccgngggttaccgagggacgttacggacgggtaacgttacgttaagtttaacgttttaaccgtacgtacggtaccttaaccgggttcttaaccggtaacttacgggtaccggtaacgggtaaaccgtaccgtaaccggttaaaacccgtaaaagggttttcgggttaacggggggtttaacccggggtttaaccgggttaccccggggggggaaacggttaaaaaccccgggggtaacccgttaaacgggggttcccccggtttaaacccgggttaaccccgggttaaaccgttaacccgggggtaacccccaaaccccggggggttaaaccccggttacccgggttaacccccgggttcccccccggtaaccccggggtttccggttaaacccccgg

SEQ ID NO: 292611 - DNA, 701 bp, Homo sapiens
  misc_feature: GYAE6OF01B0SF2.48.26.C04.1.454.CMB.1.raw
  modified_base (210)..(210): a, c, t, g, unknown or other
  misc_feature (210)..(210): n is a, c, g, or t
  modified_base (230)..(230): a, c, t, g, unknown or other
  misc_feature (230)..(230): n is a, c, g, or t
  modified_base (260)..(260): a, c, t, g, unknown or other
  misc_feature (260)..(260): n is a, c, g, or t
  modified_base (328)..(328): a, c, t, g, unknown or other
  misc_feature (328)..(328): n is a, c, g, or t
  modified_base (387)..(387): a, c, t, g, unknown or other
  misc_feature (387)..(387): n is a, c, g, or t
  modified_base (425)..(425): a, c, t, g, unknown or other
  misc_feature (425)..(425): n is a, c, g, or t
  modified_base (457)..(457): a, c, t, g, unknown or other
  misc_feature (457)..(457): n is a, c, g, or t
tcagagtatacatacacgaccggtgctcgatttagtctagcgactttgggtttggggggggtctcaggaggcagcgctctcaggacgtcaccaccatggcctggctctgctcctcctcaccctcctcactcaggctacagggtcctgggcccagtctgccctgactcagcctcctccgcgtccgggtactcctggacagtccagtcaccntctcctgctacgtggaaccngcgtagtgtacggttggtagttataacgtntggtactccgtggtaccaacacggaccaccaggaccaaaaccgccccaaagtcattacgtatttacgngtacggtacacggtaacgccggtacctacggtacgggtccctagacgtccgtagttccncgtcgtactcgtaatcgtcgacaaccgtcgccctccgngtacccgtcgtcgtcgggtacctccgacggtntacgggacgactgggtacgacttaggtaacttttacgacgtcggaccgtacggtcccttaagtacggttaacctcggtacggaaaccgcgttaacgggaaactaccgttagtacgggttcggtaacgttccgggacggttaaacggacccgttacggaccgtttaccgggaacccgttaccgaggtaccccggaacgtacccgggttaccggttccaaccccgggtccccgttacgtaaccccg

SEQ ID NO: 292612 - DNA, 722 bp, Homo sapiens
  misc_feature: GYAE6OF01BUD0P.48.26.C04.1.454.CMB.1.raw
  modified_base (205)..(205): a, c, t, g, unknown or other
  misc_feature (205)..(205): n is a, c, g, or t
tcagagtatacatacacgaccggtgctcgatttagtctagcgactttggggtttgggggggggtctcaggaggcagcgctctcaggacgtcaccaccatggcctgggctctgctcctcctccaccctcctcactcgagggcacgacgggtcctcgggccctagtctcgccctgactcacgccctcccgtccgcgtccggtctcgnggacagtcacgtccacatcctctcgctacgtacggaaccagtcgtaggtggtacggttggttagtaacttaatacgttgtccttccgtacggtaaccaacgacgaccaacccgaggaacccaaaccggaccccctaaagtcaagttacgttaatttagaggacggttacaacggtacggcccgtaccgtcggacgggtccctgacctcggtccttctcggcgtacctacgacgtcgtacgaacctacgacccgtcccttaccgcgtaccgtcgtcgtcggcctcggagtcgaggtagcgaggtacgtgtaacgttattacgtagctaccgtatcgactggtaacgtcggaacgtacggacctaacgaacttaaggtagggtacggtttcgggtaacggtacgggggtaaccgaacgggacccgtaaggtccggtaacccggtcccggttacggtaacccggtaccgaaaccggttccggacccgtaccccggtccccgtccccggttccgttacccg

SEQ ID NO: 292613 - DNA, 862 bp, Homo sapiens
  misc_feature: GYAE6OF01A0Z1B.48.26.C04.1.454.CMB.1.raw
  modified_base (216)..(216): a, c, t, g, unknown or other
  misc_feature (216)..(216): n is a, c, g, or t
  modified_base (478)..(478): a, c, t, g, unknown or other
  misc_feature (478)..(478): n is a, c, g, or t
tcagagtatacatacacgaccggtgctcgatttagtctagcgactttgggtttggggggggtctcaggaggcagcgctctcaggacgtcaccaccatggcctgggctctgctcctcctcaccctcctcactcgagggcacagggtcctgggcccagtctcgccctgactcagccctccctccgcgtccgggtctccgtggacagtcagtccaaccntcctcctgcacgtcggaaccagcgtaagtgtacgttgggttagttaactaactgttcgtccttccgtacggtaaccaagaccgaccaacccgtaacggaccaaaacccggaacccccaaaaggttcctaacgttacgttaaattttaggtacggtacggttaccgaaacgggttaaccggcccggtaccccgttacgggtacggggttacccctaggtacgttcccgtcctttcgtcgtaccggtcctaaccgtagttccgnggaaccctaccggtaccgtcccttacccgtacggtaccgttcccgtcggtccgggtaccttacggacgggtacttacggggaagtacggtacgaccgggttacgttaacggtttaacttttaaccgttcgggtactaacgtccgtttacgtactaacgtttaaccggtaaccggaggttaccgggaacctaacgtaaaccggtaaacgtttagggttaacgggttacggggtaacccgggtacggggaaaccgggggttcccgttaaaacgacggtcccgggtttaaacccacccgggttacggttaaccggaacccccgtaccggtaaccccggaacccggtttcccccgggaaacccctttcccgggtaccgttaaccccgg

SEQ ID NO: 292614 - DNA, 722 bp, Homo sapiens
  misc_feature: GYAE6OF01CNM6R.48.26.C04.1.454.CMB.1.raw
  modified_base (261)..(261): a, c, t, g, unknown or other
  misc_feature (261)..(261): n is a, c, g, or t
  modified_base (526)..(526): a, c, t, g, unknown or other
  misc_feature (526)..(526): n is a, c, g, or t
tcagagtatacatacacgaccggtgctcgatttagtctagcgactttggggtttggggggggtctcaggaggcagcgctctcaggacgtcaccaccatggcctggctctgctcctcctcaccctctcactcgagggcacgagggtcctacgggccctagtctcgccttgacctcgacgtccctcccgtcgtcgtcgttcgggtcctccgtagggactcggtccagttaccaccgtatcctccgtacgacacgtaggaaccnggcgtagtcggtacggtttggtagtactaacttgtcgttactccgtagtaccacgagccaccgagaccaaccgaccctaagtcagtacgttaattgaggtacgtacgaaggtaccgccggtacctacgggtacgggtacctgtccgtaccgttcttacgtcgtacgtactaccgagttccgacgtaccgaccgtccggttccctacgtccgtaccggtcgtcgttaccgggtccacggtacggagtacggacggtacgtaacggngttaacttggttaacctttagaccgtgacctcgacgtacaagtcggaacgcgtaacggactacggtaaactacggttagttacgggtacggtttacggccggggaaacggtaacgtacggtaccggtcggttaaccggacccggttaacgaccgtacggaaccggtccaccgggtttcccgccggttccgtacccg

SEQ ID NO: 292615 - DNA, 704 bp, Homo sapiens
  misc_feature: GYAE6OF01DK9E0.48.26.C04.1.454.CMB.1.raw
  modified_base (232)..(232): a, c, t, g, unknown or other
  misc_feature (232)..(232): n is a, c, g, or t
  modified_base (330)..(330): a, c, t, g, unknown or other
  misc_feature (330)..(330): n is a, c, g, or t
tcagagtatacatacacgaccggtgctcgatttagtctagcgactttgggtttggggggggtctcaggaggcagcgctctcaggacgtcaccaccatggcctggctctgctcctcctcacccttcctcactcagggcacagggtcctgggcccagtctcgccctgactcagtccctccctcgcgtccggtctaccgtggacagtcagtcaccatcctcctgcatcggaaccngacagtgcgttggtgttaataactgtgtacctcgtacgtaccaagacgaccaaccgaggaccaaaccgacccctaaagtcctaagtcgtaatttacgnggtaacgtacaaggtacgccggtaccgtacggaacgggtccctaggtacttcggtcttcgtccgtacgtctacgtaacgtcgtacggaccaaacgccggtaccttcccgtacgtaccgtcgttcggtacggtccctacggacggtctaagggtacgtagtacggacggtacgtagttaagtttaacgtaacgtcgtactacgtacctacggtatacgtcgacgtaacgacgaacgtaacaaacttggttaggttacggtagggttccgggagggtaaaccggaaccgtaaggtcctaccgggtaaacccgttcggtaacggtaacggacccgtaaccggtaacgtacccggtcccgtcccggttcggtaacccg

SEQ ID NO: 292616 - DNA, 762 bp, Homo sapiens
  misc_feature: GYAE6OF01A88TK.48.26.C04.1.454.CMB.1.raw
  modified_base (227)..(227): a, c, t, g, unknown or other
  misc_feature (227)..(227): n is a, c, g, or t
  modified_base (242)..(242): a, c, t, g, unknown or other
  misc_feature (242)..(242): n is a, c, g, or t
  modified_base (513)..(513): a, c, t, g, unknown or other
  misc_feature (513)..(513): n is a, c, g, or t
  modified_base (525)..(525): a, c, t, g, unknown or other
  misc_feature (525)..(525): n is a, c, g, or t
  modified_base (589)..(589): a, c, t, g, unknown or other
  misc_feature (589)..(589): n is a, c, g, or t
tcagagtatacatacacgaccggtgctcgatttagtctagcgactttggggtttgggggggggtcacaagaggcagcgctctcgggacgtctccaccatggcctgggctctgctgctgttcatcctcctcactcgaggacacagggtcctgggcccagtctgccctgactcagtcctgcctcatcgtcgtcgggttctcctagacagttcgatccaccgtctaccgngcctagtcggaaccngacagtgagttggttcggggactttatcggtacctttgttccttccgtagtaaccaaccaaccgaccgacggacctaaaccgaccccctaaagtttcttagtacgtttacgagacgatacctacggtaacgccgtacctcgttacggtccgtttaactacgttccgtccgttatccgtcgaccttacctaggtacctcggaacgtaacccgtaccgggtcccccttacaacgtaccttaactacggtcccggtaggccgtccgaacgggtntacgggaacggngtacggtacttggtttaacgtttacgttagtaccgtcgtacgttaccttagttaacggttacgnggtttaaccggggtcggtttaacttaaccggttcgggttttagggtcccgttaaaccggagggtaccgggaacgggtaaaccctcgggttaccttaagggtcccggttaaccggtaccggtacctacccggaacccgttaccgggtcccgttacccccggttcccggtaccgg

SEQ ID NO: 292617 - DNA, 642 bp, Homo sapiens
  misc_feature: GYAE6OF01A7YSS.48.26.C04.1.454.CMB.1.raw
  modified_base (272)..(272): a, c, t, g, unknown or other
  misc_feature (272)..(272): n is a, c, g, or t
  modified_base (307)..(307): a, c, t, g, unknown or other
  misc_feature (307)..(307): n is a, c, g, or t
  modified_base (341)..(341): a, c, t, g, unknown or other
  misc_feature (341)..(341): n is a, c, g, or t
  modified_base (362)..(362): a, c, t, g, unknown or other
  misc_feature (362)..(362): n is a, c, g, or t
  modified_base (393)..(393): a, c, t, g, unknown or other
  misc_feature (393)..(393): n is a, c, g, or t
  modified_base (416)..(416): a, c, t, g, unknown or other
  misc_feature (416)..(416): n is a, c, g, or t
tcagagtatacatacacgaccggtgctcgatttagtctagcgactttgggtttggggggggtctcaggaggcagcgctctcaggacgtcaccaccatggcctggctctgctcctcctcaccctcctcactcagggcacagggtcctcgggcccagtctgccctgactcagcctcctccgcgtccgggtctcctggacagtcagtcaccatctcctgcacgtacggaaccagcagtcgacgttggtagttatactatgtctctggtaccaacngccaccaggacaaacgccccaagtcatgtattagngaggtcagtacgccgcctgaccgggtcctgctcncttctcgtcgcctacagttcncgacgacgccggcctcccgtagacccgttcncgtcggcctcgagtcgtgacggngtacggtagccgttagtatttactacgtcgacgtacgtcacgtataacgttcggaccgagggtacaaccggtaactaaacggtaacgttcgggttagggttacgtccgggggaacgggtaccggaaccgttacggtcccggtacggttaccccggtaccgggttaccgcgtaacccgggtaccctaaccgggttcccctccccggttacccccggttgggtacccc

SEQ ID NO: 292618 - DNA, 808 bp, Homo sapiens
  misc_feature: GYAE6OF01C4VVB.48.26.C04.1.454.CMB.1.raw
  modified_base (617)..(617): a, c, t, g, unknown or other
  misc_feature (617)..(617): n is a, c, g, or t
tcagagtatacatacacgaccggtgctcgatttagtctagcgactttgggtttggggtggggtctcaggaggcagcgctctcaggacgtcaccaccatggcctgggctctgctcctcctccaccctcctcactcgagggcacgagggtcctcgggcccagtcctcgcccgtgacctcagccctccctccgcggtccggtctccgtggacagtcagtccaccatcctccgtgcctacgtggaaccagccgagtgtattgggttgggtacttatccggtactttcggtctccgttacggtaccaaaccaaccgaacccgtaaggaccaaaccgacccccgtaaacttccgttacgttaatttacgtaggactaacgttacgaaccgttaacggtccggaccctacggtacggtttacccgttttaacgtaaaccgttccgtaccgtttccgttccgttacggtaccgtacccgtaaacgttcgtttaccggaacccgaaaccgtacccgggtccccttacgtaacggtaacctaaacgttccgtcggtcggtacgtccgtaacgtcgtaggacgggacgtacggacgttagttagtttaagttcgttcgtcgttaccgnttaccgtaagttacggtcggttaacgtacgggtttaacgttaccgttacgggttcggggtttaacggtccggacgggtaacgggtaaccggaaaccgttacggtcgtaccgggttacccgttacggttacggacccgtaaccgcccgtaacggtcccgttccccgccccgggttacgtccttaaccccggg

SEQ ID NO: 292619 - DNA, 657 bp, Homo sapiens
  misc_feature: GYAE6OF01A60L6.48.26.C04.1.454.CMB.1.raw
  modified_base (198)..(198): a, c, t, g, unknown or other
  misc_feature (198)..(198): n is a, c, g, or t
  modified_base (229)..(229): a, c, t, g, unknown or other
  misc_feature (229)..(229): n is a, c, g, or t
  modified_base (459)..(459): a, c, t, g, unknown or other
  misc_feature (459)..(459): n is a, c, g, or t
tcagagtatacatacacgaccggtgctcgatttagtctagcgactttgggtttggggtggggtctcaggaggcagcgctctcaggacgtcaccaccatggcctgggctctgctcctcctcaccctcctcactcagggcacagggtcctgggcccagtctgcctgactcagcctccctccgcgtccggtctcctgtacngtcagtcaccatctcctgcacgtcggaaccngcagtcggtacgttggtagttaactaacttatcgtcctccgtacggtaaccaacgacgaccctaacccgaggaaccaaaaccgaccccctaaaagtccaagttacgtattttagacggtacggacgtaaggtaacggcccggtcctacggtacgggtcctgactccgtcttctcgtcgctacgtaacgtcgacggacaacgccgcctccgacgtaccgtctcgcggtacncgtaggcgaggtacgagtgaacggtcgtaacgttacgttacgttcgtcgtacgcgtactactagttcgtacgagtacgaccgaataacgtaactaggtcggtacggtacggtcggggaacggtagacccggtatcccggtaacgcccggttaacgtacgaccgtaccgtaccgacggccttccccgtaccccggttcg

SEQ ID NO: 292620 - DNA, 543 bp, Homo sapiens
  misc_feature: GYAE6OF02IN6Q9.48.26.C04.1.454.CMB.1.raw
tcagagtatacatacacgaccggtgctcgatttagtctagcgactttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgacccatctctgggctccaggctgaagatcaggctgatttattactgtctgttctattttctaagtttcctttttttgtctttcggaacgttcgggtaccgtaggtcaccgtcctaggtccagcccaaggccaacccactcgtcacctctcgttcccacctccc

SEQ ID NO: 292621 - DNA, 579 bp, Homo sapiens
  misc_feature: GYAE6OF02JD9ZN.48.26.C04.1.454.CMB.1.raw
  modified_base (311)..(311): a, c, t, g, unknown or other
  misc_feature (311)..(311): n is a, c, g, or t
  modified_base (341)..(341): a, c, t, g, unknown or other
  misc_feature (341)..(341): n is a, c, g, or t
  modified_base (464)..(464): a, c, t, g, unknown or other
  misc_feature (464)..(464): n is a, c, g, or t
tcagagtatacatacacgaccggtgctcgatttagtctagcgactttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagccacccaggacaaacgacccccaaagtcatgattangaggtcagtaagcggccctgacgggtcccngactcgcttctctggctaccaagtctggacaacgaccggtcctccctgacccgttctcgtcgggcctccgaggtccgtgaggatggacggtctgtattattacgtgtacgagctcgaattagngtccgaggccaagacaaacagttggtaggttacttacgggacggtaacgggaaccaagcgtaacgacccgttacgtacggtacaccggacccgaacggtcctaccggtcccccgg

SEQ ID NO: 292622 - DNA, 777 bp, Homo sapiens
  misc_feature: GYAE6OF02JVLAQ.48.26.C04.1.454.CMB.1.raw
  modified_base (734)..(734): a, c, t, g, unknown or other
  misc_feature (734)..(734): n is a, c, g, or t
tcagagtatacatacacgaccggtgctcgatttagtctagcgactttggtttggggggttcgttcgtaggaggcgagcgctctcaggacgtcaccaccatgcctggctctgctcctcctcaccctcctcactcaggcacaggtcctgggcccagtctgccctgactcagcctcctccgcgtccggtctcctggacagtcagtcaccatctcctgcactggaaccagcagtcgacgttggtgttataactagtgtctcctggtaccaactagcaccaggcaaagcccccaaagtcatcgattatgagtcaggtaagcggaccctcgacggggtccctgacgtcggtaccttcgttcgtcggtccttaccgtaagttccgttacgggacctaaaaccgtaccgggtaccccttccccgtttacggaacccccggtttccgttacccgttcgggggtccccttacccgtaacggggtcccgtttaagggaacggggaaacgttcgggaagggtacccgttagggttaacttttaaccgtttaaccggttcgtaccgtacgttacccgtaccgttaagtaacgtttccggacgtacgggtcctaaacggtacaaaccgttaaagttcgttacggggtaacgtttccgggggaccggtacgggtaaccgtaacgggtacccggtttaacgaaccccgggttccgttaaacggggtttcccaccgggttaaacccccggnggttaacccgtccccgggtaccccccgtttaccgggtaacccg

SEQ ID NO: 292623 - DNA, 503 bp, Homo sapiens
  misc_feature: GYAE6OF02HD0AE.48.26.C04.1.454.CMB.1.raw
  modified_base (403)..(403): a, c, t, g, unknown or other
  misc_feature (403)..(403): n is a, c, g, or t
  modified_base (456)..(456): a, c, t, g, unknown or other
  misc_feature (456)..(456): n is a, c, g, or t
tcagagtatacatacacgaccggtgctcgatttagtctagcgactttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggcctcaggggtccctgatcgcttctctggctccaagtctggcaacacggcctccctgaccgtctcgtgggctccgaggctgaggntgaggctgattattactgcagctcatatgcaggcagcaacatgtgtattcggnggaggaccaggctgaccgtctaggtcagccaggctcgcccctggtcc

SEQ ID NO: 292624 - DNA, 524 bp, Homo sapiens
  misc_feature: GYAE6OF02H9GWN.48.26.C04.1.454.CMB.1.raw
  modified_base (306)..(306): a, c, t, g, unknown or other
  misc_feature (306)..(306): n is a, c, g, or t
tcagagtatacatacacgaccggtgctcgatttagtctagcgactttgggtttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcaccaggcaaacgcccccaaagtcatgatttangagtcagtaagcgcctcgagggtccctgactcgcttctctggctaccaagtctggacaacgacggtccctccctgacccgttctcgtcgggcctcgaggctggaggatgagctagattattactgcagctcatatgcagcagacaacatgtagtagttcggaggacggacagctacgacgtcctaggcgacgacccgaaggtcctcgtccccgtgtcc

SEQ ID NO: 292625 - DNA, 546 bp, Homo sapiens
  misc_feature: GYAE6OF02HJ117.48.26.C04.1.454.CMB.1.raw
tcagagtatacatacacgaccggtgctcgatttagtctagcgactttgggtttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcagggtccctgatcgcttctctggctccaagtctggcaacacggcctccctgacccgtctcgtcgggcctccgaggctgaggatggaggctgattattactgcagtctcatatgcaggcagacaacagtgtaggtagttcgggacggtacgggaccaaggtcgtcggacccgttccgtacggtcgacggacccgaaggtcctaccggtccccctggtaccc

SEQ ID NO: 292626 - DNA, 529 bp, Homo sapiens
  misc_feature: GYAE6OF02F6I1N.48.26.C04.1.454.CMB.1.raw
  modified_base (437)..(437): a, c, t, g, unknown or other
  misc_feature (437)..(437): n is a, c, g, or t
tcagagtatacatacacgaccggtgctcgatttagtctagcgactttgggtttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaacgcccccaaagtcatgatttatgaggtcagtaagcggcctcgaggggtccctgatcgcttctctgctccaagtctggcaacacggcctccctgaccgtctcgtcgggctccgaggctggaggagtgaggctgtattattactgcagctcatntgcaggcagcaacagtgtaggtagttcgggacggaggacaggcgtacgaccgtcgtaggtcacggcccgaaggcctccgtccccgtggtacc

SEQ ID NO: 292627 - DNA, 536 bp, Homo sapiens
  misc_feature: GYAE6OF02JUR6P.48.26.C04.1.454.CMB.1.raw
  modified_base (308)..(308): a, c, t, g, unknown or other
  misc_feature (308)..(308): n is a, c, g, or t
  modified_base (379)..(379): a, c, t, g, unknown or other
  misc_feature (379)..(379): n is a, c, g, or t
  modified_base (438)..(438): a, c, t, g, unknown or other
  misc_feature (438)..(438): n is a, c, g, or t
tcagagtatacatacacgaccggtgctcgatttagtctagcgactttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaacgcccccaaagtcatgattangagtcagtaagcgcctcgagggtccctgatcgcttctcgtggctccaagtctggcaacacggccctcccgngaccgtctcgtcgggcctccgaggctggaggatgaggctgattatactgcagctacatntcgcaggcagacaactaagtggtagtagttcgggcggtaacgggaccaagtcgtacggaccgtcgtaggtcacgcccgaacggtcctccgtacccccg

SEQ ID NO: 292628 - DNA, 535 bp, Homo sapiens
  misc_feature: GYAE6OF02IMA69.48.26.C04.1.454.CMB.1.raw
  modified_base (435)..(435): a, c, t, g, unknown or other
  misc_feature (435)..(435): n is a, c, g, or t
tcagagtatacatacacgaccggtgctcgatttagtctagcgactttgggtttggggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtgttataactatgtctcctggtaccaacagcacccaggacaaacgcccccaaagtcatgatttatgaggtcagtaagcggccctcgacgggtccctgatcgcttctctggctccaagtctggacaacgaccggcctccctgacccgtctcgtcgggctccgaggtctggaggatggagctgtattattacgngcagtctacatatgacgaggcagacaacagtggtagtagttcgggacggaggaccagctacgaccgtcgtacgacacgaccgagcctcgccccgtgtacc

SEQ ID NO: 292629 - DNA, 497 bp, Homo sapiens
  misc_feature: GYAE6OF02JEIOH.48.26.C04.1.454.CMB.1.raw
  modified_base (248)..(248): a, c, t, g, unknown or other
  misc_feature (248)..(248): n is a, c, g, or t
  modified_base (253)..(253): a, c, t, g, unknown or other
  misc_feature (253)..(253): n is a, c, g, or t
  modified_base (306)..(306): a, c, t, g, unknown or other
  misc_feature (306)..(306): n is a, c, g, or t
  modified_base (325)..(325): a, c, t, g, unknown or other
  misc_feature (325)..(325): n is a, c, g, or t
  modified_base (364)..(364): a, c, t, g, unknown or other
  misc_feature (364)..(364): n is a, c, g, or t
  modified_base (402)..(402): a, c, t, g, unknown or other
  misc_feature (402)..(402): n is a, c, g, or t
  modified_base (413)..(413): a, c, t, g, unknown or other
  misc_feature (413)..(413): n is a, c, g, or t
  modified_base (424)..(424): a, c, t, g, unknown or other
  misc_feature (424)..(424): n is a, c, g, or t
  modified_base (446)..(446): a, c, t, g, unknown or other
  misc_feature (446)..(446): n is a, c, g, or t
  modified_base (463)..(463): a, c, t, g, unknown or other
  misc_feature (463)..(463): n is a, c, g, or t
tcagagtatacatacacgaccggtgctcgatttagtctagcgactttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttanaactntgtctcctggtaccaacagcacccaggcaaacgcccccaaagtcatgatttangagtcagtaagcggccctnagggtccctgatcgcttctctggctcaagtctggcaacncggcctcctgaccgtctcgtgggcctcgaggtctgagntgagctgattntactgcagctnatatgcagcagcaacatgtgtntcggcgaggacagctanaccgtcagtcacgccgagcctacgcccctggtcc

SEQ ID NO: 292630 - DNA, 520 bp, Homo sapiens
  misc_feature: GYAE6OF02F1MAX.48.26.C04.1.454.CMB.1.raw
  modified_base (345)..(345): a, c, t, g, unknown or other
  misc_feature (345)..(345): n is a, c, g, or t
  modified_base (364)..(364): a, c, t, g, unknown or other
  misc_feature (364)..(364): n is a, c, g, or t
tcagagtatacatacacgaccggtgctcgatttagtctagcgactttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtgttataactatgtctcctggtaccaacagcaccaggcaaagcccccaaagtcatgatttatgaggtcagtaagccggccctcgacggggtccctgatcgcttcnctgctcaagtctggcaacncgcctccctgaccgtctcgtggctccgaggctgaggatgaggctgtacttattacgtgacagcctcatatgacgaggcacgacaactaagtgtggttactcgggcggaggaccaagctagaccgtccgtagtcacgccgaagctcgcccctggtcc

SEQ ID NO: 292631 - DNA, 549 bp, Homo sapiens
  misc_feature: GYAE6OF02FZSHR.48.26.C04.1.454.CMB.1.raw
  modified_base (359)..(359): a, c, t, g, unknown or other
  misc_feature (359)..(359): n is a, c, g, or t
tcagagtatacatacacgaccggtgctcgatttagtctagcgactttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcaccaggcaaagcccccaaagtcatgattatgagtcagtaagcgcctcagggtccctgatcgcttctctggctcaagtctggcaacncggcctccctgacccgtctcgtgggcctccaggctgaggatgaggctgattagttactgcagctcatatgcagggcagacaacgaactggtacggtagttccgggcgggtacgggaccaaggcctacggacccgtccgttaacggtcgacgacccgaacgggccctacggtcccccccgtgggtaccccg

SEQ ID NO: 292632 - DNA, 573 bp, Homo sapiens
  misc_feature: GYAE6OF02GEMSG.48.26.C04.1.454.CMB.1.raw
  modified_base (228)..(228): a, c, t, g, unknown or other
  misc_feature (228)..(228): n is a, c, g, or t
  modified_base (393)..(393): a, c, t, g, unknown or other
  misc_feature (393)..(393): n is a, c, g, or t
tcagagtatacatacacgaccggtgctcgatttagtctagcgactttgggtttgggggggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtcaccatctcctgcactggaaccngcagtgacgttggtgttataactatgtctcctggtaccaacagcacccaggacaaacgcccccaaagtcatgtatttatgaggtcagtaagccggcctcgagggtccctgatcgcttctctggctacagtctggcaacacggcctcctgacctctctcggctcgngctgaggatggagctagtattacttacgtcgcagcctacattatcgactagtacgtagtacgacctacgtactagttcgttaggttacgttccgggacgggaacgggtaaccaacggtccgtacggtaccggttcccgttaggacctaccggaccctaagggtccttacccggtcccccg

SEQ ID NO: 292633 - DNA, 725 bp, Homo sapiens
  misc_feature: GYAE6OF02JE2HL.48.26.C04.1.454.CMB.1.raw
  modified_base (228)..(228): a, c, t, g, unknown or other
  misc_feature (228)..(228): n is a, c, g, or t
  modified_base (298)..(298): a, c, t, g, unknown or other
  misc_feature (298)..(298): n is a, c, g, or t
  modified_base (327)..(327): a, c, t, g, unknown or other
  misc_feature (327)..(327): n is a, c, g, or t
  modified_base (332)..(332): a, c, t, g, unknown or other
  misc_feature (332)..(332): n is a, c, g, or t
  modified_base (342)..(342): a, c, t, g, unknown or other
  misc_feature (342)..(342): n is a, c, g, or t
tcagagtatacatacacgaccggtgctcgatttagtctagcgactttgggtttgggggggtctcgaggaggcagcgctctcaggacgtcaccaccatggcctggctctgctctcctcacctcctcactcagggcacaggtcctgggcccagtctgccctgactcagcctcctcgcgtccggtctcctggacagtcagtcaccatctcctgcactggaaccagcaagtnacgttggtgttataactatgtctcctggtaccaacagcaccaggcaaagccccaaagtcactcgatttancgagtacagtaagcgcctcacgggtcccngtacncgtcttctcncgtctccaagtcctggaccaacgtaccggtcccgtacccgtcgtaacccggttcgttcgtacgggtccttcccgaagggtcccgttggaacgggacttgggacggtccttagggtacctttaagtttaccgaggtcctaaggtcctacgtaactttaaggccggacctaacggggttccaaacgccgtaaaaaccgtacgtttgggttacggggtttaaacgtttccggggaacgggttaccgggggtaaacccaaacgggtcccctaaacgggtacccccggttttaacccggttaagggtttaacccggaacccggttaacccccggaaaagggggttacccctcccggggtaacccccccgttacggggtttaaaccccc

SEQ ID NO: 292634 - DNA, 559 bp, Homo sapiens
  misc_feature: GYAE6OF02JBJ26.48.26.C04.1.454.CMB.1.raw
  modified_base (303)..(303): a, c, t, g, unknown or other
  misc_feature (303)..(303): n is a, c, g, or t
  modified_base (469)..(469): a, c, t, g, unknown or other
  misc_feature (469)..(469): n is a, c, g, or t
tcagagtatacatacacgaccggtgctcgatttagtctagcgactttgggtttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtgttataactatgtctctggtaccaacagcaccaggcaaacgcccccaaagtcatgattangagtcagtaagcgcctcgagggtccctgatcgcttctcgtcggctaccaagtctcggacaacgacggcctacccgtgacccgtctcgtcggcctccgaggctagaggtatggacggtctagtactttactacgttcgacacgctacattacgtgcgagcagacaanagtgtaggtacgtcgggacggacggaacgaagccgtacgaccggtcgtacggtacacggcccaacggcctccgtccccgtacggtacccg

SEQ ID NO: 292635 - DNA, 517 bp, Homo sapiens
  misc_feature: GYAE6OF02F5BL5.48.26.C04.1.454.CMB.1.raw
  modified_base (427)..(427): a, c, t, g, unknown or other
  misc_feature (427)..(427): n is a, c, g, or t
tcagagtatacatacacgaccggtgctcgatttagtctagcgactttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgattatgaggtcagtaagcggccctcgaggggtccctgatcgcttctctggctcaagtctggcaacgacggcctccctgaccgtctctgggctccgaggctgaggatgagctgattattactgcagctnatatgcaggcagcaacaagtgtgtatcgggcgaggaccaagctcgaccgtcctaggaccacgcccgaaggcctccgcccccgtggtaccc

SEQ ID NO: 292636 - DNA, 678 bp, Homo sapiens
  misc_feature: GYAE6OF02JQ3VT.48.26.C04.1.454.CMB.1.raw
  modified_base (267)..(267): a, c, t, g, unknown or other
  misc_feature (267)..(267): n is a, c, g, or t
  modified_base (298)..(298): a, c, t, g, unknown or other
  misc_feature (298)..(298): n is a, c, g, or t
tcagagtatacatacacgaccggtgctcgatttagtctagcgactttgggtttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtgttataactatgtctctgtaccacngcaccagcaaacgccccaaagtcatgattangagtcagtaagcgcctgacgggtcctgacgtcgtacttctcgtcggctccgtaagtcgtacggaccaacgtaccggtccctcctacggacccgttccgtccgtcggggtcctacccgacgggtccttacgggaacggtacgttagggaacgggtccttaagggttaacttttaacgttaacgtcggtacctaacggtccttacgtaacgttacgttcggaccgagggtccaaggtaacctaaacgttaagttcgggttaacggttaaccgttccggggaccgggtaacgggtaaccctaacgggtcctacgggtacccggttccgtacggtacgacccggtaccgaaccggtccctaccggttccccccgtaggttaccc

SEQ ID NO: 292637 - DNA, 629 bp, Homo sapiens
  misc_feature: GYAE6OF02HXUP6.48.26.C04.1.454.CMB.1.raw
  modified_base (314)..(314): a, c, t, g, unknown or other
  misc_feature (314)..(314): n is a, c, g, or t
  modified_base (344)..(344): a, c, t, g, unknown or other
  misc_feature (344)..(344): n is a, c, g, or t
  modified_base (460)..(460): a, c, t, g, unknown or other
  misc_feature (460)..(460): n is a, c, g, or t
tcagagtatacatacacgaccggtgctcgatttagtctagcgactttgggtttgggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtgttataactatgtctcctggtaccaacagccacccaggccaaaacgcccccaaagtcaatgaattttagngtaggtcagtaagcgccctcgacgggtccngatcgtcttctcgtgctcagtctagcaacgacgcctccgtcgacccgtctacgtcgggcctcccgaggtccgaggtacgggatggtaaggtccgttaggtaatttacgtttaacgnggtaccaagtccgttataacgttagtcgtacgaccgggtacacggaacctaaagtaagttcggttaggtaacgtttcgggacggaacgggacctaaggccgtacgtacccggtccgtaacgtccgaacgacccggtaaaccggtcctacccggcccccttggtaacccc

SEQ ID NO: 292638 - DNA, 580 bp, Homo sapiens
  misc_feature: GYAE6OF02GD730.48.26.C04.1.454.CMB.1.raw
  modified_base (229)..(229): a, c, t, g, unknown or other
  misc_feature (229)..(229): n is a, c, g, or t
tcagagtatacatacacgaccggtgctcgatttagtctagcgactttgggtttgggggggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacaggtcagtcaccatctcctgcactggaaccngcagtgacgttggtgttataactatgtctcctggtaccaacagcaccaggcaaagcccccaaagtcatgatttatgaggtcagtaagcggccctcgacggggtccctgatcgcttctctggctccagtctggacaacgacggcctccgtcgacccgtctcgtcgggccttccgaggctggaggtatggaggctgattattacgtgctagtctcattagtgacgaggcacgacaaacgtaagttggtaggttacgttcgggacgggacggaccgaacggccgttacggacccggttaccgtacggtaccgacggtacccgtaagggtccctcccggtcccccgtggtacccg

SEQ ID NO: 292639 - DNA, 644 bp, Homo sapiens
  misc_feature: GYAE6OF02IHMIZ.48.26.C04.1.454.CMB.1.raw
  modified_base (306)..(306): a, c, t, g, unknown or other
  misc_feature (306)..(306): n is a, c, g, or t
  modified_base (318)..(318): a, c, t, g, unknown or other
  misc_feature (318)..(318): n is a, c, g, or t
  modified_base (352)..(352): a, c, t, g, unknown or other
  misc_feature (352)..(352): n is a, c, g, or t
tcagagtatacatacacgaccggtgctcgatttagtctagcgactttgggtttggggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcaccaggcaaacgcccccaaagtcatgatttangagtcaagtaanccggcctcgacggggtccctgactcgtcttcctntcggtctccgaagtcgttcggacaaacgaccggtccctccccgtaggtaaccccgtcgttaccgtcggggtcctaccgtaacgggcgtacggacggattacggaacggtctaggtaacttttaagttactgactacgtctacgactagtcgacgacgacacgtaccaaacgtaagttggtagtacgttacggggacggtacgggaaccgtacggtaccgtacggtacccgttaccgtacggtaccaccggacccgtaagggtcccgttccggaccccccgttgggtaacccc

SEQ ID NO: 292640 - DNA, 661 bp, Homo sapiens
  misc_feature: GYAE6OF02HHHX7.48.26.C04.1.454.CMB.1.raw
  modified_base (228)..(228): a, c, t, g, unknown or other
  misc_feature (228)..(228): n is a, c, g, or t
tcagagtatacatacacgaccggtgctcgatttagtctagcgactttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgacgttggtgttataactatgtcctcctggtaccaacagccacccaggaccaaacgcccccaaagtccaatgtatttagtgaggtcaaggtaagccggtccctacgacggggtccctagactcgtcttctcgtcggcctaccaagtcgtaggacaacgaccggcctccctcgacccgtctccgtcgggcctccgacggctagagggtatggacggcttgtaactttacgttacgtggtacgccttacaagttatcggacgaacggtccaagtaacctaacgaagttacggttacgggttaacgtccggggacgggtaacgggtaccgaacggtcccgtaacggtaacccggttaccggtacggttaccgacccggacccgtaacgggcccgttacccggccccccggtttaccggtcccttaacccgg

SEQ ID NO: 292641 - DNA, 576 bp, Homo sapiens
  misc_feature: GYAE6OF02HB4CE.48.26.C04.1.454.CMB.1.raw
tcagagtatacatacacgaccggtgctcgatttagtctagcgactttgggtttggggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggacaaacgcccccaaagtcatgatttatgaggtcagtaagccggccctgacgggtccctgatcgcttctctcgctacagtctcggacaacgccggcctccctcgtaccgtctcgtcgggcctccgaggctggaggtagtggagtcgtagtattacttacgtgacacgtctcatagtcgcgagcaagacaactagttggtagtacgtcgggacgggacggaccgtaaggccgttacggacccgttacgtacggacgtaccgaccgtaacggcccgtccggtccccgtacgtacccg

SEQ ID NO: 292642 - DNA, 583 bp, Homo sapiens
  misc_feature: GYAE6OF02G5BXZ.48.26.C04.1.454.CMB.1.raw
  modified_base (202)..(202): a, c, t, g, unknown or other
  misc_feature (202)..(202): n is a, c, g, or t
  modified_base (215)..(215): a, c, t, g, unknown or other
  misc_feature (215)..(215): n is a, c, g, or t
  modified_base (250)..(250): a, c, t, g, unknown or other
  misc_feature (250)..(250): n is a, c, g, or t
  modified_base (255)..(255): a, c, t, g, unknown or other
  misc_feature (255)..(255): n is a, c, g, or t
  modified_base (269)..(269): a, c, t, g, unknown or other
  misc_feature (269)..(269): n is a, c, g, or t
  modified_base (301)..(301): a, c, t, g, unknown or other
  misc_feature (301)..(301): n is a, c, g, or t
tcagagtatacatacacgaccggtgctcgatttagtctagcgactttgggtttggggggggtcgtcgaggaggcgagcgctctcaggacgtcaccaccatggcctgggctctgctcctcctcaccctcctcactcagggcacagggtcctgggcccagtctgccctgactcacgcctccctccgcgtccggtctcctggacngtcagtcacatcncctgcactggaaccagcaagtgacgttggtgttanaactntgtctctgtacaanagcaccagcaaacgccccaaagtcatgattangagtcaagtaagcgcctcgacgggtcctaggatccggacttctcgtcggtcctaccgtaagtcgttaggacctaaaccgaccggtccctacccgtagacccgtcttcgtcgggtcctaccgacgtcgtaggacgactaggacgtcgtagtattaattacgtgacaagtctactagtactgacaggccagtacaaacgtagtcgtagtagttcgggacgtaggaacagtcgtagtaccgtacgtaggtaccacggaccaaggtccgaccgtcccgtcgtaacc

SEQ ID NO: 292643 - DNA, 594 bp, Homo sapiens
  misc_feature: GYAE6OF02F31ZD.48.26.C04.1.454.CMB.1.raw
  modified_base (249)..(249): a, c, t, g, unknown or other
  misc_feature (249)..(249): n is a, c, g, or t
  modified_base (304)..(304): a, c, t, g, unknown or other
  misc_feature (304)..(304): n is a, c, g, or t
  modified_base (359)..(359): a, c, t, g, unknown or other
  misc_feature (359)..(359): n is a, c, g, or t
tcagagtatacatacacgaccggtgctcgatttagtctagcgactttgggtttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttanaactatgtctcctgtaccaacagcaccaggcaaacgccccaaagtcatgatttangaggtacagtaacgcggtcctgacgggtccctgactcgcttctctggctcagtcnggacaacgcggcctccgtgaccgtctcgtggcctaccgaggctggaggtatggaggctagtattacgttacgtgacctagtcctactattagtcgacgaagggcaagaccaaacgtaagttggttacggtacgttaccggggacgggtacggaacccgtaaggtccgtacggtacccggtaccgttaggtaccacggtacccgtaggtacccgtcccgtaccccgtcggtacccg

SEQ ID NO: 292644 - DNA, 595 bp, Homo sapiens
  misc_feature: GYAE6OF02GE8VY.48.26.C04.1.454.CMB.1.raw
  modified_base (458)..(458): a, c, t, g, unknown or other
  misc_feature (458)..(458): n is a, c, g, or t
tcagagtatacatacacgaccggtgctcgatttagtctagcgactttgggtttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtgctaatacctatgtctcctgtaccaacaacacgcaggacaaacgcccccaaactcatgtatttactagatgtacaacgtaacgccggccctcgacggggtccctgcctcgtcttctcgtcgcctaccagtcgtggacaacgaccgccctcctcgacctactctcgtcgggctccgaggtctaggaagtagtcggagtctagtactttactttcgntctgctatatgtcgactacgacctaaacttagttacttgttacgtttacggactaggaaccgtaaccgtacggttacccgtaccgttaccgtacggtaccaccggaccccgtaacggacccccaaccctcgttaccg

SEQ ID NO: 292645 - DNA, 584 bp, Homo sapiens
  misc_feature: GYAE6OF02FQ4FX.48.26.C04.1.454.CMB.1.raw
  modified_base (237)..(237): a, c, t, g, unknown or other
  misc_feature (237)..(237): n is a, c, g, or t
  modified_base (326)..(326): a, c, t, g, unknown or other
  misc_feature (326)..(326): n is a, c, g, or t
  modified_base (377)..(377): a, c, t, g, unknown or other
  misc_feature (377)..(377): n is a, c, g, or t
  modified_base (440)..(440): a, c, t, g, unknown or other
  misc_feature (440)..(440): n is a, c, g, or t
  modified_base (462)..(462): a, c, t, g, unknown or other
  misc_feature (462)..(462): n is a, c, g, or t
  modified_base (466)..(466): a, c, t, g, unknown or other
  misc_feature (466)..(466): n is a, c, g, or t
tcagagtatacatacacgaccggtgctcgatttagtctagcgactttgggtttgggggggggtctcaggaggcagcgctctcaggacgtcaccaccatggcctgggctctgctcctcctcaccctcctcactcagggcacgagggtcctgggcccagtctgccctgactcagccctccctccgccggtccgggtctccgtggacagtcagtccaccatcctcctgcacgtggaaccngcagtgacgttggtgttaataactatcgtccttccgtggtaccaacacgccaaccgaggacaaaccgacccccaaagtcatgtatttanggaggtcaagtaacggccggtccctcggacgggtccctagactcgtcttcncgtcggcctacaagtctggaccaacgaccggcctcccgtcgtaccgtctcgcggctccgagcngagtatgcgctagtattattangacncgtctcattagcgagagcaacgacaacgtagtggttaggttagtcgggacggacgggaactagtcggttaccgaccgttccgtaggcgacgaccgtagccctccgtccccgtgtaccc

SEQ ID NO: 292646 - DNA, 679 bp, Homo sapiens
  misc_feature: GYAE6OF02JWJPH.48.26.C04.1.454.CMB.1.raw
  modified_base (228)..(228): a, c, t, g, unknown or other
  misc_feature (228)..(228): n is a, c, g, or t
  modified_base (531)..(531): a, c, t, g, unknown or other
  misc_feature (531)..(531): n is a, c, g, or t
tcagagtatacatacacgaccggtgctcgatttagtctagcgactttgggtttgggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccngcagtcgacggttggtagttaataactagtcgtcctccgtaggtaaccaacacgaccacccgaaggtaccaaaaccgacccccaaaagtctaatagtaatttagtacggtagtacaaggtaacgccggccctacggaccggggttccctagtacttccggtcttcgtcgtcggcctaccgaagttcgtacgacctaacgtccgaccctccgtacgtacccgtcgtcggtcggtcctaccgacggtctaggaggctacggacggtacgtagtaacgtttatacgtgctacgtctactagtacgngtactaagtacgtaagtcgactacgttgtacgttgttacgggtacgtcgggtacgggtaaccgggaccgtaagtccggttaaccggtaccgttaccggtacggttaccgaccggtacccggtaacggtcccgtaccccgttaccccgg

SEQ ID NO: 292647 - DNA, 544 bp, Homo sapiens
  misc_feature: GYAE6OF02JCNOT.48.26.C04.1.454.CMB.1.raw
tcagagtatacatacacgaccggtgctcgatttagtctagcgactttgggtttggggtggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcaccaggcaaagcccccaaagtcatgatttatgaggtcagtaagcggccctcgaggggtccctgatcgcttctctggctccaagtctggcaacaccggcctccctgacccgtctcgtgggcctccgaggctggaggatgaggctgatttattctgcagctcatagtgcaggcagaccaacgtaatggtaggttacgttccgggacgggagggaccgaagcgtacggaccgttccgtaggtccacgcccgaaggcctaccggccccgtacgg

SEQ ID NO: 292648 - DNA, 760 bp, Homo sapiens
  misc_feature: GYAE6OF02F30WT.48.26.C04.1.454.CMB.1.raw
tcagagtatacatacacgaccggtgctcgatttagtctagcgactttgggtttgggggggtcgtcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcacatctcctgcactggaaccagcagtgacgtttggtgtttataactatgtctcctggtaccaacaacaccaggcaaacgcccccaaactcgatgactttatgatgtcagtaatcggcctcgagggtttctaagtcgctttctctcggtctaccgaacgttcgtcggacaaacgtacccggccttaccccgttgaaccctaagttccttaccgtgggtcccttaccgaaggtccgtaggacgggacgtacggtccgttaggtaacttttaacgttaccgttacggaccctaaaccccgttcgttaaacttaacgttaaaccaaaacggggttacctaaccgacggaaccggtaccctaaaccgtttcccgttaccggggtttacgtttaacgggtttacccggggacgggggttaaaccgggtaccgtaaaccggtaccggtttcccggaacccggtttaccccggttaaacgggttaccgacccggttaacccgggaaccgggttcccggttaaccccggtcccccccggtttacggggtacccttaacccccgg

SEQ ID NO: 292649 - DNA, 600 bp, Homo sapiens
  misc_feature: GYAE6OF02I8LUE.48.26.C04.1.454.CMB.1.raw
  modified_base (310)..(310): a, c, t, g, unknown or other
  misc_feature (310)..(310): n is a, c, g, or t
  modified_base (353)..(353): a, c, t, g, unknown or other
  misc_feature (353)..(353): n is a, c, g, or t
  modified_base (416)..(416): a, c, t, g, unknown or other
  misc_feature (416)..(416): n is a, c, g, or t
tcagagtatacatacacgaccggtgctcgatttagtctagcgactttgggtttgggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcacatctcctgcacgtggaaccagcagtgacgttggtgttataactatgtctcctggtaccaacagcacccaggaccaaacgacccccaaagtcatgatttangagtcaggtaacgcgccctgacgggtccctgactcgcttctcnggcctaccgagtctgacaacacgtcctccctgaccctcgtcgtcggcctccgagctgacggtntggagtcgtagtatttacgttacgtcgacgcgtctactatagacgtaccgaggtccaacgacgtaaactagttgtagggttacgtccggacgggtaacggaaccgtacggtacgtcggacccgttaccggtacgtaccgtacggacccgtaaccggtcccgtacccggtaccccgtcggtaccc

SEQ ID NO: 292650 - DNA, 593 bp, Homo sapiens
  misc_feature: GYAE6OF02HIPM7.48.26.C04.1.454.CMB.1.raw
  modified_base (271)..(271): a, c, t, g, unknown or other
  misc_feature (271)..(271): n is a, c, g, or t
  modified_base (303)..(303): a, c, t, g, unknown or other
  misc_feature (303)..(303): n is a, c, g, or t
tcagagtatacatacacgaccggtgctcgatttagtctagcgactttgggtttggggtggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtcgacgttggtggttataactatgtctctggtaccaangcaccgagacaaacgccccaagtcatgattangtagtcagtagcggcctgacgggtcctagactcgtcttcgtctgctcagtctaggacaacgacgcctccgtgaccgtctcgtcggcctccgagtcgtggaggtacgtggacgtcttaggtaactttacgttacgtggacctaggtcctacgtattacgtgaccgaggcaacggactaaacgtaagttgttaggtacgttacgggacggaacgggtaaccgaacggtctacggtacccggtacgtacggttacaacccggccgaacgggtcccgtacccgccccgttacgg

SEQ ID NO: 292651 - DNA, 586 bp, Homo sapiens
  misc_feature: GYAE6OF02G34SL.48.26.C04.1.454.CMB.1.raw
  modified_base (229)..(229): a, c, t, g, unknown or other
  misc_feature (229)..(229): n is a, c, g, or t
  modified_base (253)..(253): a, c, t, g, unknown or other
  misc_feature (253)..(253): n is a, c, g, or t
  modified_base (303)..(303): a, c, t, g, unknown or other
  misc_feature (303)..(303): n is a, c, g, or t
  modified_base (356)..(356): a, c, t, g, unknown or other
  misc_feature (356)..(356): n is a, c, g, or t
  modified_base (414)..(414): a, c, t, g, unknown or other
  misc_feature (414)..(414): n is a, c, g, or t
tcagagtatacatacacgaccggtgctcgatttagtctagcgactttgggtttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgacgttggtgttataactntgtctcctggtaccaacaacaccaggcaaagcccccaaatcttgatttangagatcactaagcggcctcaggtcttctatcgcttctctgctcagtctgcacncgcctcctgacaatctctggctcgagctggaggacgagctagatttattattgacttntcgtctatagtgacgtaggttcggttacttaggttcgggttgttcggacgacggtaacgggacctaaggtccgttacggtacccggttacgtaacgggtccaaccggaccccgtaagggtcccttacccgggtccccccttacggggtaccctaccgttccgttacccccgg

SEQ ID NO: 292652 - DNA, 624 bp, Homo sapiens
  misc_feature: GYAE6OF02G0AEZ.48.26.C04.1.454.CMB.1.raw
  modified_base (305)..(305): a, c, t, g, unknown or other
  misc_feature (305)..(305): n is a, c, g, or t
tcagagtatacatacacgaccggtgctcgatttagtctagcgactttgggtttggggtggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttatactatgtctcctgtaccaacagcaccaggcaaacgcccccaaagtcatgtatttangaggtcagtaagcggcctcgacgggtcctgactcgtcttctctggctacgagtctggacacgaccggcctccctcgacccgtctcgtcgggctcccgaggctggagataggaggtctagtactttacgttacgtcgacgtacgctactaattagtcggaccgtacgggtacaacggaccaaacgtaagttcggttaagggttacgttccggggacgggtaaccgggaaccgtaacgggccgtaacggaccgtaaccggttaccgttaacgggttccgaaccggttacccggaacggtcccgttacccggtccccccggg

SEQ ID NO: 292653 - DNA, 649 bp, Homo sapiens
  misc_feature: GYAE6OF02HQ39C.48.26.C04.1.454.CMB.1.raw
  modified_base (304)..(304): a, c, t, g, unknown or other
  misc_feature (304)..(304): n is a, c, g, or t
tcagagtatacatacacgaccggtgctcgatttagtctagcgactttgggtttgggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttgtgttaatactatgtctctggtaccaacagcaccaggcaaacgcccccaaagtcatgatttangagtcaagtagccgcctcgacgggtcctgactcgtacttctcgtcggtcctaccgaagtccgtggacaacgtaccggccctcccgtgacccgtctcgtcgggcctccgagggtcctagggaggtagtcggacggtcttaggtaatttacttaccgtgccaagtcctacgagttactgaccgacggacacgaacctaaacgtagttcgggttaggttaaccggttcgggaccgggtaacggtacccgtaaggtccggttaccggtaacccggttaccgttaacggtacccgtaccggtaacccgaacgggttccctaccccggttaccccccgtagggttaacccc

SEQ ID NO: 292654 - DNA, 597 bp, Homo sapiens
  misc_feature: GYAE6OF02GUE9W.48.26.C04.1.454.CMB.1.raw
  modified_base (305)..(305): a, c, t, g, unknown or other
  misc_feature (305)..(305): n is a, c, g, or t
tcagagtatacatacacgaccggtgctcgatttagtctagcgactttgggtttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtgttaataactatgtctcctggtaccaacagcaccaggcaaacgcccccaaagtcatgattangagtcagtaagcgcctgagggtccctgatcgcttctctggctcaagtctggcaacgaccggcctcccgtcgaccgtctcgtcgggcctccgaggtctagaggtatacggaggtctaggtaatttacgttaacgtcgacctagtacctactaattacgtcgaccgtagggaccaacgacaaactaagttcggttagtacgttcgggacggaggtacccaaggtcgtacggtacccgtacgtacggtacgaccggtaccgtaacggtccgtacccggtcccccgttggtacccg

SEQ ID NO: 292655 - DNA, 770 bp, Homo sapiens
  misc_feature: GYAE6OF02IVQ90.48.26.C04.1.454.CMB.1.raw
  modified_base (236)..(236): a, c, t, g, unknown or other
  misc_feature (236)..(236): n is a, c, g, or t
tcagagtatacatacacgaccggtgctcgatttagtctagcgactttgggtttgggggctggggtctcaggaggcagcgctctcaggacgtcaccaccatggcctgggctctgctcctcctcaccctcctcactcagggcacgagggtcctgggcccagtctgccctgactcagcctccctccgcgtccgggtctccgtggacagtcagtcaccatctcctgacacgtcggaaccngcagtgtacggttgggtaggttaataactatcgtcctccgtacggtaccaaacgacgaccaccccgaaggaccgaaaccgaccccccgtaaaagtccaagtacgtaatttagtacggtacggtacgaacggtaacggcccggtccccgtacggtaccggggttccctagaacgttccgtcctttctcgtcggtcctaccgtaacgtccgtcggaaccaaccgtaccggtcccctacccggtaccggtacccgttcgttccggtacgggtcctacccggagggtcccgtagggtaacgggtacggtacgggacgggtaccgttacggttaaacgtttaccgtttaaccgtcgaccttacggccttaacgtaacgttacgtacggtacgaacggacgtaacgaacgtaaacgtaagttcggttaagggttacgtcgggggaaccgggtacggtaaccggtaacggtcggttaccggtaacccgttacggtaccggtacgaccgtacccggtaacggtcccgtccccggtaccccgg

SEQ ID NO: 292656 - DNA, 618 bp, Homo sapiens
  misc_feature: GYAE6OF02H4BP9.48.26.C04.1.454.CMB.1.raw
  modified_base (235)..(235): a, c, t, g, unknown or other
  misc_feature (235)..(235): n is a, c, g, or t
  modified_base (250)..(250): a, c, t, g, unknown or other
  misc_feature (250)..(250): n is a, c, g, or t
  modified_base (256)..(256): a, c, t, g, unknown or other
  misc_feature (256)..(256): n is a, c, g, or t
  modified_base (261)..(261): a, c, t, g, unknown or other
  misc_feature (261)..(261): n is a, c, g, or t
  modified_base (278)..(279): a, c, t, g, unknown or other
  misc_feature (278)..(279): n is a, c, g, or t
  modified_base (312)..(312): a, c, t, g, unknown or other
  misc_feature (312)..(312): n is a, c, g, or t
  modified_base (341)..(341): a, c, t, g, unknown or other
  misc_feature (341)..(341): n is a, c, g, or t
  modified_base (470)..(470): a, c, t, g, unknown or other
  misc_feature (470)..(470): n is a, c, g, or t
tcagagtatacatacacgaccggtgctcgatttagtctagcgactttgggtttgggggctggggtctcaggaggcagcgctctcaggacgtcaccaccatggcctgggctccgctcctcctcaccctcctaactcagggcacgagggtcctgggcccagtctcgccctgactcagccctccctccgcgtccgggtctcctggacagtcagtcaccatctcctgcacgtggaaccngcagtgacgtttggngttaanaactntgtctctggtaccaacnncaccaggacaaacgccccaaagtcatgatttangagtcagtacgcgcctcgacgggttcccngtacgtcgtcttctcgtcggtcctacgtaagtcgtcggacaaccgtaccgacctccgtacgtcccgttcgtccgtcggtcctccgacggtctacggaggtacgtggacgtcgtagtaactttagttacnggtacgacgtctacgtactagtcgacgacggacagtaaccaaagtcgttaggttacttacggtcggacggacgggtaccaggtcgttaccggaccgtacgtacgaccgacggtacccgaggtcccgtacccgtaccccgtggttaccc

SEQ ID NO: 292657 - DNA, 720 bp, Homo sapiens
  misc_feature: GYAE6OF02HGZDV.48.26.C04.1.454.CMB.1.raw
  modified_base (229)..(229): a, c, t, g, unknown or other
  misc_feature (229)..(229): n is a, c, g, or t
tcagagtatacatacacgaccggtgctcgatttagtctagcgactttgggtttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgacgttggtggttataactatgtctctggtaccaacagcaccaggacaaacgcccccaaagtcatagatttactggagtacagtaacggccggtcctcgacgggtccctagacgtccgtacctttccgtacgtcggtcctaccgtaacgtcgttacggaccaaaccgacccggtccccttccccgtacgtacccgttccgttccgtacgggtcccttaccgacgggtcctagggaacgggtacttagggacgggtccttaggtaacgttttaacttaccggtttaccggaccgtaacggttccttaaccgtaagtttagtaccggtacgaacgggtccaaacggtacctaaacgtaaagttggtttacgggtacggttacgggaccggggtaacggtacgtaaacggccttaacgggacccgttaccgtagggttaccgaaccgtccggtaacggtccgtcccggtacccccgtcgggttaacccc

SEQ ID NO: 292658 - DNA, 777 bp, Homo sapiens
  misc_feature: GYAE6OF02HQULK.48.26.C04.1.454.CMB.1.raw
tcagagtatacatacacgaccggtgctcgatttagtctagcgactttgggtttgggggggggtctcaggaggcagcgctctcaggacgtcaccaccatggcctgggctctgctcctcctcaccctcctcactcagggcacgagggtcctgggcccagtcctgccctgactcagcctccctccgcgtccgggtctccgtggacagtcagtccaccatctcctgcagtcggaaccagcagtgacgttggtaggttataactatgtctcgtaggtaccaacagcaccgaggacaaacgccccaaagtcaatgtaatttagtggacggtcagtaacgccggccgtacggtacgggtcctgactccgtcttcctacgtcgcctacgaagttcgtacggacaacgaccggtcctcccgtagtacccgttcgtcggtcgggtacctccgtacggtcgtacgggaaggtacgtggggtacttaggttaacttacgttttacgacgtacgacgtaccgtacgtaacttacgtaggtacgaaccgggtacgtaaccgtaacgtaaaccgtaacggtttaacgggtccggggtttaaacgggttcccgggggtaaccggggtaacggggtaaaccccgtaacgggttacccgtaacccggggttaaccccgggttaaccgggttaaccgggttaaccccggaaccgggtaaccccggttaacccgggtccccgtttaacccccggggttaccccggtttaaccccgggttcccgttttaacccccggg

SEQ ID NO: 292659 - DNA, 572 bp, Homo sapiens
  misc_feature: GYAE6OF02G5VXP.48.26.C04.1.454.CMB.1.raw
  modified_base (308)..(308): a, c, t, g, unknown or other
  misc_feature (308)..(308): n is a, c, g, or t
  modified_base (465)..(465): a, c, t, g, unknown or other
  misc_feature (465)..(465): n is a, c, g, or t
tcagagtatacatacacgaccggtgctcgatttagtctagcgactttgggtttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagccaccaggcaaacgcccccaaagtcatgtatttangaggtacagtaagccggccctcgacggggtccctgactcgtcttctctggcctccaagtctggaccacgaccggcctccgtcgaccgtctcgtgggcctccgaggctggaggagtggacggtctagtacttacttacgtgctagtcctactattacncgtcgacggtcaagaccgaaacgtagtggttaggtacgttcggggacggacgggaacgacgcgtcggacccgtctacggtcacgccgacggcctccgccctggtacc

SEQ ID NO: 292660 - DNA, 614 bp, Homo sapiens
  misc_feature: GYAE6OF02HQT5E.48.26.C04.1.454.CMB.1.raw
  modified_base (199)..(199): a, c, t, g, unknown or other
  misc_feature (199)..(199): n is a, c, g, or t
  modified_base (245)..(245): a, c, t, g, unknown or other
  misc_feature (245)..(245): n is a, c, g, or t
  modified_base (249)..(249): a, c, t, g, unknown or other
  misc_feature (249)..(249): n is a, c, g, or t
  modified_base (438)..(438): a, c, t, g, unknown or other
  misc_feature (438)..(438): n is a, c, g, or t
tcagagtatacatacacgaccggtgctcgatttagtctagcgactttgggtttgggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacngtcagtcaccatctctgcactggaccagcagtgacgttggtgttanactntgtctcctgtaccaacagcaccagacaaacgcccccaagtccatgtactttatgaggtacagtaacgccggcctcgacgggtccctgactcggtccttctctcggcctaccgtaagtcgtggaccaaccgccggtaccctcccgtacgtacccgttcctacgtcgggtcctccgaggtcgttggaaggngtacggagtaccgtagtacgtttacgttacgtgtacacgtcctacatacgtgtacgaggtccgaagacgtaacgtagttcggttaggtacgttcgggaggtacgggtacaacggtctacggtaccgtacgtacggacaccgtaccgacggtccgtacccggtcccgtcggtacccg

SEQ ID NO: 292661 - DNA, 704 bp, Homo sapiens
  misc_feature: GYAE6OF02IQFDT.48.26.C04.1.454.CMB.1.raw
  modified_base (249)..(249): a, c, t, g, unknown or other
  misc_feature (249)..(249): n is a, c, g, or t
  modified_base (254)..(254): a, c, t, g, unknown or other
  misc_feature (254)..(254): n is a, c, g, or t
tcagagtatacatacacgaccggtgctcgatttagtctagcgactttgggtttggggggggggtctcaggaggcagcgctctcaggacgtcaccaccatgcctgggctctgctcctcctcaccctcctcactcagggcacagggtcctgggcccagtctgccctgactcagcctccctccgcgtccgggtctcctggacagtcagtccaccatctcctgcactggaaccagcagtgacgttggtgttanaactntgtctctgtacaacagccaccagacaacgacccccaaagtcatgtatttatggagtcaaggtaacgcggaccctcgacggggtccctgtactcgtcttcctcgtcgtcctaccaacgtcgtcggacaaacgtccggtccctcccgtcgacccgtcgtcgtcgggccttacccgaggtccgtaggaacggtagtcggaacggtcgttaggtaattttacgttaccgtacgaccgacgttcctacgtataacggtcgtaccgtagggaccgaacgtacctaaacgtaagttggggttacggtttacggttacggggaccggggtaacgggtaacccgaacggtccggttaacccggtaacccggtttaccggtaaccgggttacccgaaccgggtaccccgtaaaccgggttccccggtaaccccggttcccccccggtaggttaacccccg

SEQ ID NO: 292662 - DNA, 640 bp, Homo sapiens
  misc_feature: GYAE6OF02GDLW5.48.26.C04.1.454.CMB.1.raw
  modified_base (254)..(254): a, c, t, g, unknown or other
  misc_feature (254)..(254): n is a, c, g, or t
  modified_base (269)..(269): a, c, t, g, unknown or other
  misc_feature (269)..(269): n is a, c, g, or t
  modified_base (343)..(343): a, c, t, g, unknown or other
  misc_feature (343)..(343): n is a, c, g, or t
tcagagtatacatacacgaccggtgctcgatttagtctagcgactttgggtttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctccgtggacagtcagtcaccatctcctgcactggaaccagcagtgacgttggtgttataactntgtctctgtaccaangccaccagacaacgaccccaagtcatagtatttatggaggtcaaggtaacggccggccctacgacgggttcccngtacgtcgtccttcgtctcggcctacctaagtctacggacaaccgaccggtaccctccgtcgacccgttccgtcgtcgggcctccggagtctggacgtagtggacgtcgtagtaacgtttcttacgtgtacgtactctacgtatagtacgtacgaggacaacggtacaaacgttaagttcggttaggttaccggttacggggaacgggtaccgggtaaccgaacggtcggtaaccggtaccgtaccgtacggtaccgacgacccggacgtccgtccccggtccccgttaggtacccc

SEQ ID NO: 292663 - DNA, 597 bp, Homo sapiens
  misc_feature: GYAE6OF02IEHFA.48.26.C04.1.454.CMB.1.raw
  modified_base (201)..(201): a, c, t, g, unknown or other
  misc_feature (201)..(201): n is a, c, g, or t
  modified_base (230)..(230): a, c, t, g, unknown or other
  misc_feature (230)..(230): n is a, c, g, or t
  modified_base (255)..(255): a, c, t, g, unknown or other
  misc_feature (255)..(255): n is a, c, g, or t
  modified_base (316)..(316): a, c, t, g, unknown or other
  misc_feature (316)..(316): n is a, c, g, or t
  modified_base (393)..(393): a, c, t, g, unknown or other
  misc_feature (393)..(393): n is a, c, g, or t
  modified_base (415)..(415): a, c, t, g, unknown or other
  misc_feature (415)..(415): n is a, c, g, or t
tcagagtatacatacacgaccggtgctcgatttagtctagcgactttgggtttgggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacngtcagtcaccatcctctgcactggaaccngcagtgtacgttggtgttaatactntgttcctcgtacgtaccaacacgcacccgaggaccaaacgacccccaagtcatgtatttangagtcagtacgccgcctcggacgggtcctgactcgtcttctcgtcgtcctcgaagtcgtcgacaccgaccgcctccncgtaccgtctcgtcggcctcgngtctgagagtggacgtctatattacttacgtgtcttgtttacttacgttttacttacgtttttcgtttttgtaccgttacgtaacggttccggtacgtcgttccgtaccgtcgtagtccgacgtaccgaccgtccccaacctcgtctacctcgttctcccgtccctaccctcttctcttacg

SEQ ID NO: 292664 - DNA, 637 bp, Homo sapiens
  misc_feature: GYAE6OF02F7A5P.48.26.C04.1.454.CMB.1.raw
  modified_base (255)..(255): a, c, t, g, unknown or other
  misc_feature (255)..(255): n is a, c, g, or t
  modified_base (269)..(269): a, c, t, g, unknown or other
  misc_feature (269)..(269): n is a, c, g, or t
  modified_base (299)..(299): a, c, t, g, unknown or other
  misc_feature (299)..(299): n is a, c, g, or t
tcagagtatacatacacgaccggtgctcgatttagtctagcgactttgggtttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctccgtggacagtcagtcaccatctcctgcactcggaaccagcagtgacgttggtgttataactntgtctctgtacacngcaccagacaacgccccaagtcatgattangagtcagtagcgcctcgacgggtcctgactcgcttctctcggactccgagtcgtggaccaacgccggccctacccgtcgtacccgttctccggtcggtccgtccgacggtcgtggaacggtacgtcggacgggtcttaggtaactttacgtttacgtacggtacctacgtcctactaagttacgtcggacgtacgggtccaacgtaccaacgttaagttcgggttacggtacggttacgggaccggggtacgggaaccaacggtcgtaccggtacccgttacgtacggttccgaccgaccggtaacggtcccgtacccgcccccggttacggtacccg

SEQ ID NO: 292665 - DNA, 626 bp, Homo sapiens
  misc_feature: GYAE6OF02G59YT.48.26.C04.1.454.CMB.1.raw
  modified_base (246)..(246): a, c, t, g, unknown or other
  misc_feature (246)..(246): n is a, c, g, or t
  modified_base (308)..(308): a, c, t, g, unknown or other
  misc_feature (308)..(308): n is a, c, g, or t
tcagagtatacatacacgaccggtgctcgatttagtctagcgactttgggtttggggtgggggtctcaggaggcagcgctctcaggacgtcaccaccatcggcctggctctgcctcctcctcaccctcctcactcagggcacgagggtcctgggcccagtctgccctgactcagcctccctccgcgtccgggtctcctggacagtcagtcaccatctcctgcactggaaccagcagtgacgttggngttataactatgtctcctggtaccaacagcacccaggcaaacgcccccaaagtcatgattangagtcagtaagcgcctgacggggtcctggatcgcttctcgtgctcaagtctggcaacacggcctccctgaccgtctcgtcgggacctccgacgggctaggaggagttggaggtcctaggtaattacttaccgtgtccaaggtcctacattaatcggacaacgggctaaggacctaaacgtaagtggtacggttacgtttaccggggaccgggaaggggtaaccctaagggtacccgttacgggtaacccgttaccgtaacggggttacccaaccgggtaccccaagggggcccttcccgggtccccccgttaaccggg

SEQ ID NO: 292666 - DNA, 700 bp, Homo sapiens
  misc_feature: GYAE6OF02HAYPF.48.26.C04.1.454.CMB.1.raw
  modified_base (452)..(452): a, c, t, g, unknown or other
  misc_feature (452)..(452): n is a, c, g, or t
tcagagtatacatacacgaccggtgctcgatttagtctagcgactttgggtttggggggggggtctcaggaggcagcgctctcaggacgtcaccaccatggcctgggctctgctcctcctcaccctctcactcagggcacgagggtcctgggcccagtctgcccctgactcagcctccctccgcgtccgggtctccgtggactagtcagtccacctatctcctgctactcggaaccagcagtgtacggttggtggttaataactgtcgtccttccgtacggtaaccaacgacgaccaacccgagaccgaaaccgaccccctaaagtccatagttaactttagtaggtacggtactaaggtaacggccggtacccgtacggtaccggggtccctagtactaccggtccttaccgtcggtcggtccttaccgtaagtcgtcggaacccgtaacnccgggtccctccgtacgtaccggtccgttcggtcggtaccctacggccggtgtacgggtacggaagtcggacggtacgttagtaactttacgttagcgtactagtcctacgtatacggttcgacgacgcctaacgactaacgtagttcggtacgttcggtacgggaacggtacggaactacggtccgttaccgaacccggttcgacgtacgccggtactaccggccgtaccccgtccggtccgtaccg

SEQ ID NO: 292667 - DNA, 579 bp, Homo sapiens
  misc_feature: GYAE6OF02JET4K.48.26.C04.1.454.CMB.1.raw
  modified_base (312)..(312): a, c, t, g, unknown or other
  misc_feature (312)..(312): n is a, c, g, or t
tcagagtatacatacacgaccggtgctcgatttagtctagcgactttgggtttggggtggggtctcaggaggcagcgctctcaggacgtcaccaccatggcctgggctctgctcctcctcaccctcctcactcaggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaacgcccccaaagtcatgatttatgaggtnagtaagccggccctcgacggggtccctgactcgcttctcgtggcctccaagtctggaccaacgaccggccctcctcgaccgttctcgtcggcctccgaggctggaggagtggaggtctaggtaacttagttacctgtacagtccttactatagtcgtacacgggcaacgaccaaactaagtggtaggtacgttcgggaggacgggaccaagtccgtacggaccgttcgtaggtaccacggacccgaggtcctacggaccctacccgg

SEQ ID NO: 292668 - DNA, 642 bp, Homo sapiens
  misc_feature: GYAE6OF02FHQZA.48.26.C04.1.454.CMB.1.raw
tcagagtatacatacacgaccggtgctcgatttagtctagcgactttgggtttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtcgacgtttggtggttataactatgtctcctggtaccaacagcaccaggacaaacgcccccaaagtcatgtatttatgacggtcaagtaacgccggccctcggacggggtcccctgatccgtcttcctcgtcggccttccaagtctgggacaacgaccggcctcctcgacccgttctcgtcgggcctccgaggtcctaggaggtctggagtcgtagtaattactttacgcgtcacgtctctaatgtcggccgtaggaccacggaacctaaaccgttaaggttcgttaggttaggttccgggacgggtacgggaaccctaggtcccggtacgtacccggttaccggtaacgttaccgaaccggttaccccggaacggtcccggtacccggtcccccggttcggttacccg

SEQ ID NO: 292669 - DNA, 651 bp, Homo sapiens
  misc_feature: GYAE6OF02FKHA6.48.26.C04.1.454.CMB.1.raw
  modified_base (323)..(323): a, c, t, g, unknown or other
  misc_feature (323)..(323): n is a, c, g, or t
tcagagtatacatacacgaccggtgctcgatttagtctagcgactttgggtttggggtggggtctcaggaggcagcgctctcaggacgtcgccaccatggcctgggctctgctcctcctcaccctcctcactcagggcacagggtcctgggcccagtctgccctgactcagcctccctccgcgtccgggtctccgtggacagtcagtcaccatctcctgctactcggaaccagcagtcgacgttggtggttaataacgtattcgtccttcctacggtaaccaacagccacccaggaccaaacgcccccaaagtcatgtattangagtcaagtaacgcgccctgacgggtcctgactcgtcttcgtctggctcgaagtcgtgtacaaacgccgtccctcccgtgacccgttctcgtcggtcctccgacgggtcgtgtacggagttcggacggtctacgtaatttacgttagcgctaacgtctactagttaatcgacgtacgacaacgtaccgaaacttaaggtcggttacgggttacgtaccgggggacggtaacgggaaccgtaacggtccggttaccgtaacccggtaccgttacgggttaccgaccggtaaccccgtaacggtccgtacccccggttccccggttaccg

SEQ ID NO: 292670 - DNA, 695 bp, Homo sapiens
  misc_feature: GYAE6OF02HBB55.48.26.C04.1.454.CMB.1.raw
  modified_base (203)..(203): a, c, t, g, unknown or other
  misc_feature (203)..(203): n is a, c, g, or t
  modified_base (232)..(232): a, c, t, g, unknown or other
  misc_feature (232)..(232): n is a, c, g, or t
  modified_base (312)..(312): a, c, t, g, unknown or other
  misc_feature (312)..(312): n is a, c, g, or t
  modified_base (340)..(340): a, c, t, g, unknown or other
  misc_feature (340)..(340): n is a, c, g, or t
tcagagtatacatacacgaccggtgctcgatttagtctagcgactttgggtttggggggggggtctcaggaggcagcgctctcaggacgtcaccaccatggcctgggctctgctcctcctcaccctcctcactcagggcacgagggtcctgggcccagtctgccctgactcagcctccctccgcgtccgggtctccgtggacngtcagtcacatctcctgcacgtggaaccngcagtgtacgttggtgttataactatgtctcctggtaccaacacgcaccgaggaccaaacgcccctaagtcatgtattangagtcagtacgccgcctcgacgggtccngactcgtcttctcgtcgtctacgtagtcgtggacacgtacgtcctccgtcgtaccgttctcgtcggtacctacgtagggtacgtaggtaacggtagtacgggacggtacgtacgttaacgtttacgttaccgtcgaccgtacgtccttaacgagtttaacggcgtacgacggtaccgtaacgtaacgtaaacgttaggttccgggttaacggttacgggttacggggaccggtaacggggaccgttaaacggtcgggttaacccggttaacggttacccgggtaacggtaaccggtacccggtaacccggtaccgggttccccgttacccgggttacccccgttacggttacccg

SEQ ID NO: 292671 - DNA, 707 bp, Homo sapiens
  misc_feature: GYAE6OF02GV9C9.48.26.C04.1.454.CMB.1.raw
  modified_base (295)..(295): a, c, t, g, unknown or other
  misc_feature (295)..(295): n is a, c, g, or t
  modified_base (563)..(563): a, c, t, g, unknown or other
  misc_feature (563)..(563): n is a, c, g, or t
tcagagtatacatacacgaccggtgctcgatttagtctagcgactttgggtttggggggggggtctcaggaggcagcgctctcaggacgtcaccaccatggcctgggctctgctcctcctcaccctcctcactcagggcacagggtcctgggcccagtctgccctgactcacgcctccctccgccgtccgggtctcctggacagtcagtcaccatcctcctgacactaggaacccagcaggtcgtacggttggttaggttaactaacttatcgttctaccgtacggtaaccaacncgaccacccgaggaccgaaaccgacccccaaagtcaagtgtaatttagtaggacggtacgtaaggtaacggccggcccgtcggtacggggtccctagtacgtccgttctttcgtccgtacggtacctaccgtaaggttccgtacggaccaaccggtacccggtcccttacccgtcgtaccgttccgtcggtcggcctacggcgtccgagaacggtgtcggtagtcgttacgttactttacgtacgtcgacgtactctacgattacggnaccggaccggacaacgtaactaagtacttggttcgggttaaccggcgggtaaccggacggacctacggtccgtaaccggtaccggtacgtaccggtaccgaccggtaaccggccgtacccgtacccgtccccggttcgtaaccc

SEQ ID NO: 292672 - DNA, 642 bp, Homo sapiens
  misc_feature: GYAE6OF02IKQD6.48.26.C04.1.454.CMB.1.raw
  modified_base (238)..(238): a, c, t, g, unknown or other
  misc_feature (238)..(238): n is a, c, g, or t
  modified_base (244)..(244): a, c, t, g, unknown or other
  misc_feature (244)..(244): n is a, c, g, or t
  modified_base (247)..(247): a, c, t, g, unknown or other
  misc_feature (247)..(247): n is a, c, g, or t
  modified_base (252)..(252): a, c, t, g, unknown or other
  misc_feature (252)..(252): n is a, c, g, or t
  modified_base (262)..(262): a, c, t, g, unknown or other
  misc_feature (262)..(262): n is a, c, g, or t
  modified_base (315)..(315): a, c, t, g, unknown or other
  misc_feature (315)..(315): n is a, c, g, or t
  modified_base (443)..(443): a, c, t, g, unknown or other
  misc_feature (443)..(443): n is a, c, g, or t
tcagagtatacatacacgaccggtgctcgatttagtctagcgactttggggtttggggggctggggtctcaggaggcagcgctctcaggacgtcaccaccatggcctgggctctgctcctcctcaccctcctcactcagggcacagggtcctgggcccagtctcgccctgactcagcctcgctcaggtcgtccgggtctccgtggacacgtcgtcaccatccgcctgcactggaaccngcagtnatnttggncttacacttnctcctggtaccaacatccaccgagacaaacgtcccaaggtctactttatttangtatagtcactaaggccgtccgtccggggtcctggactcgtcttacgtctcggctaccagttctaggaccaaccgcgtcctcccgtacgaccctattcccgcgttcggctccggaagcgtaagaacgngttacggcggtacttgttattacgttctgtaccgttgacttaccgtattacgtcgtaacgtaccgtaccttaaacgttattacggttcgttaaccggttaccgtaagttaccggaacgtaaacccgacgggttaacccacccggttaccgttacggtaccgtaacccgaaccggtaacccggaccccaacccggtaccg

SEQ ID NO: 292673 - DNA, 707 bp, Homo sapiens
  misc_feature: GYAE6OF02GBC0T.48.26.C04.1.454.CMB.1.raw
  modified_base (271)..(271): a, c, t, g, unknown or other
  misc_feature (271)..(271): n is a, c, g, or t
  modified_base (287)..(288): a, c, t, g, unknown or other
  misc_feature (287)..(288): n is a, c, g, or t
  modified_base (311)..(311): a, c, t, g, unknown or other
  misc_feature (311)..(311): n is a, c, g, or t
  modified_base (491)..(491): a, c, t, g, unknown or other
  misc_feature (491)..(491): n is a, c, g, or t
tcagagtatacatacacgaccggtgctcgatttagtctagcgactttggggtttggggggggggtctcaggaggcagcgctctcaggacgtcaccaccatggcctgggctctgctcctcctcaccctcctcactcagggcacgacgggtcctcgggcccagtctcgccctgactcacgccctccctccggcgtccgggtctccgtggacagtcagtccaccattcctcctgcacgtacggaccagcaggtgtacggttggtgttaatactntcgtctcgtgaccacnnccacgagacaaccgacccaagtnagtatattagtggagtcacggtacgccggccctacgggtcgggtccagtactcgtctcgtctcggcctacgacgtcgacgaactacggccgtcccttccgtcggtacctccgtacgtccgggtacctccggtaaggtcgtaggtacggagtcggtagggtactggtttaacttcgtacgngacgtcgtacctagtctaggcgtacgggtaacgaccgtaacgtaaaccgtacgttaagggttcggttacgggttccgggtacgggaaccgggtaccgggtaaccgtcggggttaacccggtaccgttacccgggttaccgtaacggtaacccgtaacccggttacccgggtaaccggttccccgtaacccccgggttcccggttaacgtaccccgg

SEQ ID NO: 292674 - DNA, 630 bp, Homo sapiens
  misc_feature: GYAE6OF02FIILV.48.26.C04.1.454.CMB.1.raw
  modified_base (212)..(212): a, c, t, g, unknown or other
  misc_feature (212)..(212): n is a, c, g, or t
  modified_base (314)..(314): a, c, t, g, unknown or other
  misc_feature (314)..(314): n is a, c, g, or t
tcagagtatacatacacgaccggtgctcgatttagtctagcgactttgggtttgggtggggtctcaggaggcagcgctcgtcaggacgtcaccaccatggcctgggctctgctcctcctcaccctccttcactcagggcacagggtcctgggcccagtctgccctgacgtcagccctccctccgcgtccgggtctcctggcagtcagtcacntctcctgccactggaaccagcagtcgacgttgggtgttaactaactatcgtctcctggtaccaactagacacccaggcaaacgcccccaaagtcatgattangaggtcaagtaacgcggtaccctcgacggggtccctgactcgcttctctggcctcaagtctggcaacacggccctcccgtgtaccgtctctcgggtcctccgaggtctggaggtactggacggtctagtatttacgttacgtgtcaagtcctactattagtcgacgacggctaacggacctaaactaagttggttacggttacgttaccggggacgggacgggtaaccgtaaggtaccgtacggtaccccggttacggttaacggtcgaaccggttcccgaaacgggtcccttacccgggtccccccttacccggg

SEQ ID NO: 292675 - DNA, 643 bp, Homo sapiens
  misc_feature: GYAE6OF02HAY35.48.26.C04.1.454.CMB.1.raw
  modified_base (233)..(233): a, c, t, g, unknown or other
  misc_feature (233)..(233): n is a, c, g, or t
  modified_base (271)..(272): a, c, t, g, unknown or other
  misc_feature (271)..(272): n is a, c, g, or t
  modified_base (305)..(305): a, c, t, g, unknown or other
  misc_feature (305)..(305): n is a, c, g, or t
  modified_base (322)..(322): a, c, t, g, unknown or other
  misc_feature (322)..(322): n is a, c, g, or t
  modified_base (333)..(333): a, c, t, g, unknown or other
  misc_feature (333)..(333): n is a, c, g, or t
tcagagtatacatacacgaccggtgctcgatttagtctagcgactttgggtttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtccaccatcctcctgccacgtcgaaccngcagtgacgttggtgttatatatgtctcgtgtaccacnncaccaggacaacgaccccaagtcatgtattagngagtcagtacgccgccncgacgggtccngacgtcgtcttctcgtcgctactagtcgtagacaacgaccgtcctccgtacgaccgtctcgtcggcctccgaggtcctaggacggtagtcggacggtcttaggtaactttacttacgtcgacgtacgtactacgtactagtcgacgacggtaccacgtaactaaacgtagttcgggtacggttaaccggtcggggaccggggtaacggtaaccgtacgggtccgtaccggtaacccggttacccgggtaaggtaccccgtaccggacccggtaaggtccccgttacccggtcccccggttagtaccccgg

SEQ ID NO: 292676 - DNA, 673 bp, Homo sapiens
  misc_feature: GYAE6OF02FJS3V.48.26.C04.1.454.CMB.1.raw
  modified_base (274)..(274): a, c, t, g, unknown or other
  misc_feature (274)..(274): n is a, c, g, or t
tcagagtatacatacacgaccggtgctcgatttagtctagcgactttgggtttgggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtggttataactatcgtctcctggtaccaacncgccacccaggaccaaacgacccccaaagtcactgtactttatggtacgtacagtaacgccggcccctcggacgggtccctgtactccgtcttcgttctcggtcctaccgagtcgtacgggaccaaccgtaccggcccttcccgtacggtacccgttccttaccggtccgggtccttacccggaggccgttcggaacggtagtacggacgggtcttaggtactttacttacgtgtaccacgtcctcaacttacgtacgtacgacgacgtacaactaactaagtcgtaggttacgttccgggacgggtacggtaaccgaggtccgtaccgtaacccggtcgtacgggtaccgaccggacccgaacggtcccgtaccccggtccccgttacccggtacccg

SEQ ID NO: 292677 - DNA, 675 bp, Homo sapiens
  misc_feature: GYAE6OF02GSDS6.48.26.C04.1.454.CMB.1.raw
  modified_base (231)..(231): a, c, t, g, unknown or other
  misc_feature (231)..(231): n is a, c, g, or t
  modified_base (257)..(257): a, c, t, g, unknown or other
  misc_feature (257)..(257): n is a, c, g, or t
  modified_base (323)..(323): a, c, t, g, unknown or other
  misc_feature (323)..(323): n is a, c, g, or t
tcagagtatacatacacgaccggtgctcgatttagtctagcgactttgggtttggggggggggtctcaggaggcagcgctctcaggacgtcaccaccatggcctgggctctgctcctcctcaccctcctcactcagggcacgagggtcctgggcccagtctgccctgactcagcctccctcgcgtccggtctcctggacagtcagtcaccatctcctgcacgtcggaaccngcagtgacgttggtgttaataacgtntcgtactccgtaggtaaccaagagccaacccgtaggacaaaccgacccccaaagtcaatgtattangtagtacaggtaacgcgcccgtacgtacgggtccctagaccgtacgtcttacgtcgtcggtacctacgtaacgttcgtacgggtaccaaaccgaccgtaccccttcgtaccgtaacccgttcgtccggttacgggccttaccgacggtcgtaggacggtaacgtacgggacgtacgttagtacgtttataccgttcgacgtacgtcttaacgaattacgcgaacgtacggactacggaactaacgtaaggttcggtacggttacgaccgggaggtaccgggactacggtctccggaaccgttcggtacgtccgaacggtccggaacgtcccgacccgttacccggtgtaccc

SEQ ID NO: 292678 - DNA, 686 bp, Homo sapiens
  misc_feature: GYAE6OF02HL6LE.48.26.C04.1.454.CMB.1.raw
  modified_base (317)..(317): a, c, t, g, unknown or other
  misc_feature (317)..(317): n is a, c, g, or t
  modified_base (524)..(524): a, c, t, g, unknown or other
  misc_feature (524)..(524): n is a, c, g, or t
tcagagtatacatacacgaccggtgctcgatttagtctagcgactttgggtttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtccaccatcctcctgcactcggaaccagcagtgacgttggtgttataactatgtctctcggtaccaacacgccaccgaggaccaacgaccccctaaagtcatagtatttagnggtaacgtcaagtacggccggcctcggtacgggtcctgacgtccgtcttcctcgtacggtccctaccggtaacgttcgtacggacccaaaccggtacccggtccccttaccccgtcgtacccggtccttacggtcggtccctaccgacgtcgtacggaggtacgaggtacggtactagttaacttagttcgtcgtacacgtccttanattcgtgacggtacgacgaaccgaactaacgtacgttggttaacggtacggttcggggacgggaccggaaccgttaggaccggtccggttacccggtacgtccggttaaccggcccggtaaccgccggttacccggtttccccggccccggtacgttacccg

SEQ ID NO: 292679 - DNA, 601 bp, Homo sapiens
  misc_feature: GYAE6OF02F6ZX1.48.26.C04.1.454.CMB.1.raw
tcagagtatacatacacgaccggtgctcgatttagtctagcgactttgggtttggggggggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtcacatcctcctgccactggaaccagcctagtcgacgtttggtgttaataacgtatgtctcctggtaccaacagcaccaggcaaacgccccaaagtcatgatttatgaggtcagtaagccggacctcgacgggtccctggactcgtcttcgtctggcctaccgaagtcctaggcaacacggccctcccgtcgtacccgtctccgtcgggtccctaccgacggtctggaggtatggaacggtcgtgtactttattacgtcgcagcttacatacgtgctaggcgacgtacgaactaagtggtacgttagtccgggagggtacggaccgaaggtcctacggtacccgtccgtacggttacgacgtacccgaagtcccgtccggacccccgttgtacccg

SEQ ID NO: 292680 - DNA, 689 bp, Homo sapiens
  misc_feature: GYAE6OF02J2SK2.48.26.C04.1.454.CMB.1.raw
  modified_base (211)..(211): a, c, t, g, unknown or other
  misc_feature (211)..(211): n is a, c, g, or t
  modified_base (515)..(515): a, c, t, g, unknown or other
  misc_feature (515)..(515): n is a, c, g, or t
tcagagtatacatacacgaccggtgctcgatttagtctagcgactttgggtttggggggggggtctcaggaggcagcgctctcaggacgtcaccaccatggcctgggctctgctcctcctcaccctctcactcgaggcacgagggtcctgggcccagtctcgccctgacctcgagtccctccctccggccggtccgggtctccgtaggacngtcagtccaccattcctcctgaccacgtacggaaccagtcgtagtcggacggtttggttacgttaactaacttagttcgtcctccgtacggtaaccaacacgaccaccgaggaccaaccgaccccaaagtccatgtacttagcgaggtacaggtacggccgtaccgtcggacggtccgtgacgtccgtcttacgtcgtcgcctaccgtagtcgtcggaccaccgccgtaccctccgtacgtcccgtcggtccgcggacccgtcgcggtcgaggtaggagtggacgttctagttaattacggttntaccggacgtacgtacctcgtacgtacgtgacggtacggacaacggtaacctaagttaagttccggttaacggtcggtacggggaccgggtacggaaccgaggttaccggccgttaccggtaccgtaccggccgacggtacccggctacccggcccgtacccggtccgttaccg

SEQ ID NO: 292681 - DNA, 743 bp, Homo sapiens
  misc_feature: GYAE6OF02FVPU9.48.26.C04.1.454.CMB.1.raw
tcagagtatacatacacgaccggtgctcgatttagtctagcgactttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtcgacggttggtggttaataacttatgttccttcctacggtaaccaaaccgtagccaaccccgaggaccaaaaccgccccccgaaaagtcctaagtgtaattttagtacggacggttaccgaaggtaaacggtcccgggtaccccgttacggacgggggttcccctaggtacgtccgtcctttacttcggtacggtccttacccgaaacggtttcctacgggtaaccaaacccggtacccgggtcccctttccccgtaccggtaaccccgttcgttaccggttccggggccctttaccccggagggtacccgtaggtaacgggtacgtcgggaagggttccctaaggttacctttaacgttcgtacgcttacggtaccttacgtagttactcggcgacgtcacgacaacgttaagtggtacttcggttcgggacggacggtacgaacgtcgtaccggtaccgttacgttacggtcctaaccggacccacggtccgtacccgtccccgg

SEQ ID NO: 292682 - DNA, 673 bp, Homo sapiens
  misc_feature: GYAE6OF02GLFZR.48.26.C04.1.454.CMB.1.raw
  modified_base (201)..(201): a, c, t, g, unknown or other
  misc_feature (201)..(201): n is a, c, g, or t
  modified_base (230)..(230): a, c, t, g, unknown or other
  misc_feature (230)..(230): n is a, c, g, or t
tcagagtatacatacacgaccggtgctcgatttagtctagcgactttgggtttgggggggggtctcaggaggcagcgctctcaggacgtcaccaccatggcctgggctctgctcctcctcaccctctcactcagggcacgagggtcctgggcccagtctgccctgactcagccctccctccgcgtccgggtctcctggacngtcagtccacatctctgcacgtggaaccngcagtcgtacgttggtagttaataactatcgtccttccgtacggtaccaacgagaccaacccgtaggaccaaacgaccccctaaagtcattacgtatttagtgtaggtacgtaaggtaacggccggtacccgttacggaccggggttccctaggtactcgttccgttactcgtcggtcctacgtaacgtccgttagaccgaacgtccggtcccttacccgtacgtacccgttcgtccggtacgggttccctacgacgggtcgtagggaacggtacggtacggacggtccgttaggttaacttacgttaccgcgtacgtaccgtctaccgtaaggtttagcgacgaggtacacgaactaacgtagttacggtgtacgtcggacggacgcaaggtcgtaccgccgtacgtacgtacgacgcggtaccgccgcctcccggtatccg

SEQ ID NO: 292683 - DNA, 817 bp, Homo sapiens
  misc_feature: GYAE6OF02HG0MU.48.26.C04.1.454.CMB.1.raw
  modified_base (232)..(232): a, c, t, g, unknown or other
  misc_feature (232)..(232): n is a, c, g, or t
tcagagtatacatacacgaccggtgctcgatttagtctagcgactttggggtttggggggggggtctcagggaggcagcgctctcaggacgtcaccaccatggcctgggctctgctcctcctcaccctcctcactcgagggcacgcgggtccgtgggccctagtctcgccctgactcgacgtccctcccgtccggccggttccgggtcctccgtggactcgtcacgtcaccnctcctcctgacctacgtacggaaccagcgtaggtcggtacggtttgggtaggtttaataactgttcgttcgtaccgtacgtaaccaacgcgaccgaaccgaggaaccaaaccgaccccgtaaagtctacgttagttaagtttaggtaacggtacggtacgtaacgggtaaccggcccggtacccgtacggggtaccgggttacctaggttaccgtaccttccgtttccggtcggttaccggtacccttaccggtaacggtccgtaccggtaacccgaaaccggtccccggttccccgtttacccggtaccggtcccggtttcgtcgggtcccgggtacccgtccggtacggtaccggttagggaaccggtagtacggggtaacgtagtttacgttacgttacgtacgtcggactacgtcttaagtacgtcggtacgacgtacggacgtaaccgacttaacggtacgttgggttacggtacgggtaccggggacggtacggtaacccgtggtacccggacgggttacccgttacggaccggtaccgaccgggaccgtcgggtccccttcccggacccgttgtaccc

SEQ ID NO: 292684 - DNA, 691 bp, Homo sapiens
  misc_feature: GYAE6OF02FWV1I.48.26.C04.1.454.CMB.1.raw
  modified_base (216)..(216): a, c, t, g, unknown or other
  misc_feature (216)..(216): n is a, c, g, or t
  modified_base (222)..(222): a, c, t, g, unknown or other
  misc_feature (222)..(222): n is a, c, g, or t
  modified_base (235)..(235): a, c, t, g, unknown or other
  misc_feature (235)..(235): n is a, c, g, or t
  modified_base (359)..(359): a, c, t, g, unknown or other
  misc_feature (359)..(359): n is a, c, g, or t
tcagagtatacatacacgaccggtgctcgatttagtctagcgactttgggtttgggggggggtctcaggaggcagcgctctcaggacgtcaccaccatggcctgggctctgctcctcctcaccctcctcactcagggcacagggtcctgggcccagtctcggccctgactcacgccctccctcgcgtccgggtctccgtggactagtcagtccacntctccngcacgtggaaccngcaggtcgacgttggtagttataactatcgtctcctacggtaccaacagccaaccgagaccaaacgcccccaaagtccatgtacttatgaggtcaggtaacggccggtacctggacgggttccngactcgtcttctcgtgcctcgagtcgacgacaacgtccggccttccgtcgtacccgttctaccggtcggcctaccggacggtccgttaaggacggtacgtaggtacggtacgttacgttaacgtttacgttacgttcggacttcgtaccgtacttacgtaggttcggaccgtacggaccaggtaacctaaacggtaagtttcgggtaacggtttacgggtaccggggagggttaacccggaccgtaacggtccggttaccggttaacccggtcggtaaccgtaccgtaccggacccggaacggtcccgtacccgttccccgtacgttacccg

SEQ ID NO: 292685 - DNA, 719 bp, Homo sapiens
  misc_feature: GYAE6OF02HMZ7H.48.26.C04.1.454.CMB.1.raw
  modified_base (336)..(336): a, c, t, g, unknown or other
  misc_feature (336)..(336): n is a, c, g, or t
tcagagtatacatacacgaccggtgctcgatttagtctagcgactttgggtttgggggctggggtctcaggaggcagcgctctcaggacgtcaccaccatggcctgggctctgctcctcctcaccctctcactcgagggcacagggtcctgggcccagtctgccctgactcacgcctccctcgcggtccggtctctggacagtcagtccacatctcctgcacgtacggaaccagctaggtcggtacgtttgggtagttaataactatcgttctcgtagtaaccaacgacgaccaccgaaggaacaaaccgacccctaaagtcaatagtactttagnggagtacaggtacgccggtcctggaacgggttcctagactacgtcttcgtacgtcgacctaccgtagtcgtacggacaaacgccggtacccttacccggtagtaccgttcctcggtaccggtccttacggacggtacggtaggtaaccgggtaagtcgggtaacggtacgtttaacggttaaacgtttaacgtttaccgacgtaccgtaagttccgtaactaacgttggaaccgtagaacgggtaccaacgaacctaaagtacggtggttaacgggtttacgtcgggaacgggtaacgtaaccggtacgttacggacgtttaacccggtaggtaccggttaacaaccgggtacctaaccgggttctaccccggttacccccgg

SEQ ID NO: 292686 - DNA, 781 bp, Homo sapiens
  misc_feature: GYAE6OF02GZCE6.48.26.C04.1.454.CMB.1.raw
  modified_base (230)..(230): a, c, t, g, unknown or other
  misc_feature (230)..(230): n is a, c, g, or t
  modified_base (325)..(325): a, c, t, g, unknown or other
  misc_feature (325)..(325): n is a, c, g, or t
tcagagtatacatacacgaccggtgctcgatttagtctagcgactttgggtttgggggctggggtctcaggaggcagcactctcgggacgtctccaccatggcctgggctctgctcctcctcagcctcctcactcagggcacaggatcctgggctcagtctgccctgactcagcctcgctcagtcgtccggtctcctggacagtcagtcacatctcctgcacgtgaaccngcagtcgatgttgtgactaatacctatcgtctccgtacggtaaccaacaacgacgacgaggaccaaaccgcccccaaactcagtacgtactttangtactgtacacgtaacgccggtacctcggacgggtaccctgaccgttcgtctttaccgtcgtacggtacctaccgtaacgtccgtacggaaccctaaccgccggtacccctccgtacgtaaccctaccttaccggtccgttaccggggtacccttaccggaacgggttccgttaacgggtaaacgtacgtaccgggtaacggtaccgtttaaggttaacgtttttaaccgtttaccggtacgtttacccttacgggtaccctttaccgttaacgtttaccggtaccgtaacccggtaaaccggtacccctttaaacgtttacgttttaacccggttacgggttttaacccggttaacccgggtaaaccgtttaaccgggtaaacccggttaacccggttaaacccgggtttacccctaaccccgggttttaacccggttaacccgggtaaccccgg

SEQ ID NO: 292687 - DNA, 754 bp, Homo sapiens
  misc_feature: GYAE6OF02HTBEG.48.26.C04.1.454.CMB.1.raw
  modified_base (226)..(226): a, c, t, g, unknown or other
  misc_feature (226)..(226): n is a, c, g, or t
  modified_base (248)..(248): a, c, t, g, unknown or other
  misc_feature (248)..(248): n is a, c, g, or t
  modified_base (269)..(269): a, c, t, g, unknown or other
  misc_feature (269)..(269): n is a, c, g, or t
tcagagtatacatacacgaccggtgctcgatttagtctagcgactttgggtttggggggggggtctcaggaggcagcgctctcaggacgtcaccacatggcctgggctctgctcctcctcaccctcctcactcagggcacagggtcctggcccagtctgccctgactcagcctccctccgcgtccggtctctggacagtcagtcacatctcctgacactggaaccngcagtgtacgttggtggttaanactatgtctctaggtaccaanagcaccgaggacaaacgaccccaagtcactagtattacgtcgtaggacaggtacgccgcctacgtacgggtcctagtactcgtcgttctcgtacgctaccgaagtcgtaggacaaaccgtccggttacctaccgttcgaacccgttcgtacggtccggtaccttaccgacggtccgtaaggtaacgtacggtacggaggtccgttaagtaaacgtttcctttaacggacgtaccaacgtaaccgtacgtaaattaacggtcgaaccggtaacgtacgtaaaccggtaacctaaacgggtaactttagggggtaaccgtttaacgggtaaccggggaacccgggtaacgggtaaacccgacgggttaccggttaaccggtaaaccccggtttaaccggttaacccgggtaactaccccgggaaaacccgggttaacggtacccccggtttccccggttaaccccccggttagggtttaacccccgg

SEQ ID NO: 292688 - DNA, 681 bp, Homo sapiens
  misc_feature: GYAE6OF02GD1QM.48.26.C04.1.454.CMB.1.raw
  modified_base (231)..(231): a, c, t, g, unknown or other
  misc_feature (231)..(231): n is a, c, g, or t
  modified_base (325)..(325): a, c, t, g, unknown or other
  misc_feature (325)..(325): n is a, c, g, or t
tcagagtatacatacacgaccggtgctcgatttagtctagcgactttgggtttggggggggggtctcaggaggcagcgctctcaggacgtcaccaccatggcctgggctctgctcctcctcaccctcctcactcagggcacagggtcctgggccagtctgccctgactcacgcctccctccgcgtccgggtctcctggacagtcagtcacatctcctgcacgtcggaaccngcagtgacgttggtagttatactatcgtctccgtgtaccaacacgccaccgagacaaaccgacccccaagtcagtagtatttagtaggacgtanaacggtacggccggccttggtacgggttcccagtacgtccgtcttacgtcgtcgtcctaccgtaggttcgtacggacctaaccgaccgggttccccttacccgtacggtacccttaccggtccgtcgggtccctacggacggttcctagggacgtaacgtcggaacggtcttagtaactttacttacggacgtaccgtacgtacgtctaatttacgcgttacggacgtcaaccgacgtaacgttaagttcgggttacggttaacgtccggggacggtacggtactacggtcgtaccgtaccgtacgtacgtacgaccgtaccggtacgtccctacccgggtaccccgtaggtaccc

SEQ ID NO: 292689 - DNA, 730 bp, Homo sapiens
  misc_feature: GYAE6OF02F2LGR.48.26.C04.1.454.CMB.1.raw
  modified_base (230)..(230): a, c, t, g, unknown or other
  misc_feature (230)..(230): n is a, c, g, or t
  modified_base (256)..(256): a, c, t, g, unknown or other
  misc_feature (256)..(256): n is a, c, g, or t
  modified_base (275)..(275): a, c, t, g, unknown or other
  misc_feature (275)..(275): n is a, c, g, or t
  modified_base (318)..(318): a, c, t, g, unknown or other
  misc_feature (318)..(318): n is a, c, g, or t
tcagagtatacatacacgaccggtgctcgatttagtctagcgactttgggtttggggtggggtctcaggaggcagcgctctcaggacgtcaccaccatggcctgggctctgctcctcctcaccctcctcactcagggcacgagggtcctgggcccagtctgccctgactcagcctccctccgcgtccgggtctcctggacagtcagtcaccatctcctgcactggaaccngctagtgacgttggtagttataactntcgtctcgtcggtaaccancgaccaccgaggaccaaacgacccccaaagtccatcgatttangtagtactaggtaacgcgtaccctggacgggtcctagtactcgtcttctcgttcgcctaccgtaagtccgtacggaccgtaaccgacccgggtccctcccgtaccgtacccggttccgttaccggtcggtcccgtcccgtacgggtcgtacgggacggttacgtgggtaacggtcgtaaggttaactttaccgttacgtacggtaccaacggttcctacgtacgttacgacggacgtaacggaccgtaaacgacgttaaaccgtagttaacggttagggttaaccggtttaccggggaccggtaacgggaccggtaacgttcccgtaaccgggtacccgttaaccggttacggtaacccggaccggtaacccgtaccggtacccgtttacccccggcccccgtttaaccggg

SEQ ID NO: 292690 - DNA, 753 bp, Homo sapiens
  misc_feature: GYAE6OF02JQN41.48.26.C04.1.454.CMB.1.raw
  modified_base (210)..(210): a, c, t, g, unknown or other
  misc_feature (210)..(210): n is a, c, g, or t
  modified_base (243)..(243): a, c, t, g, unknown or other
  misc_feature (243)..(243): n is a, c, g, or t
  modified_base (638)..(638): a, c, t, g, unknown or other
  misc_feature (638)..(638): n is a, c, g, or t
tcagagtatacatacacgaccggtgctcgatttagtctagcgactttgggtttgggggggggtctcaggaggcagcgctctcaggacgtcaccaccatggcctgggctctgctcctcctcaccctcctcactcagggcacgcggtcctgggcccagtcgtcgccctgactcacgccctcccgtccgcggtccggtctccgtggacagtcngtcacactctcctgctacgtcggaaccagcagngtacgttggtcggttaataacttatcgtctccgttaggaccaagcgaccgaacccgaggacccaaacgacccccaaagtccagtacgtattaacgcggtaacggactaacggtaacggccccggacccgtttacgggaaccggggttacccctgggtaacgttcccgtacgtttaccgtcggttaaccggtccttacccgtaaaggttccgtaacggggaacctaaaaccccggcggtccccgtacccgttaccggtaacccggtttccgtacccgtttccggggacgtaccccgtagggtacgtaccggaagggtacgtaacggaacggttcgtagttaacgtttacgtacggtacgtacgacgttacctagttcgtacgtcgaccgacggtanacgtaccgaattaccgttagttcgtacggttcgggaacggacgtacgagtccggtcgaccggtaccgacggtacgacgcccggtacgccgtcccggtttaacccgcggtaacccg

SEQ ID NO: 292691 - DNA, 698 bp, Homo sapiens
  misc_feature: GYAE6OF02I30O3.48.26.C04.1.454.CMB.1.raw
  modified_base (577)..(577): a, c, t, g, unknown or other
  misc_feature (577)..(577): n is a, c, g, or t
  modified_base (615)..(615): a, c, t, g, unknown or other
  misc_feature (615)..(615): n is a, c, g, or t
tcagagtatacatacacgaccggtgctcgatttagtctagcgactttgggtttggggtggggtctcaggaggcagcgctctcaggacgtcaccaccatggcctgggctctgctcctcctcaccctcctcactcaggcacaggtcctgggcccagtctgccctgactcacgcctccctccgcgtccgggtctccgtggacagtcacgtcaccatcctccgtgcacgtaccggaaccagcgtacggtgacggtttggttacggttaataacgtatcgttccttccgtaggtaaccaacgaccgtaccaacccgaaggacccaaaacccgtaccccccgaaaagtcctaagttacgttaagttttactacggtaagttaccgaaaggttaccggaccggtaccccctggaaccggggttccctcggacttaccggtccttacgtcgtcgacctaccgtagtcgtacgtaccaacgtcccggtccctacccgtacgtacccttcgtcgtcggtacctccgaggtcgtacgggtacgtagtaacgcggtacttacgtaacgttttaacttcgtacgcgttanccgtcaagttcgacgaccgtggacacgaactaacgttntcgggtacttagggtcggacggacgacgaccggtctacggtcgttaccgagcacccgtacgcgtcccgtaccggtccctacgg

SEQ ID NO: 292692 - DNA, 681 bp, Homo sapiens
  misc_feature: GYAE6OF02IUFYP.48.26.C04.1.454.CMB.1.raw
  modified_base (144)..(144): a, c, t, g, unknown or other
  misc_feature (144)..(144): n is a, c, g, or t
  modified_base (182)..(182): a, c, t, g, unknown or other
  misc_feature (182)..(182): n is a, c, g, or t
  modified_base (185)..(185): a, c, t, g, unknown or other
  misc_feature (185)..(185): n is a, c, g, or t
  modified_base (201)..(201): a, c, t, g, unknown or other
  misc_feature (201)..(201): n is a, c, g, or t
  modified_base (259)..(259): a, c, t, g, unknown or other
  misc_feature (259)..(259): n is a, c, g, or t
  modified_base (277)..(277): a, c, t, g, unknown or other
  misc_feature (277)..(277): n is a, c, g, or t
  modified_base (458)..(458): a, c, t, g, unknown or other
  misc_feature (458)..(458): n is a, c, g, or t
  modified_base (466)..(466): a, c, t, g, unknown or other
  misc_feature (466)..(466): n is a, c, g, or t
  modified_base (499)..(499): a, c, t, g, unknown or other
  misc_feature (499)..(499): n is a, c, g, or t
tcagagtatacatacacgaccggtgctcgatttagtctagcgactttggggtttgggggggggtctcaggaggcagcgctctcgtaggacgtcaccacatggcctgggctctgctcctcctcaccctctcactcgagggcacgnggtccgtcggcccagtctcgcctgactcgagtcctccncgngtccggtctcgtgacngtcgacgtcacagtctcgtgcctacgaggacctgctagtcgtacgtgtacgtatagtntagtctcgtacgactacncgtcgaccgagccgaacgaccccgtaagtcgaacgtgttagttacgtaggacgtacgtatacggccggtacgtcggacggttcctaggactcgtcgtccgtacgcgtacgtactacgtcgtagaccaacgtccgacccttccgacgacctcgtcgtacggtacctacgacgtcgtaacggngtaacggngtagtacgtacgttaacttcgttacggttaacncggtactccgtagactttacggacgtacgtacgacgacgttaaccggaagttacggtcggttaacccggttaggtaccgggaccggtaaccgtaacggtaaccgttccgaaccggttaccgtaaccggttacggcctaacggtcccgtaaccgtcggacccggttaccggtccttaacccgg

SEQ ID NO: 292693 - DNA, 743 bp, Homo sapiens
  misc_feature: GYAE6OF02H8PPW.48.26.C04.1.454.CMB.1.raw
  modified_base (251)..(251): a, c, t, g, unknown or other
  misc_feature (251)..(251): n is a, c, g, or t
  modified_base (274)..(274): a, c, t, g, unknown or other
  misc_feature (274)..(274): n is a, c, g, or t
  modified_base (312)..(312): a, c, t, g, unknown or other
  misc_feature (312)..(312): n is a, c, g, or t
tcagagtatacatacacgaccggtgctcgatttagtctagcgactttgggtttggggtggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactcggaaccagcagtcgacgttggtgttanaactatgtctcctggtaccaacncgacaccagaccaaacgcccccaagtcatgtatttacngagtcagtaacgccggcctcgacgggtccctgactcgtcttctcgtacgtcctaccgtagtcgtacggacaaaccgccgtccctcccgtcggtacccgttctacggtcgggccctaccggacggtcgtaggacgggtactgggacggtacgttaggttaatttaacggttacgttacgacgtaccgttactacgtaagttacggtacggacgtaccgggtaacgtaaccggtaacctaaaccgttaaggttcggtttaaacggggtttcgggtacccggggtaaaccggggttaaccggggaaacccggtaacgttacccgggtaaccggggtaccccgttttaaccccgggtacgggttaccccgggacccgggtaacccccggttaacgggtaccccggttccccccgggtacccccccggtttcccgg

SEQ ID NO: 292694 - DNA, 629 bp, Homo sapiens
  misc_feature: GYAE6OF02G6GAE.48.26.C04.1.454.CMB.1.raw
  modified_base (251)..(251): a, c, t, g, unknown or other
  misc_feature (251)..(251): n is a, c, g, or t
  modified_base (405)..(405): a, c, t, g, unknown or other
  misc_feature (405)..(405): n is a, c, g, or t
  modified_base (481)..(481): a, c, t, g, unknown or other
  misc_feature (481)..(481): n is a, c, g, or t
  modified_base (497)..(497): a, c, t, g, unknown or other
  misc_feature (497)..(497): n is a, c, g, or t
  modified_base (529)..(529): a, c, t, g, unknown or other
  misc_feature (529)..(529): n is a, c, g, or t
tcagagtatacatacacgaccggtgctcgatttagtctagcgactttgggtttggggtggggtctcaggaggcagcgcgtctcaggacgtcaccaccatgcctggctctgctcctctcaccctctcactcagggcacagggtcctgggccagtctgccctgactcacgctcctcgcgtccgggtctcctggacagtcagtccaccagtcctactgcacttcggaaccagccagtagacgttggtcgttaanactatgtctcctggtacctaacgacgtccaccgagtcaaacgtcccccaaaagtcatcgattactgacgtacagttaacgccgtcctacgacgggtcccttgactacgtcttctctagggcctaccagttactggcaacgtccggacttccccnggtacccttcgtcgtacgggacttccacgggtactgggaacggactggaacgtctaggtaccttaattacgtcgcnggtacttacacgttancgtacgaggtctaacgctaaacgtacgttacngggttaattcgggacgtacgggaaccgtaacgcgttaaacggcccgtttaccggtagtaaccggtcgcccggttaaggccgtttacccgccccggtttac

SEQ ID NO: 292695 - DNA, 769 bp, Homo sapiens
  misc_feature: GYAE6OF02IKOWM.48.26.C04.1.454.CMB.1.raw
  modified_base (240)..(240): a, c, t, g, unknown or other
  misc_feature (240)..(240): n is a, c, g, or t
  modified_base (259)..(259): a, c, t, g, unknown or other
  misc_feature (259)..(259): n is a, c, g, or t
  modified_base (578)..(578): a, c, t, g, unknown or other
  misc_feature (578)..(578): n is a, c, g, or t
  modified_base (620)..(620): a, c, t, g, unknown or other
  misc_feature (620)..(620): n is a, c, g, or t
tcagagtatacatacacgaccggtgctcgatttagtctagcgactttgggtttggggggggggtctcaggaggcagcgctctcaggacgtcaccaccatggcctgggctctgctcctcctccaccctcctcactcgagggcacgacgggtccgtcgggacccagtctcgccctgactcacgccctccctccggtcggtcccggtcctccgtcggactagtcgacgtccactatcctccgnacacgtacggaaccagcgnggtacggtacggtaggttagttaactaaccgtatcggtaccttccgtaggtaaccaacgacgacccaaccgaacggaaccaaacccgtaacccccgtaaggtaccagttacggtaattttacggcgtaacggtaacgaacgttaacggccggtaaccgtcgggtaccgggtccaagtctcgtccgttacctcggtacgtacgtaccaggttccgagacccgtaaccgacggtcccctcgacgtccgttaccgtcgtcgggtccctagacggttcgacgggtaagtcgggtaacgcgttacgtaagtttaattacgttcncgtaacgccgtaatctaaacgttgcgaaccgtcgacgaaaanaccggtttaaatcggtttaaacgggttcggaaccggggtacgggaaacggggtacggttaaccagggtcccggttaacctaaccgggtagtaccccgggaactaccggtaccggaccggttcccgcccccggaccggtttcggtaaccg

SEQ ID NO: 292696 - DNA, 673 bp, Homo sapiens
  misc_feature: GYAE6OF02FJKI6.48.26.C04.1.454.CMB.1.raw
  modified_base (271)..(271): a, c, t, g, unknown or other
  misc_feature (271)..(271): n is a, c, g, or t
  modified_base (522)..(522): a, c, t, g, unknown or other
  misc_feature (522)..(522): n is a, c, g, or t
  modified_base (562)..(562): a, c, t, g, unknown or other
  misc_feature (562)..(562): n is a, c, g, or t
tcagagtatacatacacgaccggtgctcgatttagtctagcgactttgggtttgggggggggtctcaggaggcagcgctctcaggacgtcaccaccatggcctgggctctgctcctcctcaccctcctcactcagggcacagggtcctgggcccagtctgccctgactcagcctccctcgcgtccggtctcctggacagtcagtcactatctcctgcacgtggaaccagcagtcgacgttggtgttataactatcgtctcctggtaccaangacacccaggacaaacgacccccaaaggtcagtcgtatttacgtgacggtacaagtaacggccggtacctcggacggggtccctagtacgtccgtcttccgtcgttcggcctaccgtaaacggtccttcgggacaaccgacccggtccgtacccgtcgtaacccgttccgttccgtacgggccttaccgacggccttagggagtacgttcggacggtccgttaggtaagttaacgttccggttgaccgttntaccgtactagtgtcgtcgagactacggtacaacgtagtntcggttacggtccgggtacggacggtaccgtaaggtccgcggttaacccggtaccgttacggccaacgggtcccgtaacggtcccggtcccggtaccccgtagttaccccg

SEQ ID NO: 292697 - DNA, 695 bp, Homo sapiens
  misc_feature: GYAE6OF02G5QTN.48.26.C04.1.454.CMB.1.raw
  modified_base (240)..(240): a, c, t, g, unknown or other
  misc_feature (240)..(240): n is a, c, g, or t
tcagagtatacatacacgaccggtgctcgatttagtctagcgactttgggtttgggggctggggtctcaggaggcagcgctctcaggacgtcaccaccatggcctgggctctgctcctcctcaccctcctcactcagggcacgagggtcctgggcccagtctgccctgactcagccctccctcgcgtccgggtctcctggactagtcagtccaccattcctcctgcctacgtcggaaccngcgagtgtacggttggtagttaactaactgtgtctccgtgtaccaacacgccaccgagacaacgaccccaagtctatgtattagtgagtcgaagtaagccgtcctacgtacgggtcctagacgtcgtcttcgtcgtcgtactacgtaacggtcgtacggaacctaaccgtacccggtcccttacccgtacggtcccgttcgtccgggtcggtccgtaccgtacggccgttaggaaggtacgtgggtacggtctacggttagtttaacttaccgtagacgttacgtacctgttaatcggtcgacgtaggacgacgtaccaaacgtacgttggtacggttacggttaccggaacgggtaaccggtaaccgtacggtaccgtacggtacccgttaaccggttaccggtacccggtaaccgtaaccgggtaccggttacccgttacccgttaccccggg

SEQ ID NO: 292698 - DNA, 662 bp, Homo sapiens
  misc_feature: GYAE6OF02GLLNO.48.26.C04.1.454.CMB.1.raw
  modified_base (229)..(229): a, c, t, g, unknown or other
  misc_feature (229)..(229): n is a, c, g, or t
  modified_base (305)..(305): a, c, t, g, unknown or other
  misc_feature (305)..(305): n is a, c, g, or t
tcagagtatacatacacgaccggtgctcgatttagtctagcgactttgggtttggggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcacatctcctgcactggaaccngcagtgacgttggtgttataactatgtctcctggtaccaacagcaccaggcaaacgcccccaaagtcatgatttangaggtcagtaagccggcctcgacgggtccctgactcgcttctcgtcggctccaagtctggacaacgaccggtccctccgtcgacccgtcttcgtcgggtcctccgaggtcctaggacggtagtggtacggtcgttaggtaacttttaacgttaccgtcggaccgtaacgtccttacgtaagttacgacgcggtacgggtactaacggacctaaacgtaacgttgggttacgggttaacgttccggggacggggtaacgggaacccgtaaggtccgtaccggtaacccggttacgttaaccgggtccgtaaccggacccggtaacgggtccctacccggtcccccgttcgggtacccc

SEQ ID NO: 292699 - DNA, 642 bp, Homo sapiens
  misc_feature: GYAE6OF02JUNTC.48.26.C04.1.454.CMB.1.raw
  modified_base (183)..(183): a, c, t, g, unknown or other
  misc_feature (183)..(183): n is a, c, g, or t
  modified_base (197)..(197): a, c, t, g, unknown or other
  misc_feature (197)..(197): n is a, c, g, or t
  modified_base (204)..(204): a, c, t, g, unknown or other
  misc_feature (204)..(204): n is a, c, g, or t
  modified_base (208)..(208): a, c, t, g, unknown or other
  misc_feature (208)..(208): n is a, c, g, or t
  modified_base (210)..(210): a, c, t, g, unknown or other
  misc_feature (210)..(210): n is a, c, g, or t
  modified_base (215)..(216): a, c, t, g, unknown or other
  misc_feature (215)..(216): n is a, c, g, or t
  modified_base (226)..(227): a, c, t, g, unknown or other
  misc_feature (226)..(227): n is a, c, g, or t
  modified_base (231)..(231): a, c, t, g, unknown or other
  misc_feature (231)..(231): n is a, c, g, or t
  modified_base (246)..(246): a, c, t, g, unknown or other
  misc_feature (246)..(246): n is a, c, g, or t
  modified_base (265)..(265): a, c, t, g, unknown or other
  misc_feature (265)..(265): n is a, c, g, or t
  modified_base (267)..(267): a, c, t, g, unknown or other
  misc_feature (267)..(267): n is a, c, g, or t
tcagagtatacatacacgaccggtgctcgatttagtctagcgactttgggtttgggggctggggtctcaggaggcagcgctctcaggacgtcaccaccatggcctgggctctgctcctcctcaccctcctcactcagggcacgacgggtcctgggcccagtctcgccctgactcagcctcccncgcgtccggtctcngcagtcngtcncntctcnncacgtcgacnncagngtacgttgtagttanaactgctctctcgaccacncnccgaccgagaccgaaccaccccaagtctacgtagtactttagaggtacgtataacggtacggccggtccctacgtaggttcgtttactaacgttccggtacttcgttccgtaacggttctaacccgttagtccggtacgaccctaaccgccggttcccctacgtacgaacctaacgttccgtcggtaccgtccttaccgacggtcgttacggacggtacgtgtacgtgttattacttgttcgactgtcctgtatcgtagcgtagttcgtacgttcggttggtacgttggacgtagggtacgaccaggtctaccggtaccgtcgtacggaacccgtacgtacccggtacgtcccctaccgtccccggtgttaaccc

SEQ ID NO: 292700 - DNA, 910 bp, Homo sapiens
  misc_feature: GYAE6OF02IYXMI.48.26.C04.1.454.CMB.1.raw
  modified_base (216)..(216): a, c, t, g, unknown or other
  misc_feature (216)..(216): n is a, c, g, or t
  modified_base (306)..(306): a, c, t, g, unknown or other
  misc_feature (306)..(306): n is a, c, g, or t
  modified_base (706)..(706): a, c, t, g, unknown or other
  misc_feature (706)..(706): n is a, c, g, or t
tcagagtatacatacacgaccggtgctcgatttagtctagcgactttgggtttggggtggggtcgtcaggaggcagcgctctcaggacgtcaccaaccatggccgtgggctctgctcctcctcaccctcctcactcaggcacgagggtcctcgggccctaggtcctcgccctcgactccgacgccctcccgtccgccggtccggtctccgtggacngtcaggtccaccatcctcctcgcactacggaaccagccagtgtacggttggtggttaatacttagtcgtccttccgtacggtaaccaacncgaccaaccgacgaacgaaaaccccgacccccgtaaagtcctaagttagttaacgtttagtagggttaaccggtactaaacggggttaacccggcccggttaccccgttaccggggtaccgggggtcccccgtttaggtaccgtaccggttccctttccggtacccggttccgggtacccttaaccggttaacttcccgggtaccgggtaacccaaaccggttaccccgggtccccgtttaccccgtaccggtacccccggtttttcggtccccgggttcgggtaacccccgtccggtacgggtcccggttaagggacgggtaggtccggtacgggtacgtttacggttaaaccgttttagttaccgtccggtcccgtaacgtcctactaaagtttccgngggtacgcgtaaccgaccgtaaccgtaaacgttggtttaacggccgggtttaaccggtcgggggtaacgggaaccgggtaaacccgtcgggttacccgggtacccggttaacccggtttaacccgggaacgggtttacccggaccccggtaaccccgggtaacggtttccccccgtccccccgggtttaacccggtttacccgg

SEQ ID NO: 292701 - DNA, 678 bp, Homo sapiens
  misc_feature: GYAE6OF02G13SU.48.26.C04.1.454.CMB.1.raw
  modified_base (204)..(204): a, c, t, g, unknown or other
  misc_feature (204)..(204): n is a, c, g, or t
  modified_base (235)..(235): a, c, t, g, unknown or other
  misc_feature (235)..(235): n is a, c, g, or t
  modified_base (266)..(266): a, c, t, g, unknown or other
  misc_feature (266)..(266): n is a, c, g, or t
  modified_base (286)..(286): a, c, t, g, unknown or other
  misc_feature (286)..(286): n is a, c, g, or t
tcagagtatacatacacgaccggtgctcgatttagtctagcgactttgggtttggggggggggtctcaggaggcagcgctctcaggacgtcaccaccatggcctgggctctgctcctcctcaccctcctcactcagggcacgagggtcctgggcccagtctgccctgactcacgcctccctccgcgtaccgggtcctctggacngtcagtcactatctcctgctacgtagaaccngactagtcgtacgttggttagttaataactntcgtctcgtaggtaccacgnaccaccgagacaaccgacccaagtcatgtattagtgacgtacaagtaccgcggccctggtacgggtccctagtactcgtcgttcgtcgtcgtaccgtacgtacggttcacggtactaaccggaccggtcccttaccgtacgttcccgtacgtccggtacggtcctacccgtagggccgtaaggtacggtggtacggtacgttagtacgttaactttacgtcggtacgacgtacgactactagtaccgcgaacgtacggacgtacgtacgtaattacgtcggttaacgtaccggtacgggacggtacgacgtaacggttccggaacggttaccgttaccggtacgtaccgtaccgggtacctacggcccgtacccgtaccggtcgtaaccccg

SEQ ID NO: 292702 - DNA, 802 bp, Homo sapiens
  misc_feature: GYAE6OF02G1P6Y.48.26.C04.1.454.CMB.1.raw
  modified_base (201)..(201): a, c, t, g, unknown or other
  misc_feature (201)..(201): n is a, c, g, or t
  modified_base (267)..(267): a, c, t, g, unknown or other
  misc_feature (267)..(267): n is a, c, g, or t
tcagagtatacatacacgaccggtgctcgatttagtctagcgactttgggtttgggggggggtctcaggaggcagcgctctcaggacgtcaccaccatggcctgggctctgctcctcctcaccctcctcactcaggcacacgggtcctgggcccagtctgccctgactcacgcctccctcgcgtccgggtctccgtggacngtcagtccacctatcctcctgcacgtaggaaccagctagtggtacgtttggtgttaactaacgttntcggtcttccgtaggtaccaacgacgaccacccgaggaccaaaccgcccccaaagtcatgtatttagtggacgtactacggtaacggccgtaccctacggtaccgggtccctaggcgtccgtcctttacgtcgtccggtccttaccgtaaggttccgaccggtaccaaaccggtcccggtccccttacccggtacgtaccccggtttccgtccggtttaccgggccttacccgggtgtacgttacggaaagggtcgtaggacggttacttaaccggttaattttaccgtgttaaccgcgtaaccgttctaaccgttagttacggtacggacggtaacggaccaaacgtaaccgttaacggtacgtttgggttaaccgggttccgggtacgggggtaaccgggaacgggttaacccgtaaccggtcccgggttaaaccggttaccccggttaaacccggttcgggtaaccccgtaacccggggtaccccgaacgggtttacccccgtccccggttacccccgggttgttacccccg

SEQ ID NO: 292703 - DNA, 749 bp, Homo sapiens
  misc_feature: GYAE6OF02JKP39.48.26.C04.1.454.CMB.1.raw
tcagagtatacatacacgaccggtgctcgatttagtctagcgactttgggtttggggtggggtctcaggaggcagcgctctcaggacgtcaccaccatggcctgggctctgctcctcctcaccctcctcactcagggcacgagggtcctgggcccagtctcgccctgactcagcctccctccgcgtccgggtctcctggacagtcagtcaccatcctcctgcacgtcggaaccagcagtgtacggttggtggttaataactatcgtcctccgtacgtaccaacacgccaccgaggaccaaaccgaccccctaaagtctaagttcgtatttagcggtacggtacgtaacggtaacggccggtcccgtacgggtaccggggttccctaggtaacgttcgtccttccgtcgtcggaccttaccgtaacgttcgtacggaacctaacccgtaccggtcccttacccgtacgtacccgttcgtcggtccgggtacccttaccggacggtcgtaacggaggtacgtacgggtacgttaccgtagttactttacgttacggtcgtaccgtacgtactacgtaacgtcgtacgtacggacgtaccgaacgtaacgaacgttacggttacggttaacggttacggttaccggggacgggttacggaaccgtacggtacgtaccggtacccgttacggttaccggtacgtacccggtacccggtaaccggtcccgttaccccggtaccccgggttaccg

SEQ ID NO: 292704 - DNA, 788 bp, Homo sapiens
  misc_feature: GYAE6OF01EODE4.44.68.G02.1.454.CMB.1.raw
tcagacagtatatacacgaccggtgctcgatttagtcgatagtgaagggaaaggggactgatcaggactcctcagttcaccttctcacaatgaggctccctgctcagctccgtgggctgctaatgctctgggtctcgagggtccagtggagtattattataatgactctagtcctcccctcctcccgtcggcccgtccaccccgtgggagacggcccggtccctaccacttccttccttaggttaggttcttaggtaggaagtacggttcgttgggtaggtacaacgaactattctagtcggtagtacgtaggttacttgacgaaggaacggaccggcacgttaccgacctaacctaccgtcctagtacttcgtttacgttttccgggttacctacggtccgggtcccggttccgggttctcgtacgacgtagttcgtacgtcgtaccgtagtcactactcctaacaccgtaacgtacttactttaccaactaccgtagacctaacactaccagtacaacgggtggtcggacggtcgtaacggtacgtaggtttcggggtttacggttaacctttattacccgtgaacccgttaccgtaccgttaaaccgtttaccccttaaacccccggtaacccccgtttacggtaaccccgggttacgggaacccgggtaaacggtaaaccccgttacgtaaccggtttaaagggaacgttaaaaccgggttaaggttaaccggaaccggttcggttaccggggtaccttacccgggtaaccctacgttaaccgg

SEQ ID NO: 292705 - DNA, 562 bp, Homo sapiens
  misc_feature: GYAE6OF02HZ65F.44.68.G02.1.454.CMB.1.raw
tcagacagtatatacacgaccggtgctcgatttagtcgatagtgaagggaaaggggactgatcaggactcctcagttcaccttctcacaatgaggctccctgctcagctcctggggctgctaatgctctgggtctcagggtccagtggagatattataatgactcagtctcccctctccctggccgtcacccctggagagccggcctccatctcctgtaggtctagtgagagtcttggaggtcagaacatctatgtgactggtacttgcagaagaccgggcagtctccacaactcctgatctatttgggttccacgtcgggcctccggggtctctgacaggttcagtgccagtgcatcacacacagatttcacactgcacatcagcagagtggagctggacgagttggttggggtactatttacgtgactactaccgtaagttacctaacctaaaccccgttcctaacccggtttcgggaccgtaaggggaccctacggtaacgttaggaacgtaattaacggacgtaacgttggttacggacgtacggtcctaacctaacg

SEQ ID NO: 292706 - DNA, 616 bp, Homo sapiens
  misc_feature: GYAE6OF02GHB9D.44.68.G02.1.454.CMB.1.raw
tcagacagtatatacacgaccggtgctcgatttagtcgatagtgaagggaaaggggactgatcaggactcctcagttcaccttctcacaatgaggctccctgctcagctcctggggctgctaatgctctgggtctcagggtccagtggagatattataatgactcagtcctcccctctccctggccgtcaccccctggagagccggcctccatctcctgtagtctagtgagagtcgttggaggtcagaacatctatgtggactggtacttgcagaagaccggactagtcctccacaactcctgacttcttagtttcgggtccacgtccgggccctccggggtctcgtgacgtggttcaggttcgccagtcgctatcaacacacagtactttccactactgaccacatacagacaaggaggtgggaggtctacggacgtagttgggttacgggtcttaagttaccgtgactacgtaccgtaacgtttaccctaaaccgttaaacccccggtttcgtaacccggttacgggtaaccgaacgggtaccaaccggttaacgttaggtaacgtaagttaacggacgtaacgttcggtacggcgtacggtacctaccgtacg

SEQ ID NO: 292707 - DNA, 578 bp, Homo sapiens
  misc_feature: GYAE6OF02GJOGL.8.74.G08.1.454.CMB.1.raw
tcagctcgcgtgtccacgaccggtgctcgatttagtagctctatcagggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatcacctgcactggatccaggcggagacagttggggattatgattgttgtctcttggtatcagcatccacccaggcacacgacccccaaattcaattaatttatcagtcacgcagccggtccgttagggtttctgatcgtcttctcgtgctcagtctaggaccaacgaccgccctcctgactaactctctcggcctcacgtccgtaggacggacggaggtcttagtactttacttacgtcgcgtcgtctatagttagtggttcgttacctaactaccttcccttagtcgttaccgttacgggtaagggtcggtaaccgtaacgggttccgacccggttccgtcggtccgtcgaccgacccgtaaccggtaccccc

SEQ ID NO: 292708 - DNA, 860 bp, Homo sapiens
  misc_feature: GYAE6OF02HVRDO.8.74.G08.1.454.CMB.1.raw
  modified_base (215)..(215): a, c, t, g, unknown or other
  misc_feature (215)..(215): n is a, c, g, or t
  modified_base (245)..(245): a, c, t, g, unknown or other
  misc_feature (245)..(245): n is a, c, g, or t
tcagctcgcgtgtccacgaccggtgctcgatttagtagctctatcgagggggggggtcacaagaggcagcgctctcgggacgtctccaccatggcctgggctctgctgctcctcaccctcctcactcaggacacgagggtcctgggccccagtcctcgccctgactcacgcctgcccttccgtgtcgtggtcctcgtaggactggtcgatcaccntccacctgcacgtggactccgaggcggaanacgtagttggggaatttagtgtagttggttcgttccgtttagttaggttactaccgtacgacctaacgtaccaacccggtacggaccaacccgtaacccgtaaccccctaaaatttacctaaagtttaaactttacgtaccgtaacggtcctaacgaccgaccgggtcccgggttacccggtttaggggtttacctaggtacgttccgttacgttccgtacgtcggtacctacgtaacgttcgtaccggaacctaacccggtacccgttaccccgtacccttaagaacccgtttacgtttaccccggttccggtaaccgggtacccttcccgggtaaacggtccccggttaaggggtaaccggggaaacggtaccgggtttataaccgggttttaaatttaacccgggtttacttccggttaacgttcggtaaacctttcggtaaacgtttacgggtttaccggttttaacggttaccccttaaaactccccgtttaaccgttagttccggttacgggtttacgggtaccggggtaacggtacccgttaacggtacccgtcccgtttacggacccggttaccgtaccgacccgtacccggaacccgtaacccccg

SEQ ID NO: 292709 - DNA, 665 bp, Homo sapiens
  misc_feature: GYAE6OF02HPBL6.8.74.G08.1.454.CMB.1.raw
  modified_base (171)..(171): a, c, t, g, unknown or other
  misc_feature (171)..(171): n is a, c, g, or t
  modified_base (185)..(185): a, c, t, g, unknown or other
  misc_feature (185)..(185): n is a, c, g, or t
  modified_base (190)..(190): a, c, t, g, unknown or other
  misc_feature (190)..(190): n is a, c, g, or t
  modified_base (206)..(206): a, c, t, g, unknown or other
  misc_feature (206)..(206): n is a, c, g, or t
  modified_base (223)..(223): a, c, t, g, unknown or other
  misc_feature (223)..(223): n is a, c, g, or t
  modified_base (238)..(238): a, c, t, g, unknown or other
  misc_feature (238)..(238): n is a, c, g, or t
  modified_base (524)..(524): a, c, t, g, unknown or other
  misc_feature (524)..(524): n is a, c, g, or t
tcagctcgcgtgtccacgaccggtgctcgatttagtagctctatcaggggggggtcacaagaggcagcgctctcgggacgtctccaccgatggcctgggctctgctgctcctcaccctctcactcaggcacagggtcctggcccagtctgccctgactcagcctgcctcgngtctggctctgacngtcgntcacatcgactgcacnggactcaggtccggaanactagttgggattangatgtgtctctttggatcagtcatccgaccaggacacgaccgacccctaattcaacttaatttacgactaggttacccacgccgtaccggaccgggttccccgtttaacgggggtttcctacggacttaccggtcctttccgaccgtttggccttaacccgtagtttccgaacgtacccgaaccgtccggtacccctccgttacgaacgtacgtttccggacgtcgggtccacccgtaggacccgttacgggaggtccgtaacggtctacggttatacgggttacnggcctaggtactcgtaatggttcggttacgttacctaacgtacccttacgtgttcgtacgtttaggggccggtaacggacctaccggttacccgcggttaccgtaccggtaccgttcgaacccgcccgtaaccgtaccccg

SEQ ID NO: 292710 - DNA, 630 bp, Homo sapiens
  misc_feature: GYAE6OF01BPVE3.8.27.C05.1.454.CMB.1.raw
tcagctcgcgtgtccacgaccggtgctcgatttagacgcgatcgaagggtttgggggggagaggagcccagcactgggattccgaggtgtgtccattcggtgatcagcactgaacacagaggactcaccatggagttctggctgggctgggttttccttgttgcaatttcaaaaggtgtccagtgtgaggtgcagctggtggagaagtgggagggggcttgatccgaggccggggggtcctgagactctcctgtgcagcctctggcttcaccatcagtagagactacatgagcgtcgggcccgccgaggcctccgaggggaggggctgggagtgggtctcgtagtttatttagcgcgagtgggtgcacacactacgcagactcggtagagggcagacttcaccgtctccagacgaacaattaccaaagaacagtgggtacttactacttacaaatcgaaacaagaactaaacgaggacccggaaggtaccgaccgggtaccgttaattaacttaaccgtcggttacgaccggtaagtaaccaagttcggaaccgttaacggggttacggaaccgggtcccccggttagggggggaccccctaaacggggggtaaacccccgttcccgggg

SEQ ID NO: 292711 - DNA, 799 bp, Homo sapiens
  misc_feature: GYAE6OF01DA1ZE.8.27.C05.1.454.CMB.1.raw
  modified_base (180)..(180): a, c, t, g, unknown or other
  misc_feature (180)..(180): n is a, c, g, or t
  modified_base (362)..(362): a, c, t, g, unknown or other
  misc_feature (362)..(362): n is a, c, g, or t
tcagctcgcgtgtccacgaccggtgctcgatttagacgcgatcgaagggtttggggggagaggagcccagcactagaagtcggcggtgtttccattcggtgatcagcagtgaactcagaggactcaccatggtagtttggctgaccgtgggtcctttcctcgtggtcttacgttttaagnggtgtccagtgtacaagtgcaagtggtggattcggtggggagcgtggtccagccgtgggagtcacgagagactcgtcgtgtgcacgtcctcgttacggttccaccttcgaagtaaccgtacggctagtcgacacgttcggcccacgaacgcctaccgaggacgaggtagttggaggttgggngtacgtagtttcgtttcgagttcggaggaggtaccttaggttacgttacgtaacgtttgggtatcggtacgtacggtaccgtccggtaagggaaccggtaccgttaacttaccgaaccttacgttacccgaccgtaaacggtaaacgaaccgttaaacgttacccggaaaaggtaaccctacgttaaacgttcggtttaaaggtttcggaacgtaccgtaacgtaaccgtacggtttaacccgtaacggtaccgtagggaaccggtaacccggtacgggtaacgttaaccgtaacgtttaaccggtacgggtaaccggggaaacggggggttaaccggggaaaccggtcgggtaaaccggggttaccgttaaccggtaaaccgttttccggttacccggttacggtacccgggttcgggtaccggggtaaccccggg

SEQ ID NO: 292712 - DNA, 882 bp, Homo sapiens
  misc_feature: GYAE6OF01AFMEB.8.27.C05.1.454.CMB.1.raw
tcagctcgcgtgtccacgaccggtgctcgatttagacgcgatcgaagggtttgggggggagaggagcccagcactagaagtcggcggtgtttccattcggtgatcagcagtgaactcagaggacctcaccatggagtttgggctgacctgggtctttcctcgtggcttcgttttaggaggtgtccagtgtcaagtgaagttggtggagtcgtgggggagcggtggtccgagggcccgggggggtccctggagtaccgtcctccgtggtagaacggtccttcgtgggtacttcgaccgttacgaaagttggactgggcagttcgacctacgtcggggtcccgccgaggcctacccgaaggccggtaaggggcgtgggacggtggggtggccggtctattttctatcggaatagaaaagtaaaagtgtaagttaattagtacgtacgaaacggtccgtaacggtaggggaaaccgggtccgtaacgttaccgaaccggtcccttacccgtaccgaacgggtaacgtaaccgttaaacggttaccggggtaaacgggtaaccggttaaacgggttaaaccttaacgtttaacccgttaaacgtaaaacgttcgggaaacccgccgtaacggttccccgtaaacggaaaccggtaaccgggaaccggggaaaccggaacccgttaaccgggtaacttaaccgttaaccgtttaacgttacccgggttaggtaccggtaaacccgggtaaacccgggtaccccccgtttacccccggaacgtaaccgggtaaccgtaacccgtaaccgggttaacggggttacgggggtttaaccggggggttactttaacggggttaaacccgggtccgggtaaaccccggggggg

SEQ ID NO: 292713 - DNA, 529 bp, Homo sapiens
  misc_feature: GYAE6OF02HCAIY.8.27.C05.1.454.CMB.1.raw
tcagctcgcgtgtccacgaccggtgctcgatttagacgcgatcgaagggtttgggggggagaggagcccagcactagaagtcggcggtgtttccattcggtgatcagcagtgaactcagaggactcaccatggagtttgggctgacctgggctttcctcgtggctcttttaggaggtgtccagtgtcaagtgaagttggtggagtctgggggaggcgtggtccagccggggggtccctgagactctcctgtgaaggctctggattcgacttcgaaatggctggcatgcactgggtccgccaggctccaagcaaggggctgggagtgggtggcggtcatttctatgatgaagaaaatgagtatatgcaagcacgtgaagggccattcagcctctccagagacaattcgaagggcacggtatatcttacaaatgagcagcctgacaagacgaggacacggctatctattactgtgacgaaggacctcccacctagacgactacgagacggtgggggctttggagcgtacgg

SEQ ID NO: 292714 - DNA, 681 bp, Homo sapiens
  misc_feature: GYAE6OF02GF4BW.8.27.C05.1.454.CMB.1.raw
tcagctcgcgtgtccacgaccggtgctcgatttagacgcgatcgaagggtttggggggggagaggagcccagcactagaagtcggcggtgtttccattcggtgatcagcagtgaactcagaggactcaccatggagtttgggctgacctgggctttcctcgtggctcttttaggaggtgtccagtgtcaagtgaagttggtggagtcgtgggggaggcggtggtccgaggccggggggggtccctggagactctcctgtgaaggctctggattcgacttcgaaatggctggcatgcactgggtccgccgaggcctccaagcgaaggggctgggagtggggtggcgggtctagttttcttagtgatgaaagaaaaatggaagtattatgacaagcacggtagaacgggtccgattcgacgtcctaccgtcgagacgaacgtaagttacggaacgggacgtaacggttaattacgttacttaacgaaagtacgacgaccgacgtacctacgaacgtaagaccggaagtacgaccgggtacttaacgttacgtttaacttaccgttaggtacggacggtaaccgggtaaccccgtccccgtaaccggtcggtaaaccgtaccttacccggaaggtaacgggtcgggggggtttacgtttacggtaccggtccgtaacccggggg

SEQ ID NO: 292715 - DNA, 758 bp, Homo sapiens
  misc_feature: GYAE6OF02HCVXS.8.27.C05.1.454.CMB.1.raw
  modified_base (593)..(593): a, c, t, g, unknown or other
  misc_feature (593)..(593): n is a, c, g, or t
tcagctcgcgtgtccacgaccggtgctcgatttagacgcgatcgaagggtttgggggggagaggagcccagcactagaagtcggcggtgtttccattcggtgatcagcagtgaactcagaggactcaccatgagtttgggctgacctgggctttcctcgtggcttctttaggaggtgtccagtgtcgaagtgaagttggtggagtcgtgggggaggcggtggtccgacggtccgggggggtcccctggaggactccgtccgtgtgaacggcgtcgtggacttcgaccttacgaaagtggtactgggacagtcgctacggttcgggtccgaccgacggtaccctaccgaacggaccgaaacggggtacgtggggtaacggtggggtcgggtaccggtccgttagttttaccgtttaagtagtagttaacggaaaagtaaaaagttaggaacgttagtttaagtcgtaaggaacgtaaccgtaccgggtaggtaaccggggtacctaaggttaccgaccgtccgtaccgtacccgagacgtaataacgtaggaaccgggtactaccgggtaattcgtacttaagaaacgtcgaancgaagtacctagaaccgtaaggacgtaacggacgtacctacggacttaacgttaagttcgtaacgtcgtaaccggtaccggtaccccttaaccccggacgttaacgacggaacccgttagaggtaacgggtccggggtttaggtccggactacgggttaaccggg

SEQ ID NO: 292716 - DNA, 510 bp, Homo sapiens
  misc_feature: GYAE6OF01A0N2C.33.12.B01.1.454.CMB.1.raw
  modified_base (382)..(382): a, c, t, g, unknown or other
  misc_feature (382)..(382): n is a, c, g, or t
tcagtacacacactcacgaccggtgctcgatttagtagtgtagatttgggggcggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcagtggcatcaatgttgatacctacaggatattctggtaccagcagaagccagatagtcctccccggtatctcctgaggtacaggtcagactcagatacgcagcagggctcgtggacgtccccagcccgcttctctggatccaaggatgtttcggccaacgcgagggtattttacncatctcgtgggctccagtctgacgatgagctgacttattactgtatgtatttggctacatcaacgtcgttgggtgttcgggcgggagggaccaaggcctaggaccgtcgtaggtcagcccgtaacggg

SEQ ID NO: 292717 - DNA, 498 bp, Homo sapiens
  misc_feature: GYAE6OF01ACO7P.33.12.B01.1.454.CMB.1.raw
  modified_base (379)..(379): a, c, t, g, unknown or other
  misc_feature (379)..(379): n is a, c, g, or t
  modified_base (457)..(457): a, c, t, g, unknown or other
  misc_feature (457)..(457): n is a, c, g, or t
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcagtggcatcaatgttgatacctacaggatattctggtaccagcagaagccagatagtcctccccggtatctcctgaggtacaggtcagactcagatacgcagcagggctctggagtccccagcccgcttctctggatccaaggatgtttcggccaacgcagggattttacncatctctgggctccagtctgacgatgaggctgactattactgtatgtatttggcacatcaacgtcttgggtgttcggnggagggccaaggctggaccgtcctaggtcaggcccgaacgg

SEQ ID NO: 292718 - DNA, 514 bp, Homo sapiens
  misc_feature: GYAE6OF01DK7L6.33.12.B01.1.454.CMB.1.raw
  modified_base (379)..(379): a, c, t, g, unknown or other
  misc_feature (379)..(379): n is a, c, g, or t
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcagtggcatcaatgttgatacctacaggatattctggtaccagcagaagccagatagtcctccccggtatctcctgaggtacaggtcagactcagatacgcagcagggctctggagtccccagccgctttctctggatccaaggatgtttcggcaacgcagggtattttacncatctctgggctcagtctgacgatgaggctgacttattactgtatgtatttggctacatcaacgcgtttgggtgttcgggagggacgggaccaaggcctaggacccgttacgtagggtccacggcccgtaacggg

SEQ ID NO: 292719 - DNA, 652 bp, Homo sapiens
  misc_feature: GYAE6OF01CWGEO.33.12.B01.1.454.CMB.1.raw
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcagtggcatcaatgttgatacctacaggatattctggtaccagcagaagccagatagtcctccccggtatctcctgaggtacaggtcagactcagatacgcagcagggctctggacgtccccagcccgcttctctggactccgaaaggacgttggttttccggaccaacggccgtaacggggtatttttaaccgtactaacttccttcgtggggtccttccgtacgttccgttcggacgtagttggacggtcttaggtaactttaatttaaccgttgttaacgttggttaacgttttgggacctactaagttaccgtaaaccggtccgtttaggggttacggtttccggggacggggtaacgggggtaaccctaaacgggtccgttaccgggtaaccccggttacccggttaacgggttaccgaccggtacccccggtaaacggg

SEQ ID NO: 292720 - DNA, 836 bp, Homo sapiens
  misc_feature: GYAE6OF01EF1VI.33.12.B01.1.454.CMB.1.raw
  modified_base (210)..(210): a, c, t, g, unknown or other
  misc_feature (210)..(210): n is a, c, g, or t
  modified_base (263)..(263): a, c, t, g, unknown or other
  misc_feature (263)..(263): n is a, c, g, or t
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtctccacctgcctaccttgcncgaggtggcatctaatcgttgaactacctagaggtattacttcgtacgtaccncgcaaggaacgaccgagtacgtacgttccccgtaccccggttactaccgttcctagggtacgtaactttacggtacacgtactacgaagtaacgtaccggacgacggcctaaggggggccttaccgttccgggaaggttcccccccgaaggttcccccggccgttttcccgtccacgggaagttccctaaacggggtaacgtacggttttaccggggtcccgtaaaccggttaccgttaacgggggtacgtttttaaccgttaccgttacgtttaccgttacccttacggggtccgaaccccgtacgttaccgttacggtaaccgggtaacgttcggtacgggtaccgtttacggttaaccgtttaacgttttaaccgttacggtttaaagttggtaacgtttttacgggtccgtaaaccgtaacgttccgttaaaccgggttaccggtttacggggggttacgggttttccggggtaccggggtaacgggggtacccggtaaacgggacccgttacggtaacccgggttacccgttaaccgggttcccgtaacgggtcccccgtaaaccggg

SEQ ID NO: 292721 - DNA, 718 bp, Homo sapiens
  misc_feature: GYAE6OF01A5WPY.33.12.B01.1.454.CMB.1.raw
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcagtggcatcaatgttgatacctacaggatattctggtaccagcagaagccagatacgtcctccccggtatctcctgaggtacaggtcagactcagatacgcagcagggctcgtggacgtccccagcccgtctttcgtctaggactaccgaaggtacgttcggtttaccgggaccctaacggtacgtaacggggttactttttaccgtccgtaacgttccgttaccgttcggggtacccttacccgtacggtttccgtacggtaaccggtagtacgggtaacggtccgttacggtaaccgtttaagtttaaccgttaggttaacgtttggttaacgttttcgggacctaacttacgttaccgtaaaccggttccggtttgggggttacgggtttccgggggtaccggggtaaacggggtaaccccgttaaacgggtcccgttacgggtaacccccggtttacccggttaaccgggttaccggtaacccgggtaaccccggtaaacccgggg

SEQ ID NO: 292722 - DNA, 590 bp, Homo sapiens
  misc_feature: GYAE6OF01B461H.33.12.B01.1.454.CMB.1.raw
  modified_base (179)..(179): a, c, t, g, unknown or other
  misc_feature (179)..(179): n is a, c, g, or t
  modified_base (224)..(224): a, c, t, g, unknown or other
  misc_feature (224)..(224): n is a, c, g, or t
  modified_base (411)..(411): a, c, t, g, unknown or other
  misc_feature (411)..(411): n is a, c, g, or t
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtgctgactcagccggcttccctctctgcatctcctggancatcagccagtctcacctgcaccttgcgcagtggcatcaatgttnataccagaggatattcgtggtaccagcagaagccagactacgtccctcccggtatcctccgtgacgtacaggtcagactcagtataacgcagcgagggtctcgtcggacgtccccgagcccgtcttcgtcgtggaactccgaaaggtcttcgttccggacctaacgtcgtaagggttacttttaccnctaacttcgtacgtcgggtcctaccgtagtcgtacgacgtatggacgtctacgtacttatacgtcgttagtcgtagtttcgactactactccgtaacgtcgtttggggtcggttcgggacggtaacgggacccaggtccgtacggtacccgttcgtaggtcccgacggacccgtacggg

SEQ ID NO: 292723 - DNA, 648 bp, Homo sapiens
  misc_feature: GYAE6OF01AXBVB.33.12.B01.1.454.CMB.1.raw
  modified_base (366)..(366): a, c, t, g, unknown or other
  misc_feature (366)..(366): n is a, c, g, or t
  modified_base (403)..(403): a, c, t, g, unknown or other
  misc_feature (403)..(403): n is a, c, g, or t
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcagtggcatcaatgttgatacctacaggattattctggtaccagcagagccagatacgtccctccccggtatcctcctgaggtacaggtcagactcagatacgcagcgagggctcgtggacgtccccagcccgtctttctcgtaggactaccgaaggtnttcggttccggacctaacgcgtagggttacttttacnctacttcgtcgtcgggtcctccgtagtctacgacgtagtggacggtctagtaacttacgttacgttggttagttaggttagttttacgggacctaacgtacgtaccgtaaccggttcggtttaggggttacgggttaccggggaccggggtaacggggtaaacccgtaaagggtcccgttaccgggtaaccccggttaccgggttaaccgggtacccgtaacccgggtaccccggtaaaccgggg

SEQ ID NO: 292724 - DNA, 552 bp, Homo sapiens
  misc_feature: GYAE6OF01EKU61.33.12.B01.1.454.CMB.1.raw
  modified_base (232)..(232): a, c, t, g, unknown or other
  misc_feature (232)..(232): n is a, c, g, or t
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcagtggcatcaatgttgatacctanaggattattctggtaccagcagaagccaagatagtcctccccggtatctcctgaggtacaggtcagactcagatacgcagcgagggctcgtggacgtccccgacgccgtcttctcgtcggactccgaaggtatcggtttacggacccgaacggcgaagggttacttttacacgtattcttcgtgggtccttccgtagtcttacgacgtatcggagtccgtgtacttattactgtatgtatttgcactatcacgtcgttgggtgttccggagggaggaacccgagtccgtacgccgttacgtaggtcacgcccgtaacggg

SEQ ID NO: 292725 - DNA, 710 bp, Homo sapiens
  misc_feature: GYAE6OF01DC91K.33.12.B01.1.454.CMB.1.raw
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcagtggcatcaatgttgatacctacaggatattctggtaccagcagaagccagatagtcctcccggtatctcctgaggtacaggtcagactcagatacgcagcagggctcgtggacgtccccagccgtcttctcgtggactccgaaggtacttcggttttaccggaccctaaacggccgtaaggggtaactttttaccgtacgtaacttccgttaccgttggggtcccttcccgaacggtttccgtacggtaacccggtagttacgggtaacgggtcgttaacggtaaccgtttaacgtttaaccgtttaggtttaacgtttaggtaacgttttttcgggacctacgtaacgttacccgtaaacgggttccggttttacgggggttcggtttcccgggggtacggggtaacggggtaaccccgtaaagggtcccgttaccgggtaaccccgggtttacccgttaaggggttacccgtaaccgggtacccccgtaaacccgggg

SEQ ID NO: 292726 - DNA, 644 bp, Homo sapiens
  misc_feature: GYAE6OF01BNJMK.33.12.B01.1.454.CMB.1.raw
  modified_base (179)..(179): a, c, t, g, unknown or other
  misc_feature (179)..(179): n is a, c, g, or t
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtgctgactcagccggcttccctctctgcatctcctggancatcagccagtctcacctgctaccttgcgacagtggcatcaattgttagactacctagaggtattattcgtaggtaccagcaagaacgccaagactacgtcccgtcccggtatccgtaccgtggacggtacgacggtcagtactacgaagtactacgcgacgacgagggtccttcgacgggtacccgtccccgacggtccgtcctttccgttacgtacggtactaaccgaagggttacgttccggtttaccgggaaccctaacggtacggtaacgggtttaacttttaccgactacgttcgtcggtacgggttacctaccgtagttcctaggacgtagtggacgtctacgtaacttattacgtagttacgttgtattcggactatacgtacgacgtggtttgggtacggtcgggagggacgacgacggtctcggtaccgtacgttaggcctaccggtccgaacgg

SEQ ID NO: 292727 - DNA, 576 bp, Homo sapiens
  misc_feature: GYAE6OF01DCFP9.33.12.B01.1.454.CMB.1.raw
tcagtacacacactcacgaccggtgctcgatttagtagtgtagatttgggggcgggggtaagaggttgtgtccacaatggcctggactcctctcctcctcctgttcctctctcactgcacaggttccctctcgcaggctgtgctgactcagccggcttccctctctgcatctcctggagcatcagccagtctcacctgcaccttgcgcagtggcatcaatgttgatacctacaggatattctggtaccagcagaagccagatacgtcctccccggtatctccgtgaggtacaggtcagactcgagatacgcagcgagggctctggacgtccccgagccgtcttctcgtggactccgaaggattcgtttcgggaccacgcgtagggtatttactcattctcgtgggctcgagttcagtacgatggacggtctagtacttattactgttatgttagttcggactactactaacgtaacggtccggtttgggttcggttcggggacgggtaacgggtaacccgaacggtcgttacggtaacccgttaccggttacgggtccacggtacccgtaaccggg

SEQ ID NO: 292728 - DNA, 665 bp, Homo sapiens
  misc_feature: GYAE6OF01E2W5C.33.12.B01.1.454.CMB.1.raw
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtcccacctgcaccttgcgcagtggcatcaatgttgatacctacaggatattctggtaccagcagaagccagatacgtcctccccggtatctcctgaggtacaggtcagactcagactacgcagcgagggctcgtggacgtccccgagcccgcttctcgtggactaccgaaaggtacttcggtttaccggacccaacggtcgtaaggggtactttttaccgtacctagttccgttacgttcggggtaccttccgtacgttccgttaggaaccggtagtacgggtacggtccgttaggtaaccttaagtttaaccgttaggttaacgttaggttaagttttcgggacctaactacgttaccgtaaaccgtcggtttaggggttcgggtttccggggacgggtaaggggtaacccgaaggtccgttacgggaccccgttccgttaacgggtaccgaccggtaccccgaagggtcccccg

SEQ ID NO: 292729 - DNA, 686 bp, Homo sapiens
  misc_feature: GYAE6OF01DRCQ4.33.12.B01.1.454.CMB.1.raw
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcagtggcatcaatgttgatacctacaggatattctggtaccagcagaagccagatacgtcctcccggtatctcctgagtacaggtcagactcagatacgcagcgagggctcgtggacgtccccagcccgtctttctcgtggactaccgaaggtacgttcggtttaccggacccaacggcgtaacggggttactttttaccgtactacgttccgttccgttcggggacccttccgtacgttcgtacggtaaccgtagtcgggacggtcttacgtaaccgtttaacgtttacgttagttaagttcggttaacgttttcggaacctaccgtaacgttaccgtaaaccggttcgggttttacgggggttacggtttccgggggtaacgggtaacggggtaaacccgtaaacggtcccggttaaccgggttacccccggtttacggtaccgggttacccgaacccggtccccggtaaaccgggg

SEQ ID NO: 292730 - DNA, 818 bp, Homo sapiens
  misc_feature: GYAE6OF01AB13Q.33.12.B01.1.454.CMB.1.raw
tcagtacacacactcacgaccggtgctcgatttagtagtgtagatttgggggcgggggtaagaggttgtgtccaccatggcctggactcctctcctcctcctgttcctctctcactgcacacggttccctctcgcaggctgtgctgactcacgccggcttccctctctgctacttcctccgtggacgcactcgacgccacgttcctaccaccgtcgcctaccgttcggccgacgtacggtcggactacgttactaagttggtttacgaacttaaccgtaacgtaaggtactttacgtttcgtacggtaccaaggcgaacggaacgaccgaagtacgttaccggtacccgttaccccggttattccgtaccgtagggtaacggttaacgtacgggtaccaacggtacctacgaacgtacgtaacggcgtaacggacggtacgggtccttacggtaccggtaccgtcccgacgtcccgttcgtttcgtcggtacgtaccgtaccgtaagggttacgttccgggttaccggaccgtaacggtcgttaagggttaccttttaccgcttacgttccgtacggtcgggtccttacggtacgttcgtacggtaacgtacgtacgggtaacgtctaacgttaacttcgtttaacggtagttacgttcggttaacgttcggtaacctaacgtacgttaaccggtacgggttccgggtttacggggttacgggttaccgggacgggttaaccgggtaccgtaacggtaccggttaaccgggtacccggttaccggtaaccgggtccgtaaccggtaacccggttacgg

SEQ ID NO: 292731 - DNA, 654 bp, Homo sapiens
  misc_feature: GYAE6OF01BVRL0.33.12.B01.1.454.CMB.1.raw
  modified_base (223)..(223): a, c, t, g, unknown or other
  misc_feature (223)..(223): n is a, c, g, or t
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcagtgcatcaatgttnatacctacgagtatattctaggtaccagcaagaacgccagtactacgtccctccccggtatcctcgtaggacgttacgaggtcagactcagtactacgcagcgagggctcgtacggaccgtccccagccgtctttcgtcgtaggactaccgaaggtcgttcggtttccggaccaacgtcgtaacgggttactttactactacttcctcgtcggtccttaccgtacgtccgtagacgtagtcggacgtctagtacttagttacgttagttagttagttagtttcggactactaacgtaccgtaaccggttcggtttacggggttcgggttccggggtacgggtaacggggtaacccgtaacgggtcccgttaacccggtaccccggttaccggttaaccgggtccgtaacccggtaaccccggtaacccggg

SEQ ID NO: 292732 - DNA, 610 bp, Homo sapiens
  misc_feature: GYAE6OF01DEWRB.33.12.B01.1.454.CMB.1.raw
  modified_base (453)..(453): a, c, t, g, unknown or other
  misc_feature (453)..(453): n is a, c, g, or t
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcagtggcatcaatgttgatactacaggatattctggtaccagcaagaagccagatacgtcctccccggtatctcctgaggtacaggtcagactcgagatacgcacgtcgagggctcgtcggacgtcccagcccgtcttctcgtcggactaccgaaggcgttcgtttccggacctaacggtcgtaagggttacttttactctaacttccgtacgtcgggacctccggagttcgtacgacgtagtcgngggtactgtaacttattactagttagtagtatttcggacctacgtataccggtaacgtcggttttggggtcgttccggggacggtaagggaaacccgtaaggtccgttaaccggtacccggttaccgttaggtcccggaacgcccggtaaacccggg

SEQ ID NO: 292733 - DNA, 640 bp, Homo sapiens
  misc_feature: GYAE6OF01BNA69.33.12.B01.1.454.CMB.1.raw
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcagtggcatcaatgttgatacctacaggatattctggtaccagcaagaagccagatacgtccctccccggtatcctccgtgacggtacaggtcagactcaagatacgcagcagggtctcgtggacgtccccgagcccgtctttcgtcgtaggactaccgaaggtacttcggttaccggaccgtaacgcgtaagggttacttttactctacttccgtacgtcgggtcctaccgtagtcgtacgacgtagtacggtacggtctacgtaacttagtttaaccgttagttagttcggttagtttcggacctacgtacgtaccgtaacggttcggtttaggggttcggttccggggacgggtaacggggaacccgtaacggtccggttaccggtaacccggttaccgtacgggtaccgaccgggtaccccgtaacggg

SEQ ID NO: 292734 - DNA, 602 bp, Homo sapiens
  misc_feature: GYAE6OF01BRSN6.33.12.B01.1.454.CMB.1.raw
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcagtggcatcaatgttagatacctacaggattattctggtaccagcagaagccagatacgtccctccccggtatcctcctgaggtacaggtcagactcaagactacgcagcgagggctcgtggaccgtccccaggcccgtctttcctcgtaggactaccgaaaggtagttcgtttaccgggaccaacggtcgaaggggttacttttacctactattccgttcgtgggcctccgtagtcgtagacgtagtggaggtctagtacttatttactgtacttgttagtttcggactactataccgtaacgtcggtttaggggttcgtcggggacgggtaacgggaacccgaagtcgtaccggtacccggttacgtaagggtccacggtcccggtaacggg

SEQ ID NO: 292735 - DNA, 593 bp, Homo sapiens
  misc_feature: GYAE6OF01DGGTD.33.12.B01.1.454.CMB.1.raw
tcagtacacacactcacgaccggtgctcgatttagtagtgtagatttgggggcgggggtaagaggttgtgtccaccatggcctggactcctctcctcctcctgttcctctctcactgcacaggttcccctctcgcaggctgtgctgactcagccggcttccctctctgcatctcctggagcatcagccagtctcacctgcaccttgcgcagtggcatcaatgttgactacctacgaggatattctggtaccagcagaagccagatacgtcctccccggtatctcctgaggtacaggtcagactcagatacgacagccgagggctcgtcggacgtccccacgccgtctttctcgtggactcccgaaaggtgttcggtttaccggacccgtaacggcgtaagggttactttttaactctaacttccgttcgtcgggtcctccgagttctaggacgtagtggacggtctacgtacttacgtttacttagttatgttagtttaggctactagtacgaacgtgttgggtcggttcgggacgggtacgggaccgaacggtctacggtaccgtaccgtaggtaccgcgcccgtaaccggg

SEQ ID NO: 292736 - DNA, 616 bp, Homo sapiens
  misc_feature: GYAE6OF01BZRMB.33.12.B01.1.454.CMB.1.raw
  modified_base (231)..(231): a, c, t, g, unknown or other
  misc_feature (231)..(231): n is a, c, g, or t
tcagtacacacactcacgaccggtgctcgatttagtagtgtagatttggggggcgggggtaagaggttgtgtccaccatggcctggactcctctcctcctcctgttcctctctcactgcacaggttccctctcgcaggctgtgctgactcagccggcttccctctctgcatctcctggagcatcagccagtctcactgcaccttgcgcagtgcatcaatgttgatacctanaggatattctggtaccagcagaagccagatacgtccctcccggtatcctcctgaggtacaggtcagactcagatacgcagcgagggtctcgtggacgtccccaggccctcttctcgtggactaccgaaaggtcttggttccggacctaacggtcgtaagggttacttttacgtctaattcgttcgtcgggtcctccgtagttcgtagacgtagtcggaacgtctagtaacttaagtttacgttagttacgttagttagtttacgactaacgtaactacgtaaccgttcggttaggggttcggttacggggacgggtaacgggtacccgaaaggttccgtaccggtaccggttaccgtaacggtaccgaacggacccggtaaccgg

SEQ ID NO: 292737 - DNA, 683 bp, Homo sapiens
  misc_feature: GYAE6OF01E4RMI.33.12.B01.1.454.CMB.1.raw
  modified_base (427)..(427): a, c, t, g, unknown or other
  misc_feature (427)..(427): n is a, c, g, or t
  modified_base (452)..(452): a, c, t, g, unknown or other
  misc_feature (452)..(452): n is a, c, g, or t
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtgctgactcagccggcttccctctctgcatctccgtggagcatcagccagtctcacctgcctaccttgcgcaggtggcatcaatgttgatacctacgaggattattcgtaggtaccagcaagaacgccagatacgtccctcccggtatcctcgtggagtacgaggtcagactcagatacgcagcgagggtctcgtacggaccgtccccgagcccgtctttctcgtaggactaccgaaggtactttcggttaccggacccgtaacggtcgaagggtttacttttaccnctacttcgttcgtcgggtctaccgngttcgtaggaccgtatacggacggtcttaggaactttactttaacgtagttaacgttggttacgttttcgggaacctaagtacgttaccggtaaccggtttcggggtttacggggtttaccgggttccgggggacggggaaaccgggtacccgtaaacgggtcccggttaacccgggtaacccgggttacccgtaaggggtacccaacccgggtaccccggtaacccgggg

SEQ ID NO: 292738 - DNA, 648 bp, Homo sapiens
  misc_feature: GYAE6OF01A2CHD.33.12.B01.1.454.CMB.1.raw
  modified_base (191)..(191): a, c, t, g, unknown or other
  misc_feature (191)..(191): n is a, c, g, or t
  modified_base (349)..(349): a, c, t, g, unknown or other
  misc_feature (349)..(349): n is a, c, g, or t
  modified_base (546)..(546): a, c, t, g, unknown or other
  misc_feature (546)..(546): n is a, c, g, or t
tcagtacacacactcacgaccggtgctcgatttagtagtgtagatttaggggtttagggggcgggggtaagaggttgtgtccaccactcggcctggactcctctcctcctctgttccgtctctcacgtgcacaggttccctctcgcaggctgtgctgactcagccggcttccctctctgcatctcctggancatcagccagtcctcacctgccaccttgcgcaggtggcatcaatgttagatacctacgaggattattcgtgtaaccagcaagaacgcagactacgtccctccccggtatcctcctggacggtacaggtcagactcgagactacgcagcgagggctcgnggtaccgtccccaggtccctcgtttctcgtaggactaccgaaggtacttcggtttacccggaccgaacgtcggtaagggtttacttttacgtactacgtttccgtacgttcgggcccttaccgtagttccgacgacgtacgtggtacggtcctaaggttaaccttatttagtcgttagtgttaacgttggacctaanacttaccggtacgtttccgggttaggggttccggttacgggacggggtaccggaccgtacgtcgtaccgggaccgttaccgttaggcccgacgtaacccggg

SEQ ID NO: 292739 - DNA, 679 bp, Homo sapiens
  misc_feature: GYAE6OF01DN8OP.33.12.B01.1.454.CMB.1.raw
  modified_base (462)..(462): a, c, t, g, unknown or other
  misc_feature (462)..(462): n is a, c, g, or t
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtgctgactcagccgtcttccctctctgcattcctccgtggagcatcgagccagtcctcaccgtgctaccgttgccgcaggtcggactatcaagttggtttacgaactaccctagaaggtacttaagtttcgtacggtaccaacggacaaggaaacgccgtaagtaacgttaccgtccccgtaccccggtattccgtacgtaggaacgtacacgtacgacgtactcgaagactacgacgagcgaggctcgtacgactcccgagccttcttctcgtagactaccgaagtcgttcgttaccggacaagtacgtagtactttacgntacgttctacgtcggtacctacgtacgtcgtacgacgtagttacggaacgtcgttaacgtaacgtttaacttacggttagttagttacggttacttcggtaacctacgaacgttacggtaaccgttcggttagggttcgggttaccgggacggaacgggttaacccaggttccgtacggtacccgttacggacgttaccaccggtacccggtaacgg

SEQ ID NO: 292740 - DNA, 841 bp, Homo sapiens
  misc_feature: GYAE6OF01DELNY.33.12.B01.1.454.CMB.1.raw
  modified_base (462)..(462): a, c, t, g, unknown or other
  misc_feature (462)..(462): n is a, c, g, or t
tcagtacacacactcacgaccggtgctcgatttagtagtgtagatttggggggcgggggtaagaggttgtgtccaccatggcctggactcctctcctcctcctgttcctctctcactgcacacggttccctctcgcaggctgtgctgactcacgcccggtccttccctctctgctactcctccgtggacgcctatcgacgcccacgtcctaccacccgtgccctaccgttcggccgcgaggtcggccaattactaagttgttacgtaacctaaccgtaacggtaggtaactttactttaccggtacggtaaacccgacgaacgaaacggaaacgacccgaagtaacgttacccgtaccccgttccccggtaacttcccgtaccggttacggtacggtaaccgtaggtaccacgtacctacgagtacacgacgagaccggtacggtctcggtaccggtacccnccccgtacgtcccgttcctttcgtacggtacggtaacgtaacccgtaggtacgtttcggttacccgaccgtaaccggacgttaaccgggtttactttaaccgctacgttcccgttacggtcggtacctcggtaactcggttacgaaaccgtgttaacggcggttacgtaacgttactttacgttaaccggtttggttaaccgttaggttaacgttttacggacctaaacgttccggttaaaccgttcggggtttcgggtttaccggggttacggggtttaccggggaaacggggaacggttaacccggaaccgttacgggtaaccccgtacccgggttttacgaaccgggtaccctaaacccgggcccggttacccggg

SEQ ID NO: 292741 - DNA, 606 bp, Homo sapiens
  misc_feature: GYAE6OF01BZ7YB.33.12.B01.1.454.CMB.1.raw
  modified_base (163)..(163): a, c, t, g, unknown or other
  misc_feature (163)..(163): n is a, c, g, or t
  modified_base (223)..(223): a, c, t, g, unknown or other
  misc_feature (223)..(223): n is a, c, g, or t
  modified_base (232)..(232): a, c, t, g, unknown or other
  misc_feature (232)..(232): n is a, c, g, or t
  modified_base (313)..(313): a, c, t, g, unknown or other
  misc_feature (313)..(313): n is a, c, g, or t
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtgctgactcagccggcttccctntctgcatctcctggagcatcagccagtctcacctgcaccttgcgcagtgcatcaatgttnactacctanaggtattattctcggtaccagcagaagccagatacgtccctcccggtatcctccgtgagtacaggtcagactcagatacgngagcgagggtctcgtcggactccccgaggcctctttccgtcgtacggactacgaaaggtcgttcggtttccgaccgtaacgacgtacgggtttaactttaccgtactaacgttccgtacggttcggtcctacgtacgttcgtacgacgtatcggacgtctagtaacttattaacgtgttagttagttagtttcggactaacgtactacgtaacggtcgtttgggtcggtcgggtaggacggtaccgaggtacgtccgtacccgttacggtaggtccacggtcccgtaaccggg

SEQ ID NO: 292742 - DNA, 745 bp, Homo sapiens
  misc_feature: GYAE6OF01BR0AQ.33.12.B01.1.454.CMB.1.raw
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcagtggcatcaatgttgactacctacaggatattctggtaccagcagaagccagatagtccctccccggtatctcctggacggtacaggtcagacctcagatacgcagcgagggctcgtggaccgtccccaggcccgtctttccgtcttacgggactacccgaaagggtacttcggtttacccgggacccaaacgggtcgtaacgggggtttaactttttaccgtaccgtaactttcccgttcggttacggggtcccttacccgtaacggttccgttacggaccggtaagttcgggacggtccttacggtaacctttaacgttttaaccgttaggtttaagttcgggttaacgtttttacgggacctaaccgttaacgttaaccgggtaaccggtttcggttttacgggggggtttccgtttaccggggggacccgggggtaacggggtaaaccccggaaagggtcccggttaccggtaaacccccgggtttcccgtaaacggggttcccgaacccgggtacccgtaaaccccggggg

SEQ ID NO: 292743 - DNA, 629 bp, Homo sapiens
  misc_feature: GYAE6OF01D62O8.33.12.B01.1.454.CMB.1.raw
  modified_base (370)..(370): a, c, t, g, unknown or other
  misc_feature (370)..(370): n is a, c, g, or t
  modified_base (611)..(611): a, c, t, g, unknown or other
  misc_feature (611)..(611): n is a, c, g, or t
tcagtacacacactcacgaccggtgctcgatttagtagtgtagatttgggggcgggggtaagaggttgtgtccaccatggcctggactcctctcctcctcctgttcctctctcactgcacaggttcccctctcgcaggctgtgctgactcagccggcttccctctctgcatctcctggagcatcagccagtcctcacctgccaccttgcgcagtggcatcaattgttgatacctagaggattattctaggtaccagcagaacgccagatacgtccctccccggtatcctccgtgagtacaggtcagactcagatacgcagcgaggctcgtggacgtccccagcccgtctttctcgtggactccgaaggtnttcggtttccgactaacgcgtaaggttacttttacgctactcctcgtacgggcctccgagttcgtacgacgtagtgggacggtctacgtacttaagtttaccgttagttagttacggttagttttcggaccttaccgtacgtacccgtaacggttcggtttacggggttcggtttaccggggacgggtaacggggtacccaacggttccgtaacggtacccgttaccggtacgggtacccncgggtacccgtaaccggg

SEQ ID NO: 292744 - DNA, 752 bp, Homo sapiens
  misc_feature: GYAE6OF01BH2OU.33.12.B01.1.454.CMB.1.raw
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtgctgactcagccggtcttccctctctgcatctccgtggagcatcagccagtcctcacctgcctaccttgcgcagtcggactatacgaagttgttacgaacttaaccctacgtaggtaattacgtttaccgtacggtaaccaggaccgaaggaaccgaccgtaaggtacgttacccggtccccgtaccccgttatcctcggtaggtacgtacgacggtacgacgtactacgaagtacgtacgcgacggacggtcggtccgtcggaccggtacccgtccccgacggtcccgttctttccgtacggtacgtaccgtaccgtaaggtcgttccggtaccgaccgtaacggtacggttacggtttactttacgtacgttacgtcgttcggaccggtccttcctacgggttacgtacggtacgtacgtacggtcggtacttagttaacctttgttaacgttagtacgttacgtttagtccgaaccgtataaccgttaccggtacggtttcgggttcgggttacggggtccggggaacggtaaccgggtaccgaaccgggttcccgtacggtaaccccgttacgggtaaccgtccccgaaccggtacccggtacccgg

SEQ ID NO: 292745 - DNA, 764 bp, Homo sapiens
  misc_feature: GYAE6OF01AZRUZ.33.12.B01.1.454.CMB.1.raw
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtgctgactcagccggcttccctctctgcatctccgtggagcatcacgcctagtcctccacctgcctaccgttgcgcgtaggtgacctattacaaattgttacgaacttaccgtaacgaggtaacttactttcgtacggttaaccacggtacgaaggaacgtccgaagtacgttaccgtccccgttaccccggtaacttccgttccgttaggaacggttaccgtaacgggttaccaacgtactaccgtaacgtaacgtaccggacgacggacgtacgggtccgttcggtacgggtaaccgtaccccgtacggtcccggtctttccttacggtacgttaccgtaccgtaaagggttacgttccgggttttaaccggaccccgtaacggtacggttaacgggttttaaccttttaccggtacctaagtttcccgttcgggtacgtcccgttaccgtacgttacgtacgaccgtagtcgacggtctacggttacttacgttatagtagttcgttacgttcggaactacgtaactaccggttacgttgggtttcgggttacggtccggggacggtaacggtaccgcgtacgttcggaccgttcggtacgtacggcgtaccggtacccgg

SEQ ID NO: 292746 - DNA, 633 bp, Homo sapiens
  misc_feature: GYAE6OF01BKOPF.33.12.B01.1.454.CMB.1.raw
  modified_base (237)..(237): a, c, t, g, unknown or other
  misc_feature (237)..(237): n is a, c, g, or t
  modified_base (388)..(388): a, c, t, g, unknown or other
  misc_feature (388)..(388): n is a, c, g, or t
tcagtacacacactcacgaccggtgctcgatttagtagtgtagatttgggggcgggggtaagaggttgtgtccaccatggcctggactcctctcctcctcctgttcctctctcactgcacacggttccctctcgcaggctgtgctgactcagccggtcttccctctctgcatctccgtggagcatcagccagtcctcacctgcctaccttgcgctagtcggactatcaattggttanactacctagagtattattcgtacggtacagacaacgacgaccaagtactacgtccccgtaccgtattcctccgtaggacgtacgacgacgagacctagacgtactacgcgacgcgaggtcctcggacgtacccgtccacggtccctgttcncgtagacgtaccgtagtcttcggtacgaccgaggtcgtagtttacttcgtagacttcgaggtcggtactccgtaacgttcgtagtacgtagtacggtacgttctagttaactttagttagtacgttagttaacgttcggtacgacctaagtctacgtacgggtgtttacgggttcggacgggtaccgggacgtaacacggtaccgttaccggaccggttcgtaacgccggtacggcccgtaccgg

SEQ ID NO: 292747 - DNA, 667 bp, Homo sapiens
  misc_feature: GYAE6OF01A3KEK.33.12.B01.1.454.CMB.1.raw
  modified_base (300)..(300): a, c, t, g, unknown or other
  misc_feature (300)..(300): n is a, c, g, or t
  modified_base (313)..(313): a, c, t, g, unknown or other
  misc_feature (313)..(313): n is a, c, g, or t
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcagtggactatcaattgttgactacctacgaggtatattcgtaggtaccagcagaacgccagatacgtcctacccggtatctcctgaggtacnggtcagactcganactacgacagcgacgggctcgtacggaccgtccccgagtcccgtctttcgtcgtgtactacgaaggtcgttcggttaccgaccaacggcgtaagggtttacttttaccgtctactttcgtccgttgggtcccttaccgtggttaccgtaggtaacggtacgtcggtaacggttcgttacgttaactttaacgtttaacgttggttaagttacgtttaggttaccggactaccgtaacgttaccgtaacggttcggtttacggggttacgggtccgggacgggtaccgggtaccgaacgggtcccgtacgggtaccccgttacggtaccggttccaacgggtccccgtaaccggg

SEQ ID NO: 292748 - DNA, 836 bp, Homo sapiens
  misc_feature: GYAE6OF01D3CBY.33.12.B01.1.454.CMB.1.raw
  modified_base (196)..(196): a, c, t, g, unknown or other
  misc_feature (196)..(196): n is a, c, g, or t
  modified_base (201)..(201): a, c, t, g, unknown or other
  misc_feature (201)..(201): n is a, c, g, or t
  modified_base (483)..(483): a, c, t, g, unknown or other
  misc_feature (483)..(483): n is a, c, g, or t
tcagtacacacactcacgaccggtgctcgatttagtagtgtagatttggggggcgggggtaagaggttgtgtccaccatggcctggactcctctcctcctcctgttcctctctcactgcacgtacggttccctctcgcaggctgtgctgacctcgacggcccgtcttccctctcgtgactactcctccgtaggacnctacncgacgcctacgtcctccgaccgtcgccttaccgttcggaccgacgtaggtacggacctaattacgtaagttcggttactaaccttaaccttacgggaaggttactttcgttacgtacggtaaccagacgaaagaccgacctaagtaccgttaccggttccccgttaccccggttacttcccgttacggtacgggtaacggtacggtacggtacgaacgtacctacgaacgtaccgtacggaccgaacggcggacgggtccttacggacgtacccggtacccncggtccctcgtttacgacggtcgtaacccgtaaaccggtaggtttccgttacggtacccggaacggaaccgtacggtttaacggttttacctttacgacgttccggttaccgttcgggaccgtttccgtacgttaacgttccggagtaacggtaccggtaggtaccgtacggttaactaacggtttaacttacggttggtttaacgttacgttacggttactaaccgtaacgttacccttaaggtaccgggtttcgggtacgggggtttacgggtaaccgggacgggtaacctacgtaaccggtaccggtacccgtaccggtacggtaccggaccgtcccgacggttaccccg

SEQ ID NO: 292749 - DNA, 901 bp, Homo sapiens
  misc_feature: GYAE6OF01EY6LP.33.12.B01.1.454.CMB.1.raw
tcagtacacacactcacgaccggtgctcgatttagtagtgtagatttgggggcgggggtaagaggttgtgtccaccatggcctggactcctctcctcctcctgttcctctctcactgcactacggttcccctctcgcaggctgtgctgactcacgcccggtccttccctctctgccattcctccgtgggagctactccgacgcccagttcctccaccgtgcctaccttggccgcctaggtcggactacttaccaagtttcggtttagaaccttaacccgtaacggtaaggtaactttacgtttcgtacgggtaacccagaccgaacggaaccgacccgaagtaacgttaccggtttcccccccggttacccccgggtttaacttccccgtttaccggttacgggtaaccggttaaccggtaccggttacgaaccggttaaccctaccggtaacggtaacgttaaccccgggaccgacggtaccggacggggttacccttccggttaaccggtaccccggttacccccgaccggtccccgttcttttcccgttccggtacgggtaacctttaacccggaaacgggtttacgtttccgggttttacccgggaaccccggtaaaccggttaccggttaaggggtttttacctttttaaccctacgttaccgttcccgtttacccggtcgggtaccctttaccgggtacgttaccgttacggtaaccgtacggtacggcggttacctaggttaaccttacgtttacgttagttagttagtttacggttacgtactacgtacgttaccgacggtttccggtttcggggttccggtcggggtacgggaccggtacgtaccggcgttacccggacccgttacggtacgtccgaaccggccccgtacgg

SEQ ID NO: 292750 - DNA, 642 bp, Homo sapiens
  misc_feature: GYAE6OF01DYEM1.33.12.B01.1.454.CMB.1.raw
  modified_base (188)..(188): a, c, t, g, unknown or other
  misc_feature (188)..(188): n is a, c, g, or t
  modified_base (222)..(222): a, c, t, g, unknown or other
  misc_feature (222)..(222): n is a, c, g, or t
  modified_base (351)..(351): a, c, t, g, unknown or other
  misc_feature (351)..(351): n is a, c, g, or t
  modified_base (387)..(387): a, c, t, g, unknown or other
  misc_feature (387)..(387): n is a, c, g, or t
  modified_base (629)..(629): a, c, t, g, unknown or other
  misc_feature (629)..(629): n is a, c, g, or t
tcagtacacacactcacgaccggtgctcgatttagtagtgtagatttggggggcgggggtaagaggttgtgtccaccatggcctggactcctctcctcctcctgttcctctctcactgcacgacggttccctctcgcaggctggtgctgacctcaggccgtccttccctctctgctatcctcgtggancactcacgccagttcctcgacctgcctacttgcngtgtcgctatcaattgtacactaccgtagacgtattacgttctacggtaccagacaacgacgaccgaagtaactccgtccccgtcccgtacttccgtaccgtggaggtacgacgtacacgtactcgaancaccgtcgtacgcgtacggtccgttacgcggtaccncccgtacgtccgttctacgtcgtacgcgttaccggaagttcggttcgtcgacgaacgttacggtacgtttactacgtctacgttcttcggtcgtaccgtcgacgttcgtagtaccgaggtcagtacttgtacctttacgtgttgtacgtttagtacttgacctacgtacgtcttacgggttcgttcggggaccggtcgggtaccggagtacgttacccgtcgaccgtcggttcaacggtccnggaaccggtcccg

SEQ ID NO: 292751 - DNA, 964 bp, Homo sapiens
  misc_feature: GYAE6OF01D43LH.33.12.B01.1.454.CMB.1.raw
tcagtacacacactcacgaccggtgctcgatttagtagtgtagatttgggggcgggggtaagaggttgtgtccaccatggcctggactcctctcctcctcctgttcctctctcactgcacacggttccctctcgcaggctgtgctgactcgacggccggtcttccctctcgtgctatcctccgtggagctatcgagccctagttcctacctacctcgacctttttttttaccgcggccgtacgtaacggttcggactaactaacttaaagtttggttaacgaaacttaacccgtaacgtaaggtaactttacgttttcgtacgggtaacccgaagaaccgaaagggaaaaccgacccgtaaagtactttaaccggttccccccggttacccccggtaaatttcccgtacccggttagggaaacggtaacccgtaaggggttacctaaacgggtaacctacgtaaaggtaaccgttaaccggaacgtaacggtaaccggtaacggggtcccttaacggggttccgggtaaaccccgttacccccgggacgttacccgggttaccttttcccgggtaccgttaacggggtaacttaaacccggtaaaggggttaacggttttcccggggttttaccccggaaaaccggttaaacgggtaaccgggttaaacggggttttaacttttaaacccgtcggtaaacctttcccggtaacggtcggggttacccttacccggtaacgttcgttaaccggggaccttaaggtcggtacggtacttaacgttaacgttaacgttttaagttccggtaagttaccgttaagttacgggacctaacgttaaccgtaagtaaacccggttcggtttagggtttacggaccgggtaacggggtaacggggaaacctaaccggttcgacccggtaaccgggtttaccggtaagccccggaagttacccgggaacccgg

SEQ ID NO: 292752 - DNA, 689 bp, Homo sapiens
  misc_feature: GYAE6OF01CCPHS.33.12.B01.1.454.CMB.1.raw
  modified_base (162)..(162): a, c, t, g, unknown or other
  misc_feature (162)..(162): n is a, c, g, or t
  modified_base (180)..(180): a, c, t, g, unknown or other
  misc_feature (180)..(180): n is a, c, g, or t
  modified_base (213)..(213): a, c, t, g, unknown or other
  misc_feature (213)..(213): n is a, c, g, or t
  modified_base (246)..(246): a, c, t, g, unknown or other
  misc_feature (246)..(246): n is a, c, g, or t
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtgctgactcagccgcttccctntctgcatctccgtggacncatcagtcctagtctcacctgccacttgccgtnagtcgacatactaagtcgttagactacctaagnggtattcttcgtacggaccagacagaacgtccaagacttcgtccctaccggtatccgtacgtagtacgtacgtacgtcacgtactcgagactacgaccgaggtaccgtagggtcctacggtacggtaccccgtacccgaacggttcccgtacttttccgacggtaacggtaccttaaccgggaaaggtttccgttcgggttacccgaccggtaacgtacgttacggttacctttacgtctaacttcccgtcgtcggtacctcgtacgtctacgtacgtgtacgtacgtatacgtcgttacgttacgtagtagtcgttacgttcgactactaacgttacgtacggttcggttacgggttcggtaccgggtagggaccggttaccgtaaccggtcggttacccggtaaccggttaccggtacggtaactcccggaaccggtccgg

SEQ ID NO: 292753 - DNA, 512 bp, Homo sapiens
  misc_feature: GYAE6OF01A08B7.33.12.B01.1.454.CMB.1.raw
  modified_base (302)..(302): a, c, t, g, unknown or other
  misc_feature (302)..(302): n is a, c, g, or t
  modified_base (418)..(418): a, c, t, g, unknown or other
  misc_feature (418)..(418): n is a, c, g, or t
tcagtacacacactcacgaccggtgctcgatttagtagtgtagatttgggggcgggggtaagaggttgtgtccaccatggcctggactcctctcctcctcctgttcctctctcactgcacaggttcccctctcgcaggctgtgctgactcagccggcttccctctctgcatctcctggagcatcagccagtctcacctgcaccttgcgcagtgcatcaatgttgatacctacaggatattctggtaccaggcagaagccagatagtcctccccggtatctcctgagtacaggtcagactcanatacgcagcagggctctggagtcccccagccgctttctcgtggatccgaaggactgtttcggaccaacgcagggtattttactcatctctgggctccagtctgacgatgaggtcgnactattactgtattgtattgacacatcaacgtgttgggtgtttcggcggagggacctaagcgttcgtaccgtccgttaagctagcccgtaacgg

SEQ ID NO: 292754 - DNA, 616 bp, Homo sapiens
  misc_feature: GYAE6OF01CQ23Q.33.12.B01.1.454.CMB.1.raw
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcctaccttgcgcagtgcatcaattgtgactacctagaggtattattcgtcggtaaccagcaagacgccagatcgtccctccccggttatcctccgtagaggtacaggtcagtactcgagactcgcgagcgaggtctcgacggaccgtcccgagccgtacttcgtcgtcggaactaccgaaggtcgttcggttaccgacgaacggtcgtacggttactttacgcttacgtccgtttacgtcgggtcctaccgtacgtacgtacggtacgtaagtcggacggtctacgtacttaagtttactaggtattggtagttacgactagtacgtacgtaacggtgtttggggttcgttacgggacgggtacgggaccgtacggtcgttccggtaccggttacgtacggtccgcgtacccgtacgg

SEQ ID NO: 292755 - DNA, 758 bp, Homo sapiens
  misc_feature: GYAE6OF01DJUB3.33.12.B01.1.454.CMB.1.raw
  modified_base (386)..(386): a, c, t, g, unknown or other
  misc_feature (386)..(386): n is a, c, g, or t
  modified_base (557)..(557): a, c, t, g, unknown or other
  misc_feature (557)..(557): n is a, c, g, or t
  modified_base (597)..(597): a, c, t, g, unknown or other
  misc_feature (597)..(597): n is a, c, g, or t
  modified_base (630)..(630): a, c, t, g, unknown or other
  misc_feature (630)..(630): n is a, c, g, or t
tcagtacacacactcacgaccggtgctcgatttagtagtgtagatttgggggcgggggtaagaggttgtcgtccaccatggcctggactcctctcctcctcctgttcctctctcactgcactcggttccctctcgcaggctgtgctcgactcgacgcccgtcttccctcgtctcgcctactccgttccgtcgggaactcctaatcgaaccgtccgtagttccctaccgtaaccgtcgacctccgtcgccgtacgtaggtcggactactacgtaagttgttacgaactaccgtaagtaaggttacttaggttccggaacgtaccgagaccgaagtaccgctaggtactaccggtcccgtccgtatcctacggtagtaccggttaacncgtaccaacgtactaccggaaagttacccgacggacgacgggttaccgggaacgttcgtaccggacggttacccccaccgggtctacccgtttccgtacgtcggtaacgtaacctacggtaaacgttcggtacccgggtaccaacgtaagtccgtaaggtttacttacgtntaccgtcgtcggtacgtcgtacgtacgtacgacgtaacgngtacgcgtacttcgtaaatacgttacacggttntcggttagttcactaactacgtaacggtcgttacggggtcgttaacgggccggtacgggtacggtaaccgttacggaccgttcccggtaaccgtaccgggtagtaccccgtaacggacggttccccgg

SEQ ID NO: 292756 - DNA, 750 bp, Homo sapiens
  misc_feature: GYAE6OF01CKFHU.33.12.B01.1.454.CMB.1.raw
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgctaccttgcgcaggtgcatacaatgttgaactactacgaggtatattcgtggtacacgcaagaacgccagactacgtcccgtacccggtatcctcgtaggacggtacgacggtcaacgtactacgacgatacgcgagtccgaagggcctcgtacggtaccgtccccgacggtcccgtcctttccgtcgtaggaaccgttaccggtaaagggttcttttaccgggttacccgggaaccccgtaaacgggtaccgggtttaacggggttaacctttttaccgtaaccttaacggttcccgtccggttacgggtcccttaccggtacgtttaccgtacgggtaacgtacgtacgggtacggtactttacgtaacgttactttacgttacgtacgttaggttacgttacggtactaacggaattacccgtaacgggttccgggtttagggttcggggttaaccggggtacggggtaaccggtaaaccgaacggttacccggtaccggttaacccggtacgggttaaccgtccggaacccggtcccggtaacccggg

SEQ ID NO: 292757 - DNA, 642 bp, Homo sapiens
  misc_feature: GYAE6OF01BRZJC.33.12.B01.1.454.CMB.1.raw
  modified_base (207)..(207): a, c, t, g, unknown or other
  misc_feature (207)..(207): n is a, c, g, or t
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcncagtggcatcaatgttgactacctacgaggattattcgtggtaccagacaagaacgccagatacgtccctccccggtatcctccgtaggacggtacacgggtacagactcaagtactacgcaggcgagggtctcgtacggaccgtccccgagtcccgtctttcgtcgtcggactaccgaaggtacttcggttaccggaccaacggtacgtacgggttactttacgtctacttcgtacgtcggtcctacgtcgtcgtacgagtacgtcggacgtactacgtacttagttaccgtagttacgtagttacgtttacgctacgtaacgtccgtaacgggttcggtttacggggtcggtcgggacggggtaaccggtaccgtacggttcccggtacgtacccggttaccgtaacggtcgacccggtaccgtaaccccggg

SEQ ID NO: 292758 - DNA, 791 bp, Homo sapiens
  misc_feature: GYAE6OF01B7H77.33.12.B01.1.454.CMB.1.raw
  modified_base (130)..(130): a, c, t, g, unknown or other
  misc_feature (130)..(130): n is a, c, g, or t
  modified_base (161)..(161): a, c, t, g, unknown or other
  misc_feature (161)..(161): n is a, c, g, or t
  modified_base (240)..(240): a, c, t, g, unknown or other
  misc_feature (240)..(240): n is a, c, g, or t
tcagtacacacactcacgaccggtgctcgatttagtagtgtagatttgggggcgggggtaagaggttgtgtccaccatggcctggactcctctcctcctcctgttcctctctcactgcacaggttccctntcgcaggctgtgctgactcagccgtcttccnctctgcatctccgtaggagcatcagccagtctccaccgtgcctaccgttgcgctaggtcggactatacaagttcggttnaacttacccgtaagaggttacttattccgtacggtaccagacaagaacgccaaggtacttaccgtcccttacccggtatccgtaccgtaggaacggtacctaggtacaggtacctacgtacgtaacgtaccgacgtacggacgaacggggtctaccgggttacggacccgtaccccgaggtccccgtttcgtttaccggtttacggaaccttaccggtaagggttacgtttccggttacccggaaccgtaacggtacggtttaacggtttacttttaaccgcttacgttccgttaccggtcggttaccctacgttacgtacgttacgggtaaccgtagttcggacgtacttaacggttaacttacggtttacgtagttacgttacgttacgtttcggaacttaccgacgtttaaccggaaccgggttttgggtttcgggttacccgggttacggggaaccggggtaaacgtacccggtaacggttccggtaacccggttaccgttaaccgggtacggtaaccccacccgggttaacccgacggttcccccg

SEQ ID NO: 292759 - DNA, 770 bp, Homo sapiens
  misc_feature: GYAE6OF01BXG8U.33.12.B01.1.454.CMB.1.raw
  modified_base (186)..(186): a, c, t, g, unknown or other
  misc_feature (186)..(186): n is a, c, g, or t
  modified_base (371)..(371): a, c, t, g, unknown or other
  misc_feature (371)..(371): n is a, c, g, or t
  modified_base (646)..(646): a, c, t, g, unknown or other
  misc_feature (646)..(646): n is a, c, g, or t
tcagtacacacactcacgaccggtgctcgatttagtagtgtagatttgggggcgggggtaagaggttgtgtccaccatggcctggactcctctcctcctcctgttcctctctcactgcactaggttccctctcgcaggctgtgctgactcagccggtccttccctctctgctatcctccgtggacnctactcgacggccctcgttcctacacctcgcctaccgttgcgtacgaggttcggactatactaagttcggttagaacttaaccgtacgaggtaattacttcggtacggtaacccagtacgaagaacgaccaagtagttacctcccgtacccgttactcctaccgtggtaacggtacgtacggtanaacgtacctacggaacgtactacccgagtacgaccggtacggtccgttaccggtacggaacccgttcccccgaacggttccccgttcgtttttccccgaggttaacggtaaccgtacccggttaaagttacggttttccgttaaccccggaaccgtaaccggtacggtacggtttacttttaactccgtaacttccgttcgtacggtcccgttaccgtacgtcgtacggtacgtagttggaccgttacgtacgtacttaacgtttacttaggttnttaacgtttgtacgtctacgtccgtaagttacgttcggttcgggttacggtaccgggacggaacgggtaccgacggttcgtacccggtaccgttacgttacggaccgacggtccccggtaacgg

SEQ ID NO: 292760 - DNA, 868 bp, Homo sapiens
  misc_feature: GYAE6OF01A9V9D.33.12.B01.1.454.CMB.1.raw
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtgctgactcagccggtccttccctctctgctatcctccgtggagcatcacgcctagtctccgacctgcctaccgttgcgcgagtcggacatcaagttgttagaactacctacgagtattacttcgtacggtaccaggacgaacgacgcctaagtacgttacggttcccccgttacccggtaatccgtaccgtagggtaacggttaaccgtacggtaccgtaacgaaccttacggaagacctaccgacgtacggaccggtacggggtcctacggttacggaccccgttaccccgacggtccccttacctttccgtacggtacgaacccgttaccggaaaggttccgtttaccggggttaccccggaacccgtaacgggtaccggttaacggggtttaaccttttacccggtacttaccgtttaccggtaccgggttacgggtaccctttaccggtaacggtttccggtacgggtaaaccgtaggttacgggtacggttaacgttaccggttaaaccttttaacggtttaagtttaacgggttaacgtttaccgggtttaaggttttacccggtaacttaaccggttaaccggttaccgttaaccgggttccgggtttacgggggttacgggttacccgggggaaccgggtaacggtacccgtaaacggtccggttacccggtaaccggttaccgtaccgggtacccaaacccgggtcccggtacccggg

SEQ ID NO: 292761 - DNA, 781 bp, Homo sapiens
  misc_feature: GYAE6OF01DLMWO.33.12.B01.1.454.CMB.1.raw
  modified_base (134)..(134): a, c, t, g, unknown or other
  misc_feature (134)..(134): n is a, c, g, or t
tcagtacacacactcacgaccggtgctcgatttagtagtgtagatttgggggcggggtaagaggttgtgtccaccatggcctggactcctctcctcctcctgttcctctctcactgcacacgttccctctcgcngctgtgctgactcgacgccggtccttccctctcgtcgcctactccgtccgtggacgactactacgtaacgtcgtacgtcctaccaccctcgacctaccgttcgcgtacgtaggtacggacctactactaagttgttacgtaacctaaccgtaacgaggttacttacgttaccgtacggaacctacgacgaaacggaaccgtacgaacgtacgttacccgtcccgttacccggtacttcccgtacggtacggtacggtaccggtagactaacgtactacgagaccgtacgacgacgtacggtacggtctacggtcgtacccgaccgccgtaccgttcgttacgtcgtacgtacgtacgtaggtacgttcggtaccgacgacggtacggttaacgttacttaccgtagtaccgttcgttccgggaccgttacgtcgtaccgttacgtacggtacgtagtacgggttctacgtaccgtttaacttacgttacgttagttaacggtttcgttaggttaccaacgtacgttaccggtaccgttagtccggggtttaacgggtccgggtaacggggtaacgggccggaaaccgtttaccggtccgggtaaccgttaaccggtacggtacccgacggtaccgacccgggtcccg

SEQ ID NO: 292762 - DNA, 840 bp, Homo sapiens
  misc_feature: GYAE6OF01AZ2H0.33.12.B01.1.454.CMB.1.raw
tcagtacacacactcacgaccggtgctcgatttagtagtgtagatttgggggcgggggtaagaggttgtgtccaccatggcctggactcctctcctcctcctgttcctctctcactgcacaggttccctctcgcaggctggtgctgactcgagccggtcttccctcgtctgctatcctccgtgggactcactcgaacgccgtattcctacgtacccgtcgacctaccgttcgccgtactacggttggactacttacctaagttgttacgtaaccttacccgttagaacggttacttacgttacgtacggtaccagacgaacgaacgtaccgaagtacgttaccgttccccggtacccggttaactccgtaccgtaggtacgtacggtacgtcgacgtactacgaacgtacgaccgacgacggacggtacgggctacggtacggtacccgtcccgacgtcccgtcctttcgtcgtacgtaccgtacgtaacggtacttacgggttacccgaaccggtacggtacggtaacggtttaccttttacgtcgttaacgttccgtaccggttacggttaccctaccggttacgttccgtaacggtacggtaacgtacggtacggtactacggttaacgtttaacttacgttaagttacggtaagttccggttaacgtaacctacgtaccggttaaccggtaccggttacggggtttacggggttaccgggtaccgggtaaccgggggttaaccggtacccgggtaaccggttcccggttaaccccgggtaccggtttaacccgggttacccgggtaaccctaaccggggtacccggtaaccccggg

SEQ ID NO: 292763 - DNA, 513 bp, Homo sapiens
  misc_feature: GYAE6OF02HZB0X.33.12.B01.1.454.CMB.1.raw
  modified_base (232)..(232): a, c, t, g, unknown or other
  misc_feature (232)..(232): n is a, c, g, or t
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcagtggcatcaatgttgatacctanaggatattctggtaccagcagaagccagatagtcctccccggtatcctctgaggtacaggtcagactcagatacgcagcagggctcgtggacgtccccagccgcttctctggatccaaggacttggtttccgggaccaacgcgtagggtacttttactcatctcgtcgggctccgagtctgacgatgagctgtacttattactgtatgtagtttgcacatcaacgtgttgggtggttcggcggagggaccaagcgtcgaccgtctacggtcacgcccacgg

SEQ ID NO: 292764 - DNA, 770 bp, Homo sapiens
  misc_feature: GYAE6OF02F7UVC.33.12.B01.1.454.CMB.1.raw
  modified_base (179)..(179): a, c, t, g, unknown or other
  misc_feature (179)..(179): n is a, c, g, or t
tcagtacacacactcacgaccggtgctcgatttagtagtgtagatttgggggcggggtaaggggaggttgtggtccgaccatggcctggacgtcctctcctcctcctgttcctcgtctcactgctaccaggttcccctctcgcaggcgtgtgcgtcgacgtccagccggtcttcccctntctgacactctcctggagcagtcacgccgagtctcactgaccaccttgcgcagtcggcgactcaatgttagtatacctactagtaattattctggttaccagcagaacgccgagatagtccctaccccggtatcttccttgaggtacaggtcagactcgacgagttacgcagcgaggtctacgtggactccccaagcccgtacttctcgtcggactcccgaaagggtcttcggtttcccggacccgaacggtccgaaggggtacctttttaacgaccgtaacgttaccgttccgttaggggtacctttaccgtaacggtttccgttaacggtaacgtaacgttacgggtaaacgggtacccttagggtaaaccgtttaaacgtttaccgtttagggttaacgttttacggggtaacggtttttacggggaaccctaaaccggttaacttaccggtaaacccggttcgttttacgggggttcggtttaaccggggacccgggtaaaggggtaacccctaaagggtccccttacgggtaccccggttacccgttaaccgggttcccgtaacccggtacccccgttaaccgggg

SEQ ID NO: 292765 - DNA, 557 bp, Homo sapiens
  misc_feature: GYAE6OF02JKO3W.33.12.B01.1.454.CMB.1.raw
  modified_base (313)..(313): a, c, t, g, unknown or other
  misc_feature (313)..(313): n is a, c, g, or t
  modified_base (324)..(324): a, c, t, g, unknown or other
  misc_feature (324)..(324): n is a, c, g, or t
  modified_base (341)..(341): a, c, t, g, unknown or other
  misc_feature (341)..(341): n is a, c, g, or t
  modified_base (346)..(346): a, c, t, g, unknown or other
  misc_feature (346)..(346): n is a, c, g, or t
  modified_base (351)..(351): a, c, t, g, unknown or other
  misc_feature (351)..(351): n is a, c, g, or t
  modified_base (374)..(374): a, c, t, g, unknown or other
  misc_feature (374)..(374): n is a, c, g, or t
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcagtggcatcaatgttgatacctacaggattattcgtggtaccagcagaacgccagatacgtcctcccggtatcctcctgacgtacgagtcagactacagatacgnagcaggctcgnggactcccagcctctcngtgancaagntgttcgcacgcgaggtactttcnctatctcgtcgggcctccgtagtcgtgaacgagtggagtctagtactatttacgtagttagtagttagtttcggactactaacgtcctaacgttcggtttgggtacggttccgggaaggacgggtaaccaaggttcgtaccggtaccgttccgtaagggtccctaacggtacccccgtaacgg

SEQ ID NO: 292766 - DNA, 533 bp, Homo sapiens
  misc_feature: GYAE6OF02I559Y.33.12.B01.1.454.CMB.1.raw
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaacttgcgcagtggcatcaatgttgatacctacaggatattctggtaccagcagaagccagatagtcctccccggtatcctcctgaggtacaggtcagactcagatacgcagcgagggctcgtggacgtccccagccgcttctctggactccgaaggatgtttccggccacgcgagggtacttttacgcattctcgtgggtctccgagttctgacgagtgacggtctcgacttattacgtgtatgtagtttgctactatctaacgtcgttgggtggttcgggcggtacgggaccaggcgtacggaccgttccgtaggtccgacgtaccgaacgg

SEQ ID NO: 292767 - DNA, 690 bp, Homo sapiens
  misc_feature: GYAE6OF02GXC0L.33.12.B01.1.454.CMB.1.raw
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcagtggcatcaatgttgatacctacaggatattctggtaccagcagaagccagatacgtcctccccggtatctcctgaggtacaggtcagactcagatacgcagcagggctcgtggacgtcccagccgtctttccgtcgtcggactaccgaaaggtacttcggtttacccgggacccgtaaaccggccgtaacggggttaacttttttaaccgtaccgtaactttccgttacggttcgggggtacccttcccggtaacggttccgttacggtaaccggtaacgttcggaacgggtccttacggtaaccgtttaacgtttaaccgttaggtttaagttcggttaagttttcgggacctacgtaacgttaccgaacgttcggtttacggggttcggttcggggaccgggtaacggggtaacccgtaaggtccgttacgggtacccggttaccggttaacgggtccgaccggtaccccgtaacggg

SEQ ID NO: 292768 - DNA, 492 bp, Homo sapiens
  misc_feature: GYAE6OF02JCMST.33.12.B01.1.454.CMB.1.raw
  modified_base (378)..(378): a, c, t, g, unknown or other
  misc_feature (378)..(378): n is a, c, g, or t
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcagtggcatcaatgttgatacctacaggatattctggtaccagcagaagccagatagtcctccccagtatctcctgaggtacaggtcagactcagatacgcagcagggctctggagtccccagccgcttctctggatccaaggatgtttcgccaacgcagggtattttacncatctctgggctccagtctgacgatgagctgactattactgtatgtatttggcacatcacgtcgttgggtcgttcggcggaggaccaagctagaccgtcgtacggtcagtcccg

SEQ ID NO: 292769 - DNA, 626 bp, Homo sapiens
  misc_feature: GYAE6OF02H0A1T.33.12.B01.1.454.CMB.1.raw
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcagtggcatcaatgttgatacctacaggattattctggtaccagcagaagccaggatagtccctccccggtatcctccgtgacggtacaggtcagctcagactacgcagcgagggctcgtggaccgtccccgagcccgctttctcgtagggactcccgaaagggtcttcggtttccggacccgaacggcgtaacggggttactttttacctactacttcctcggtcgggtcctacccgtacggttcgtcggaacgtagtggacgtctagtactttaattacgtagttacgtgtagtttcggacactagtacgtaacgttcgtttcggggttcggttccggggaccgggtaacggggaccgtaaacggtcgttacgggtacccgttcccggttaagggtcccgacggacccgtaaccggg

SEQ ID NO: 292770 - DNA, 503 bp, Homo sapiens
  misc_feature: GYAE6OF02GEGC8.33.12.B01.1.454.CMB.1.raw
  modified_base (353)..(353): a, c, t, g, unknown or other
  misc_feature (353)..(353): n is a, c, g, or t
  modified_base (434)..(434): a, c, t, g, unknown or other
  misc_feature (434)..(434): n is a, c, g, or t
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcagtggcatcaatgttgatacctacaggatattctggtaccagcagaagccagatagtcctccccggtatctcctgaggtacaggtcagactcagatacgcagcagggctctggagtccccagcccgctttctctggatccaaggntgtttcgcaacgcagggattttactcatctctgggctccagtctgacgatgagctgactattactgtatgtatttggctanatcaacgtcttgggtgttcgggacggtagggaccaaggctacgacccgttcgtacggtcagcccaacgg

SEQ ID NO: 292771 - DNA, 523 bp, Homo sapiens
  misc_feature: GYAE6OF02HG61D.33.12.B01.1.454.CMB.1.raw
  modified_base (396)..(396): a, c, t, g, unknown or other
  misc_feature (396)..(396): n is a, c, g, or t
  modified_base (429)..(429): a, c, t, g, unknown or other
  misc_feature (429)..(429): n is a, c, g, or t
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtgctgactcagtcggcttccctctctgcatctcctggagcatcagccagtctcacctgcaccttgcgcagtggcatcaatgttgatacctacaggatattctggtaccagcagaagccagatagtcctcccggtatctcctgaggtacaggtccagactcagatacgcagcagggctcgtggacgtccccagccgcgtttctcgtggactccgaaaggacttcggtttacggccctaacggcagggtacttttacnctactctcgtagggtcctccgagttctgacgtntagagctgactattactgtatgtatttgcacatcaagtcgttgggtcgttcggcggacggacagtcgtcgacgtccgtaggcacgccgtaacgg

SEQ ID NO: 292772 - DNA, 671 bp, Homo sapiens
  misc_feature: GYAE6OF02I0JD4.33.12.B01.1.454.CMB.1.raw
tcagtacacacactcacgaccggtgctcgatttagtagtgtagatttgggggcgggggtaagaggttgtgtccaccatggcctgggtacgtcctctcctcctcctgttccctctctcactgcacgaggttccctctcgcaggctgtgctgactcagccggcttccctctctgcatcgtcctggagcatcagccagtctcacctgcaccttgcgcagtggcatcaatgttgatacctacaggatattctggtaccagcagaagccagatagtcctcccggtatctcctggaggtacaggtcagactcagatacgcagcagggctacgtggacgtccccgagcccgtctttcctcttgggactcccgaaagggtacttcgggttttcccgggaccaaaccgggtccgtaaggggtttaactttttaccgtcctaatttccgtcggttcggggtccttcccgtaacggttccttaggtaccgtagttgggaacggtccgtaggtaacctttaagtttacgtacgttaagttcggttagttttcgggacctacgtactactaacggttcgtttaggggttcggttccggggtacggggtacgggtaaccgtaacggtccgttaacgggttacccgttacccggttacgggtaccgaccggtaccccgtaacgggg

SEQ ID NO: 292773 - DNA, 632 bp, Homo sapiens
  misc_feature: GYAE6OF02FQNN2.33.12.B01.1.454.CMB.1.raw
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcagtggcatcaatgttgatacctacaggatattctggtaccagcagaagccagatacgtcctccccggtatcctcctgaggtacaggtcagactcagatacgcagcagggctcgtggacgtccccgagccgtctttcgtcgtggactaccgaaaggtacttcggtttccggaccctaaacggcgtaacggggttaactttttaccgtctaacttcttcgtcgggtcctccgacgttcttacggacgtagtcggacggtctacgtaacttaattacgttgttaagttcgtagttttacggacctaacgtacttaccgtaaccggttcggtttggggttcggtttcggggaccgggtaacggggaacccgtaaggtccgttacggtacccggttccgtaacgggtccgtacggtaccccgtaacggg

SEQ ID NO: 292774 - DNA, 610 bp, Homo sapiens
  misc_feature: GYAE6OF02HFEUC.33.12.B01.1.454.CMB.1.raw
  modified_base (257)..(257): a, c, t, g, unknown or other
  misc_feature (257)..(257): n is a, c, g, or t
  modified_base (285)..(285): a, c, t, g, unknown or other
  misc_feature (285)..(285): n is a, c, g, or t
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcagtggcatcaatgttgatacctacaggatattctggtaccagcagaacnccagatacgtccctcccggtatcctccnggacggtacaggtcagactcagatacgcagcgagggctcgtggacgtcccgagtccgtctttactcgtggactaccgaaaggtcttcggtttaccggcctaacgcgtagggtatttactactactctcgtcggtactccgagtcgtagtacgtagtacggaggtctacggtacttacgtttacgtagttaacgttgttaacgtttcggactaacgtactaccgtaacggttcggtttaggggttcggttaccggggcgggtaacgggaacctaaggtccgtacggtacccggttcgtaacggtaccgtaccggacccgtaacggg

SEQ ID NO: 292775 - DNA, 944 bp, Homo sapiens
  misc_feature: GYAE6OF02IZW4C.33.12.B01.1.454.CMB.1.raw
  modified_base (112)..(112): a, c, t, g, unknown or other
  misc_feature (112)..(112): n is a, c, g, or t
tcagtacacacactcacgaccggtgctcgatttagtagtgtagatttagggggacgggggtaagaggttgtcgtccaccataggtcctgggactcctcctaccgtcctcctnttcctctctcacctgcaactaggttcccttctcgcctacggctgttcgtcctgtaccttcgtacgggcccggtccctttacccgttcggttccttcggtcctacttccgtccggtgggacgccaacttcgaacgaccctaacggttcctaccgtaaccccgtagggaccttaacccggtttagggaccggtcccgtaacggtcgggacctacgttacctaacgttcgtttaacgtaaccttaaaccccgttaacgtaacgtaacgtttaccgtttacccggtaacggttaaccgtacggtaccgaacggtaaacgacccgaaagtaacgtaccggttacccccgttaaccccgggttaacgttccctaccggtacggtaacggtaacgacgggtaccgtaccgtacgtaccgaacggtaacgtaccggtcgagggtacggacgggtccgttacggtaacggtaacccgttaccccgtaaccggtcccggtaccgtttcgtacggttaggacgttaaccgtaaggttacgtttacggtttaccgggaaccgttaacggtacggttaaacggggtttaacttttaaaccgtaacgttactttacccgttaccgggtacgggttaacccttacccgaacgttcgttaacgtaccgtaacgtaaccggaacgttcgtttaacgtactttaaccgttacggtattaacgttgttacgttacgggaccctacgttaccgtaacgtaccggttcgttttcggggtaaccttcgggtaacggaaccggtaccacggttcgaccggtaccttaccgtcgggaaccgaacgtaccgtaacgg

SEQ ID NO: 292776 - DNA, 673 bp, Homo sapiens
  misc_feature: GYAE6OF02JONLM.33.12.B01.1.454.CMB.1.raw
  modified_base (207)..(207): a, c, t, g, unknown or other
  misc_feature (207)..(207): n is a, c, g, or t
  modified_base (232)..(232): a, c, t, g, unknown or other
  misc_feature (232)..(232): n is a, c, g, or t
tcagtacacacactcacgaccggtgctcgatttagtagtgtagatttggggcggggtaaggaggttgtgtccaccatggcctggactcctctcctcctcctgttcctctctcactgcacagttccctctcgcaggctgtgctgactcagccggcttccctctctagcatctcctggagcatcagccagtcctcacctgcaccttgcncagtggcatcatgttgactacctanaggattatctggtaaccagcaagagccagatacgtcctcccggtatctcctgcgtacagtcagactcagatcgcacgacgaggctacgtagggacctaccccgaggcccgtatttccgtcgtagggacttacccgtaaagggctttccggtttacccggggacccctaaagggaccggtaacggggtttacttttaaccctccggtaccttacggttccgtcgggtcccgtacctacggttcgttacggacggtacgtggtacgctaggtaccctttagttacgttcgttagtagtttacgttcggacctacgttaagtcccgtaacggttccgtttagggggttaccgtttcccggggaacgttacgggggaaccctaggtacccgttacgggtaaccccgttccggtaaacgggtccgtaccggtaccccgtaacgggg

SEQ ID NO: 292777 - DNA, 724 bp, Homo sapiens
  misc_feature: GYAE6OF02FQD0A.33.12.B01.1.454.CMB.1.raw
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtactgactcagccggcttccctctctgcatctcctggagcatcagccagtctcacctgcaccttgcgcagtggcatcaatgttgatacctacaggatattctggtaccagcagaagccagatagtcctcccggtatctcctgaggtacaggtcagactcagatacgcagcgagggctcgtcggacgtccccgagcccgtctttcgtcgtacggactacccgaaagggtacttcgggttttaccgggaccctaaaccggccgtaacgggggttaactttttaccgtacctaacgtttccgttaccgttcggggtcccttacccgtaacggttccgttacggtaaccggtaacgttacgggaacgggtaccgttacggtaacctttaacgttttaaccgttaggtttaagttaggttaacgttttgggacctaacgtaacttaccgtaaaccgggttcgtttacggggttacgggtttaccgggggtaccggggtaacggggtaacccgtaaacggtccgttacgggtaaccccggttcccggttaacggggttaccgaaccggtacccccggtaagggtccccgg

SEQ ID NO: 292778 - DNA, 625 bp, Homo sapiens
  misc_feature: GYAE6OF02IPGMB.33.12.B01.1.454.CMB.1.raw
  modified_base (232)..(232): a, c, t, g, unknown or other
  misc_feature (232)..(232): n is a, c, g, or t
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcagtggcatcaatgttgatacctanaggatattctggtaccagcagaagccagatagtcctccccggtatctcctgaggtacaggtcagactcagatacgcagcagggctcgtggacgtccccagccgctttctctggactaccgaaggtattcggttttccggacccgtaacggcgaaggggttaactttttacgtctaacttcttcgtcggggtcctccgtagttccgtaggaccgtagtaggacggtctacggtacttacgtttactagtattgtagtttcgggactacgtaactaccgtaacggtcgtttaggggttcgggttccggggtacgggtaaccggggtaaccgtaacggtccgttacgggtacccggttaccggttacgggtaccgtaccggaccccgtaaccgggg

SEQ ID NO: 292779 - DNA, 711 bp, Homo sapiens
  misc_feature: GYAE6OF02H9W8J.33.12.B01.1.454.CMB.1.raw
  modified_base (235)..(235): a, c, t, g, unknown or other
  misc_feature (235)..(235): n is a, c, g, or t
  modified_base (262)..(262): a, c, t, g, unknown or other
  misc_feature (262)..(262): n is a, c, g, or t
tcagtacacacactcacgaccggtgctcgatttagtagtgtagatttggggggcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgccaccttgcgcagtggcatcaatgttagatacctanaggtattattctaggtaccagcagaanccagatacgtcctcccggtatctcctgacggtacaggtcagtctcagactacgcagcgagggctcgtacggaccgtcccgagccgtctttcgtcgtacggactaccgaaaggtcgttacgggtttaccggacccgtaaacggtcggtaacggggtttaactttttaaccgtacgtaacgttccgttcggtccggggtacccttaccggtacggttccgttacggtaccggtagttacgggtaacgggtcttacggttaaccgttttaagtttaccggttgttaacgtttggttacgttttacggacctaacgtacgtttaacccgacggttcggtttacgggggtttcggttccggggtaccggggtaacgggtaacccgtaacggtacccggttaccggaccccggtttaccggtaaccgggtaccgtacccggacccggtaaccggg

SEQ ID NO: 292780 - DNA, 520 bp, Homo sapiens
  misc_feature: GYAE6OF02JBLNH.33.12.B01.1.454.CMB.1.raw
  modified_base (398)..(398): a, c, t, g, unknown or other
  misc_feature (398)..(398): n is a, c, g, or t
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcaggtggcatcaatgttgatacctacaggatattctggtaccagcagaagccaagatagtccctccccggtatctcctggagtacaggtcagactcagatacgcagcgagggctcgtggacgtccccagcccgtctttctcgtcggatccgaaggacttggtttccgccgaacgcgtacgggtattttacnctatctcgtgggctcctagtctgacagtgagctgactattatgtatgtatttggctacatcacgtcgttgggtcgttgggcggtagggacctagcgtgaccgtctaggtcacgtaccgacgg

SEQ ID NO: 292781 - DNA, 676 bp, Homo sapiens
  misc_feature: GYAE6OF02H9FIU.33.12.B01.1.454.CMB.1.raw
tcagtacacacactcacgaccggtgctcgatttagtagtgtagatttgggggcgggggtaaggaggttgtgtccaccatggccttggactcctctcctcctcctgttcctctctcactgcacaggttccctctcgcaggctgtgctgactcagccggcttccctctctgcatcctccgtggagcatcacgccagtcctcacctgcaccttcgcgcaggtgctatcaattgttgattacctacgaggtattacttcgtcggtaccagcaagaacgaccaggatacgtccctcccggtactctacttcgaggtacacggtcaagactcagaactaccgcgacgcgacgggtctcgtacggaccgtcccgagccgtctttcgtcgtaggaccttacgaaggtattcggtttccgaccgtaacggacgtaacgggttacttttactctacgttctcgtcggtaccgtcgtacgtcgtcgtaacgtacgtacggacggtacgtacggttaacttaacgtttaacttagttaacgttaggttacgtttagtacgactaacgttaccgtaacggttcgggttttacggggttcgggttaccggggtacgggaacggtaaccggtacggtacgtaccggttaccgttaccgggttaccggtaccggtaccgggacctaaccggg

SEQ ID NO: 292782 - DNA, 673 bp, Homo sapiens
  misc_feature: GYAE6OF02HK2D6.33.12.B01.1.454.CMB.1.raw
  modified_base (225)..(225): a, c, t, g, unknown or other
  misc_feature (225)..(225): n is a, c, g, or t
  modified_base (234)..(234): a, c, t, g, unknown or other
  misc_feature (234)..(234): n is a, c, g, or t
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtcctcacctgcaccttgcgcagtgcatcaatgttanactacctanaggtattattctcggtaccagcaaggaacgccaagattacgtcccgtccccggtatcctctggaggtacaggtacacgactcagtactacgcgagcgagggctcgtacggaccgtaccccgagtcccgtactttccgtacgtacggtactaccgaaggttcgttcggtttccggaccgaacgtcggtaaggtttacttttacgtactacgttccgtacgtcgggtcctaccgtagtcgtacggacgagtcggtacgtcgtagtaactttagttacgttagttacgtaggttatttcgggaccttaactacgttaccgtaaggttccggtttaggggttaccgggttacgggacggggtaacccggtaaccgaaccggttaccggttaccggtacccggttacccggttaacgggtaccgtacccggtacccggtaccgg

SEQ ID NO: 292783 - DNA, 626 bp, Homo sapiens
  misc_feature: GYAE6OF02GHTGP.33.12.B01.1.454.CMB.1.raw
  modified_base (231)..(231): a, c, t, g, unknown or other
  misc_feature (231)..(231): n is a, c, g, or t
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcagtggcatcaatgtgatacctanaggatattctggtaccagcaagaagccaagatacgtcctccccggtatcctcctggaggtacaggtcagactcagatacgcagcgagggctcgtggacgtcccgagccgtctttctcgtaggactaccgaaaggtattcggtttaccgacccaacggcgtaacgggtacttttacgactacttcgttcgtcgggtcctaccgtagttacgtagacgtagtggacggtctagtaacttaacgttacgttagttagtagttagtttggacacgtaactacgtaaccggttcggtttaggggtcgggttaccggggtacgggaaccgggtaaccgtaaacggtcgttaccgggtacccgttaccggtaacgggttaccgaccggaccccgtaaccggg

SEQ ID NO: 292784 - DNA, 645 bp, Homo sapiens
  misc_feature: GYAE6OF02HHR4O.33.12.B01.1.454.CMB.1.raw
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcagtggcatcaatgttgatacctacaggattattctggtaccagcagaagccagatacgtccctcccggtatctcctgagtacaggtcagactcagatacgcagcgagggctcgtggacgtccccagccgtctttctcgtggactccgaaaggtcttcggtttccggaccgaacggcgtagggttactttttactactacttaccgtcgttcgggtcctccgtacgttcgttacggacgtacgtcggtacggtacgtacgtaacttaacgtttacgttagttagttaggttagtttcggactaacgtacgttaccgtaacggtcggttttacggggttcgggttacggggacggggtaacgggaaccgtaacggtccggttaccggttaccccggttaccggttaaccgggtaccgtaccggtaccccggtaaccggg

SEQ ID NO: 292785 - DNA, 683 bp, Homo sapiens
  misc_feature: GYAE6OF02HTSUT.33.12.B01.1.454.CMB.1.raw
  modified_base (184)..(184): a, c, t, g, unknown or other
  misc_feature (184)..(184): n is a, c, g, or t
  modified_base (330)..(330): a, c, t, g, unknown or other
  misc_feature (330)..(330): n is a, c, g, or t
tcagtacacacactcacgaccggtgctcgatttagtagtgtagatttggggcgggggtaagaggttgtgtccaccatggcctggactcctctcctcctcctgttcctctctcactgcacaggttccctctcgcaggctggtgctgacgttcagccggcttccctctcgtgccatctcctaggancatcgagccagtcgtcaccgtgcaccttgcgcagtggacatcaattcgtagatacctacaggtattattctggtaccagcagacgcagatacgtcctcccggtatcctacctggagtacgaggttcgagtactcgagactacggtnagcgtaggctcgtagccgtcccagccgtcgttctcgtgtactacccgaaagtcgttacggttccggacctacgcgtaacgggttacttttaccactacgtaccttacggtacgggtcctaccgtaacgttacgttacggtaacgtacgttacggtacggtaccgttacgtaacgttaccgtttaacgtagttacgttacgttaacggttttacgacgtaaacctaacgtaccgtaaccgggttacgggtttaggggttacggtacggggtaccggggtaacggtaaccggtaacggacgttccggttacccggttaccgttacgggtacccggtaccggaccggttaacccgg

SEQ ID NO: 292786 - DNA, 684 bp, Homo sapiens
  misc_feature: GYAE6OF02F1LPR.33.12.B01.1.454.CMB.1.raw
  modified_base (180)..(180): a, c, t, g, unknown or other
  misc_feature (180)..(180): n is a, c, g, or t
tcagtacacacactcacgaccggtgctcgatttagtagtgtagatttgggggcgggggtaagaggtttgtgtccaccatggcctggactcctctcctcctcctgttcctctctcactgcacaggttccctctcgcaggctgtgctgactcagccggcttccctctctgcatctcctggancatcagccagtctcacctgctaccttgcgcagtggcatcaattgttgactacctagagtattattcgtggtaccagcaagaacgaccgagtatacgtcccctaccccggtattcctccgtgacggtactacggtacagtacctacgagactacgcaggcgacgggtcctcggtacggaccgtccccgaggtccccgtctttcgtcgtacggtactacccggtaaggttcgtttcggtttacccggacccgaacggtaccggttagggttaaccttttttacgacttaccgttccgttcggtaccgggtccttaccgtacgttcggttacgtagtacggtcggacgttactcggttaacttacgttacgttagttagttagttagttccgaactacgtacgttaccgtacgttgggtttacgggtcggttaccgggacgggtaccggaaccgtacggtcgttaccggtccgttaccggtacggtaccgaccggtacccgtaacgg

SEQ ID NO: 292787 - DNA, 937 bp, Homo sapiens
  misc_feature: GYAE6OF02FV8G7.33.12.B01.1.454.CMB.1.raw
  modified_base (137)..(137): a, c, t, g, unknown or other
  misc_feature (137)..(137): n is a, c, g, or t
  modified_base (141)..(141): a, c, t, g, unknown or other
  misc_feature (141)..(141): n is a, c, g, or t
tcagtacacacactcacgaccggtgctcgatttagtagtgtagatttagggggacgggggtaagaggttgtgtccaccatggaccctggactccgtctcctcctcctgttcctctctcactgcacgacggttcctcncgcnggctgtcgctacgacctacgacgtccggtccttccctcttcctcgactacttccctccgtagggacctactacgtacctaccgccgtacgttccctaccacccttcgaccgttaccgttcgacccgtaccggtaagggtccggtacctaacgttaccgtaaacggttccggtttaacgggtacctttaacccggtaacggtaacgggtttaacttaaccgtttccggttaaccggttaaccccgaggttaaccggaaacggtaaccggtacccgtaaggttaacccggttacccggttaccccccgggtttacccccggttaacggttaccccggttaccgtaggggtaaaccgggttaccgtacgggttacccgaagtaccgttacggaacggtaccgtaaccggagaaccggtacggggtacggtccgttaccggtaaccgggtacccgtaccccgggacggtttccccgttaccgttttcggttaccgtaacgggttacgtaaccgggtacgggtttaccgttccgggttaacccgaaccgttaccggtacgggtaaacggttttcctttaacgcttacgtaccgtcggtcggtaccttacgtacgtcgttacgcgtaggacgtcgtacgtgttaacttgtacgttaggttacgttgttacggtcgtactacgttaccgacggttaccggtttggttacgggttaccgggttacgggacggggtaaccgtcgtaccggttaccggaccgtttaccgggaccggttacggcccgtaacccggcggttaacccgg

SEQ ID NO: 292788 - DNA, 801 bp, Homo sapiens
  misc_feature: GYAE6OF02I9ARC.33.12.B01.1.454.CMB.1.raw
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtgctgactcagccggcttccctctctgcatcctccgtggagcatcgacgcctagtcctaccacctcgacctaccgttgccgacgaggtcggactatactaaagttggttacgtaacttaacctaacgaaggtattactttcgtacggtaaccagacaagaacgaccaagtacttaccggtccccgtacccggtatcctaccgtaggtacggtacgacggtcgaacgtactacgaagtaacgtaccgacgacggacggacgggtcctcggtacgggaaccccgtacccgacggtcccgttcctttccgtacgtcggtaacctaccggaaaggttacgtttccgggtttacccggaacccgtaacggtccggttaaacgggttttaaccttttaccgacgttacgttccgttaccgggtacgggtcccttaccgtaaggttccgttaagggtaccttaggtacggacggtactacggttaactttagtttaacgttggttaacgttcggttacgtttccgacctaactaacgtaaccgttaacgggttcgggtttacggggttacgggttaccggggaacgggtaccgggtaaccgtaggtcccggtaaccggttacccgggttacgtaaccgggtcccgtaacccggtacccggtaacccgg

SEQ ID NO: 292789 - DNA, 642 bp, Homo sapiens
  misc_feature: GYAE6OF02HUCHO.33.12.B01.1.454.CMB.1.raw
  modified_base (226)..(226): a, c, t, g, unknown or other
  misc_feature (226)..(226): n is a, c, g, or t
  modified_base (234)..(234): a, c, t, g, unknown or other
  misc_feature (234)..(234): n is a, c, g, or t
  modified_base (309)..(309): a, c, t, g, unknown or other
  misc_feature (309)..(309): n is a, c, g, or t
  modified_base (375)..(375): a, c, t, g, unknown or other
  misc_feature (375)..(375): n is a, c, g, or t
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcagtcggcatcaattgttnatacctanaggattacttcgtggtaccagccagaacgccagatacgtccctcccggtatccgtctggacgtacaggtcagctnaagatacgcagcagggctcgtcggactcccgagccgtctttcctcgtacggactaccgtaaaggtntttcggtttccgggaccctaacggtacgtacgggttacttttaacgtctacttccgtcgtacgggtctcccgtagtcgtacgacgtagtcggacggtactacgtaacttaacgttacgttgtaacgttgttaagttcggactaaccgcttaaccgtacggttacggtttcgggtacgggttccgggtaacgggtacgggtaaccgtaacggtcgttaccggtacccggttaccgttaaccgggttaccgtaccggcccgtaaccggg

SEQ ID NO: 292790 - DNA, 746 bp, Homo sapiens
  misc_feature: GYAE6OF02HT1YR.33.12.B01.1.454.CMB.1.raw
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgaccaccttgcgcagtggctatacaagttgttagactacctacgaggtattacgttcgtacggtaccagacaaggaaacgccgaagacgttaccggttccccgttacccccggttaatcccttccgtaggtaacggtaccgtagggtccaagaccttacgaagtacgtaaccgacgaggaccgtacgggccttacggtacggacccgttaccccgacggtcccgtctttcccgtcgtacgggtactaccgtaaggttacgttacggttaccggaaccgtaacgacggtacgggtttaacttttacacgtacgttccgtacggtcggtaccttacgtacgtacgtacggtaacgtagttacgggacgtcgtacgttaactttaacgtttacttaggtttactaggtttacgttacggtacctaacgttaaccgtaccgtaacgggtttcgggttttacgggtacgggtaccggggaacgggtaacggaaccgtacggtaccggttaccggtaccggttaccgtacggtacccgaccggtaccgtacccgg

SEQ ID NO: 292791 - DNA, 620 bp, Homo sapiens
  misc_feature: GYAE6OF02F6U5D.33.12.B01.1.454.CMB.1.raw
  modified_base (433)..(433): a, c, t, g, unknown or other
  misc_feature (433)..(433): n is a, c, g, or t
  modified_base (452)..(452): a, c, t, g, unknown or other
  misc_feature (452)..(452): n is a, c, g, or t
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtcctcacctgcaccttgcgcagtcggcatcaattgttagacttaccgtacgaggtattacttcgtcggtaccaggcaagaacgcagatacgtcccgtccccggtatcctccgtggacggtacgacggtcaaggtacctcgagactacgcgtaggcgagggtctcgtacggacctccccgaggcccgtcttctcgtggactaccgaagtcgttcggttccggaccaacgtcgaggttctttacgntactcgtgtcggctccgtntcgtagacgtgtcgtcgtcgtagtacttagttactagtttagtgttagttcgctagtataccgtacgtacggtttgggttaccggtcgggaccggtaacgggtaccgtaacggtccggttaacggtcccggttaaccggttcggtacccggaccgtaccggtacccgg

SEQ ID NO: 292792 - DNA, 664 bp, Homo sapiens
  misc_feature: GYAE6OF02ITUJ3.33.12.B01.1.454.CMB.1.raw
  modified_base (207)..(207): a, c, t, g, unknown or other
  misc_feature (207)..(207): n is a, c, g, or t
  modified_base (533)..(533): a, c, t, g, unknown or other
  misc_feature (533)..(533): n is a, c, g, or t
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcnagtgcatcaatcgttagactacctacgaggtattactttcgtacggtaaccagacaagaacgccaagattacgtccctccccggtatcctaccgtggacggtacgaggtacaacgtactacgaagactacgacgtaggacgagggtcctggtacggtacccgtaccccggacggtcccgttccttttcgtacgtacggtaacctaccggaaggtactttcgggttaccggaccgtaaccggtacgtagggtttaacttttacgtaaccgtacttccgtcggttccgggaccgtttccgaagttccgtagtacggtaagtggacgtntacgtacttagttacttagtagtcgttagttcgaacctagactacgtactcgggttggtcgggttaccggcgggtacggaaccaggtccgtacggtacccgttaggaccggttcaccgggtaccctaccgg

SEQ ID NO: 292793 - DNA, 638 bp, Homo sapiens
  misc_feature: GYAE6OF02JCF9U.33.12.B01.1.454.CMB.1.raw
  modified_base (352)..(352): a, c, t, g, unknown or other
  misc_feature (352)..(352): n is a, c, g, or t
  modified_base (546)..(546): a, c, t, g, unknown or other
  misc_feature (546)..(546): n is a, c, g, or t
  modified_base (608)..(608): a, c, t, g, unknown or other
  misc_feature (608)..(608): n is a, c, g, or t
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtgctgactcagccggtcttccctctctgcatctccgtggagcatcagccagtctcacctgcaccttgcgtcagtgacatcaagttgttgactacctaacgagtattattcgtacggtacagcaagacgccagatacgtcccgtcccggtatcctctggagtacgaggtcagactcgagacgtacgcgagcgagggtcctcgtacggtacccncccgagcccgtacttttcgtcgttacggactaacccggtaaagtacgtttccggtttccggaaccgaacgtaccgggtaagggtttaaccttttacgactacgttccgttcggtcggtacgtcccgtagttcgtgtaacgtcgtggacgtcgtacgtacgttattacgttagtagttcttagttacgaccgtanacgttacgacggttcggtttgggtacggtccgggacggtaacgggaccgtaagtcggttacnccggttacggtacgtccgacgccgtaacgg

SEQ ID NO: 292794 - DNA, 708 bp, Homo sapiens
  misc_feature: GYAE6OF02HG7BH.33.12.B01.1.454.CMB.1.raw
  modified_base (179)..(179): a, c, t, g, unknown or other
  misc_feature (179)..(179): n is a, c, g, or t
  modified_base (225)..(225): a, c, t, g, unknown or other
  misc_feature (225)..(225): n is a, c, g, or t
  modified_base (331)..(331): a, c, t, g, unknown or other
  misc_feature (331)..(331): n is a, c, g, or t
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtgctgactcagccggcttccctctctgcatctcctggancatcagccagtcctcacctgcaccttgcgcagtggcatcaatgttnactacctagaggtattattctacggtaccagacaagaacgccaagatacgtccctccccggtatcctaccgtggaacggtacgaggtcagacctagagagtaccgnacgacgaggtctacgtggtacccgtcccgagtcccgtctttccgtacgtggtacctaaccgaaggttacgttccgggtttacccggaccgtaaaccgggtcggttaaacgggtttactttttaaccgaccttaacgttcgtttccgggtaccgggtcccttacccgtaggttccgttaacggaccggttagttacgggaacgggttcctaacgttaacctttagttacgttagttacgtggtttacgtttacgactaactagttaccgtacggttcggtttacgggggtcggttaccgggacgggtaaccgggtaaccgacggttaccgttaccggtaacccggtccgtaaccgggtcaccggtacccggtaaccgg

SEQ ID NO: 292795 - DNA, 846 bp, Homo sapiens
  misc_feature: GYAE6OF02FHYMY.33.12.B01.1.454.CMB.1.raw
  modified_base (163)..(163): a, c, t, g, unknown or other
  misc_feature (163)..(163): n is a, c, g, or t
  modified_base (181)..(181): a, c, t, g, unknown or other
  misc_feature (181)..(181): n is a, c, g, or t
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtgctgactcagccggcttccctntctgcatcctcctaggancatcacgccagtcctcacctgcctaccttgacgcgagtcgcacttccgaattcggttagaacttacccgtaacgacggtaattaccgtttccgtacgggttaaacccaggtaccaaggtaaccgaccccaaggtaacgttaaccggtccccttacccccgggttatcccgttaccgtaggtacgtaacgtcggtacacgtactacgaacgaactacggtaccacgtaccggacggtctacgtccggtaacctcccgacgtcccgtctctcgtgtactaccgaggttcttcggttaccgccgaacgtcgtaacggttacttttaccgactacgttccgtcggtacggttaccgttaccgacgttaccgttacggtaccgttacgtaccgggtacggttccgttaaccgttaaaccgttttaccgttaaccggtttacggtttaaacgtttacggtttaaacggttttaccgggaaaccttaaaccggttaacgttaacccgggtttaaccggtttacggggtttacccggggttaccggggttttaaacccggggccgggggtaaacccgggtaaacccggttaaccggttacccggttaccgggtaccccggttaaccgggttacccggtaacccgtaccccgggtaaccccgttaaccccgggg

SEQ ID NO: 292796 - DNA, 588 bp, Homo sapiens
  misc_feature: GYAE6OF02IQE6H.33.12.B01.1.454.CMB.1.raw
  modified_base (219)..(219): a, c, t, g, unknown or other
  misc_feature (219)..(219): n is a, c, g, or t
  modified_base (227)..(227): a, c, t, g, unknown or other
  misc_feature (227)..(227): n is a, c, g, or t
  modified_base (296)..(296): a, c, t, g, unknown or other
  misc_feature (296)..(296): n is a, c, g, or t
  modified_base (300)..(300): a, c, t, g, unknown or other
  misc_feature (300)..(300): n is a, c, g, or t
  modified_base (302)..(302): a, c, t, g, unknown or other
  misc_feature (302)..(302): n is a, c, g, or t
  modified_base (322)..(322): a, c, t, g, unknown or other
  misc_feature (322)..(322): n is a, c, g, or t
tcagtacacacactcacgaccggtgctcgatttagtagtgtagatttgggggcgggggtaagaggttgtgtcacatggctggactcctctcctcctcctgttcctctctcactgcacaggttccctctcgcaggctgtgctgactcagccggtcttccctctctgcatctcctggagcatcagcagtctcacctgcacttgcgcagtgcatcaatgttnatacctanagatattctggtacagcagaagcagtatagtcctcccggtatctctgaggtacacggtcagactcaganacgnancaggctgagcgtcccagccnctttctctggatccaaggattcgtttacgcaacgcaggtattttactcatctcgttgggcttaccgtgtacgttgacgtagtcggtaggactcggtaactttagttaccgttagttattcgttagtttacgttaccgacgtacttaccgtaaccgttacggtttggggtttcggtttccggggtaccgggttaacggggaaccgtaaacggtcggttacgtacccggttacccgttacgggttacgttaccggacccggtaaccgg

SEQ ID NO: 292797 - DNA, 717 bp, Homo sapiens
  misc_feature: GYAE6OF02FET2U.33.12.B01.1.454.CMB.1.raw
  modified_base (165)..(165): a, c, t, g, unknown or other
  misc_feature (165)..(165): n is a, c, g, or t
tcagtacacacactcacgaccggtgctcgatttagtagtgtagatttggggggcgggggtaagaggttgtgtccaccatggcctggactcctctcctcctcctgttcctctctcactgcacaggtttccctctcgcaggctgtgctgactcagccggcttccctntctgcatctcctggagcatcagccagttcctcactgcaccttgcgcagtggcatcaatgttgacttacctacgaggtattacttcgtggtaaccagacagaacgcagatacgtcccgtccccggtatccgtcgtggacgtacgacggtacacggactacgaacgtacgtaccgacgacgtacggacgggtccttacgtcggtaaccgtcccccgaacgtcccgtctttccgttccggtcggtaacgttaccggaacggttacgttccggttttaccggaccgtaaccggtacgtaacgggtttacttttacacctacttccgttcgtcgggtacctaccgtacgttacgtacggaacgtaggttacggaaggtccgttacggttaactttattacgttagttagttacgttagtttcggacctacgtacttaccggtaaccgtttcgggttacgggttcgggttaaccggggacgggtaaccgggaaccgtacggtaccgttacggtaccccggttacggtaccggaccgtaccggtacccggtaaccccgg

SEQ ID NO: 292798 - DNA, 927 bp, Homo sapiens
  misc_feature: GYAE6OF02G5TD3.33.12.B01.1.454.CMB.1.raw
  modified_base (132)..(132): a, c, t, g, unknown or other
  misc_feature (132)..(132): n is a, c, g, or t
  modified_base (191)..(191): a, c, t, g, unknown or other
  misc_feature (191)..(191): n is a, c, g, or t
  modified_base (476)..(476): a, c, t, g, unknown or other
  misc_feature (476)..(476): n is a, c, g, or t
tcagtacacacactcacgaccggtgctcgatttagtagtgtagatttgggggcgggggtaagaggttgtgtccaccatggcctggactcctctcctcctcctgttcctctctcactgcactacggttccctntcgactaggtctgtgctgacctcagtccggtcttccctctctgactatctccgtggacncatcacgacctagtcctaccaccgtcaccttaccgttggccgtagtacggtacggactaacttacgtaaacgttcggtttaacgaaccgttaaaccgtaaccgaaggttaactttaacgtttaccggttaaccggttaaccgaacggtaccgaaaacggttaaaccgaccgttaagtaccgttaccggttacccccttaccccgggtaattccggttaccggtacggtaaaccggtaaccggtaccggtaacgtagtaacccgttaacgactaacggtaacccgngtaacgggtacgtaccgggtcttacggtaacggtccccgtaaccccgtagggtaccccgttaccgtttacgtacggtacgggtaacccttaacgggaaacggtttccgtttacccgggttaaccgaacccgtaacggtacgggtttaaccggttttactttaaacccgcggttaacccgtcgttaaccggtaccggttaccttaaccggtaccgttacgtaacgggtaaccgttagtacgggtacgttaaccgtaagttacgtaacgtttaacgttacgtaacgttcggtttaacccgtacgtacccgtaaacgttacgtaaccggggttaccgtttacggggtttaccggggtaccgggttaccggggaacgttaacccgggtaacaccggtttaccgaaccggtttacccggacgttcggtaaccccgtaccggaccgttaaccccggg

SEQ ID NO: 292799 - DNA, 621 bp, Homo sapiens
  misc_feature: GYAE6OF02I3KIM.33.12.B01.1.454.CMB.1.raw
  modified_base (130)..(130): a, c, t, g, unknown or other
  misc_feature (130)..(130): n is a, c, g, or t
  modified_base (166)..(166): a, c, t, g, unknown or other
  misc_feature (166)..(166): n is a, c, g, or t
  modified_base (177)..(177): a, c, t, g, unknown or other
  misc_feature (177)..(177): n is a, c, g, or t
  modified_base (184)..(184): a, c, t, g, unknown or other
  misc_feature (184)..(184): n is a, c, g, or t
  modified_base (205)..(205): a, c, t, g, unknown or other
  misc_feature (205)..(205): n is a, c, g, or t
  modified_base (228)..(228): a, c, t, g, unknown or other
  misc_feature (228)..(228): n is a, c, g, or t
  modified_base (239)..(239): a, c, t, g, unknown or other
  misc_feature (239)..(239): n is a, c, g, or t
  modified_base (329)..(329): a, c, t, g, unknown or other
  misc_feature (329)..(329): n is a, c, g, or t
  modified_base (334)..(334): a, c, t, g, unknown or other
  misc_feature (334)..(334): n is a, c, g, or t
  modified_base (342)..(343): a, c, t, g, unknown or other
  misc_feature (342)..(343): n is a, c, g, or t
  modified_base (355)..(355): a, c, t, g, unknown or other
  misc_feature (355)..(355): n is a, c, g, or t
  modified_base (370)..(370): a, c, t, g, unknown or other
  misc_feature (370)..(370): n is a, c, g, or t
  modified_base (390)..(390): a, c, t, g, unknown or other
  misc_feature (390)..(390): n is a, c, g, or t
  modified_base (415)..(415): a, c, t, g, unknown or other
  misc_feature (415)..(415): n is a, c, g, or t
  modified_base (607)..(607): a, c, t, g, unknown or other
  misc_feature (607)..(607): n is a, c, g, or t
tcagtacacacactcacgaccggtgctcgatttagtagtgtagatttggggcggggtaagaggttgtgtccaccatggcctggactcctctccgtcctcctgttcctctctcactgcacgaggttccctntcgcgacggctgtgctagactcagcccgctttcccnctctgccatcncctggancatcagccagtctcacctgcnccttgcgctagtcgcatcaagtnttgactcctanaggatacttcgtgaccagcagaagcctagtatgtccctccggtatctccgtgacgtcaggtcagactcaagctaacggcaagtcacggtntaacnggacaccnnccggtaacttcncttaggcacgaaagnttcgttccgaccgttaaacncgtaggttaactttcgcatcttcgnggtacctaacctgtcgtacgtaacgacttcgggacttcgaccgttaacgttacgttacccgtagtaaccgttcgtaagttttccggtaaccactaacgtaacgtccgtcgttttacgggggtacgtttcggggaccgaacggtaccgtaacggtcctaacgggttaccctaacgggttcggttaccgtaacncccggttaaccggg

SEQ ID NO: 292800 - DNA, 600 bp, Homo sapiens
  misc_feature: GYAE6OF02JP3QO.33.12.B01.1.454.CMB.1.raw
  modified_base (361)..(361): a, c, t, g, unknown or other
  misc_feature (361)..(361): n is a, c, g, or t
  modified_base (392)..(392): a, c, t, g, unknown or other
  misc_feature (392)..(392): n is a, c, g, or t
  modified_base (406)..(406): a, c, t, g, unknown or other
  misc_feature (406)..(406): n is a, c, g, or t
  modified_base (414)..(414): a, c, t, g, unknown or other
  misc_feature (414)..(414): n is a, c, g, or t
tcagtacacacactcacgaccggtgctcgatttagtagtgtagatttgggggcgggggtaagaggttgtgtcacatggcctggactcctctcctcctcctgttcctctctcactgcacaggttccctctcgcaggctgtgctgactcagccggcttccctctctgcatctcctggagcatcagccagtcctcacctgccaccttgcgcagtggcatcaatgttagactacctagaggattattctggtaccagcagaacgccagtatacgtccctcccggtatcctctggagtacgaggttcgagacctcgagactacgcgtagcgacgggctcgtcggacgtccccgagccgtctttccncgtggactacgaggatcggttcgacctacgngagggtactttacnctattccngtcggtctccgtagttccgtggaccgtagtcggtagtcgtacgtacgtttattacgtaggtttataggttcgtttagggacctacgtaacgtacctacggttccggtttaggtcgggttcggaccgggtaggacccgtaggtacgtcggtacccggttccgtacgggtaccaggtacccgtaccgg

SEQ ID NO: 292801 - DNA, 615 bp, Homo sapiens
  misc_feature: GYAE6OF02G2TKM.33.12.B01.1.454.CMB.1.raw
  modified_base (178)..(178): a, c, t, g, unknown or other
  misc_feature (178)..(178): n is a, c, g, or t
  modified_base (204)..(204): a, c, t, g, unknown or other
  misc_feature (204)..(204): n is a, c, g, or t
  modified_base (218)..(218): a, c, t, g, unknown or other
  misc_feature (218)..(218): n is a, c, g, or t
  modified_base (236)..(236): a, c, t, g, unknown or other
  misc_feature (236)..(236): n is a, c, g, or t
  modified_base (258)..(258): a, c, t, g, unknown or other
  misc_feature (258)..(258): n is a, c, g, or t
  modified_base (280)..(280): a, c, t, g, unknown or other
  misc_feature (280)..(280): n is a, c, g, or t
  modified_base (312)..(312): a, c, t, g, unknown or other
  misc_feature (312)..(312): n is a, c, g, or t
  modified_base (335)..(335): a, c, t, g, unknown or other
  misc_feature (335)..(335): n is a, c, g, or t
  modified_base (399)..(399): a, c, t, g, unknown or other
  misc_feature (399)..(399): n is a, c, g, or t
  modified_base (420)..(420): a, c, t, g, unknown or other
  misc_feature (420)..(420): n is a, c, g, or t
  modified_base (441)..(441): a, c, t, g, unknown or other
  misc_feature (441)..(441): n is a, c, g, or t
tcagtacacacactcacgaccggtgctcgatttagtagtgtagatttgggggcgggggtaagaggttgtgtccaccatggcctggactcctctcctcctcctgttcctctctcactgcacaggttccctctcgcaggctgtgctgactcagccgtcttcctctctgcatctcctggancatcagccgatctcactgctactgcnagtgcatcaatgtnactacctacgagtacttnttcgtacgtaccagcaagtacncagatcgtaccgtccgtatccncgtagacgtacagtacagtacctgagactacngagcgaggtctagcgtacgaccncgccttcttctcgacggtactccgaagtcttacggtcgaccgacgtacgtacggttactttacncgtatcgtcgtcggtctacgnttcgagtacgctcggagtctnacttagttatcgttagtacgttgttcggaccaacgtacgttccgtaacgtttcgggtttacggttcggggttaccggggaacgggttacccggtaaccctagggtacccgtttaacgggtaccccgttttaacgggacccgggtaacgtaccccggtaacgggttaaccccggg

SEQ ID NO: 292802 - DNA, 822 bp, Homo sapiens
  misc_feature: GYAE6OF02IIPWX.33.12.B01.1.454.CMB.1.raw
  modified_base (176)..(176): a, c, t, g, unknown or other
  misc_feature (176)..(176): n is a, c, g, or t
tcagtacacacactcacgaccggtgctcgatttagtagtgtagatttggggggcggggggtaaggaggttgtgtccaccatggcctggactcctctcctcctcctgttcctctcctcactgctacctacggttcccctctcgctaggctgtgctgacctcgagccggtcttccctntctgcctattcctccgtaggacgtctatccgagtcctagttcctccaccgtgaccctaccgttgccgacgtaggtcgacctactactaattcggttagtacttaacctagagtacttaacttaccgtacggtaaccgacgaacgtaacggaaccgtaccgtaacgtaacttaacgtaccccgtaccccggttactacccgttccgttaaggtaacgggtacgtacggttacgaacggtacctacgtaacggtacgtaaccgacggtacgtacggacggttcctacggtacggtacccgtacccgtacggtcccgtctttaccggtacgttacggtaccttaaccggtaaagttaccgtttacggtttacccggacccgtaacggtaccggtaacggtttaactttaccgtacgtaacgttcgttaccggtcggtaccgttacgtacgtacgttaggtaccgtagtacggtacgtactaacgtaacgttaacttaacgttacgttaacgttggttaacgtttcgaaccgtaacgtaactaaccgtacggttacggttcgggttacggtaaccgggtacggtaacggtaaccgtacgtccgttacggtacccgttacgtaccggtacgtacccggtaccgtaacccgg

SEQ ID NO: 292803 - DNA, 522 bp, Homo sapiens
  misc_feature: GYAE6OF01C9FGE.52.67.G01.1.454.CMB.1.raw
  modified_base (502)..(502): a, c, t, g, unknown or other
  misc_feature (502)..(502): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgacaatactttgcattgggtgcgccaggcccccggacaagggcttgtttggatgggatggatcaacgctggcaagtggtaacacaaaatattacacagaagttccagggcagagtcacatcaccagggacacatcgcgagcacagcctacatggagttgagcagcctgagaatgaagacacggctagtatattactgtgcgagaggggaaatggcctccacgagggcccagtccggtccttcccccnggcccaccctcctccgaacg

SEQ ID NO: 292804 - DNA, 539 bp, Homo sapiens
  misc_feature: GYAE6OF01EF39E.52.67.G01.1.454.CMB.1.raw
  modified_base (407)..(407): a, c, t, g, unknown or other
  misc_feature (407)..(407): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctcttttggtggcagcagccacaggtggccactcccaggtccagcttgtgcagtctggggctgaggtgaagaagcctggggcctcagtgaaggtttcctgcaaggcctctggatacacctttcagtgacaatactttgcattgggtgcgccaggcccccggacaagggcttgtttggatggggatggatcaacgctggcaatggtaacacaaaatattcacagaagttccagggcagagtcacatcacagggacacatccgacgagcacagccctaanatggagttgagcagcctagagaatgaagacacggctgtatatactgtgcgagagggaaatggacctcgaccgaagggccccaagtcccgggttccttccccccgtggaccctaccccgtccctcgtaaacgg

SEQ ID NO: 292805 - DNA, 550 bp, Homo sapiens
  misc_feature: GYAE6OF01B6LRC.52.67.G01.1.454.CMB.1.raw
  modified_base (217)..(217): a, c, t, g, unknown or other
  misc_feature (217)..(217): n is a, c, g, or t
  modified_base (345)..(345): a, c, t, g, unknown or other
  misc_feature (345)..(345): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctggaggtgaagaagccgtggggcctnagtgaaggtttcctgcaaggcctctggatacaccttcagtgacaatactttgcattgggtgcgccaggcccccggacaagggcttgtttggatggatggatcaagctggcaatggtaaacacaaaatnttcaacagaagttcaggcagagtcacatcacaggacacatccgcgagcacagcctaacatggacgttgagcagcctgaagaatgaagcaggctgtatagttactgtgacgaggaagggaaatggacccgtccgaaccgaaacggggcccctaagtccgggtccctttacccccgttggcccctaacccttccgacccgtaaacgg

SEQ ID NO: 292806 - DNA, 521 bp, Homo sapiens
  misc_feature: GYAE6OF01EYSBC.52.67.G01.1.454.CMB.1.raw
  modified_base (501)..(501): a, c, t, g, unknown or other
  misc_feature (501)..(501): n is a, c, g, or t
  modified_base (507)..(507): a, c, t, g, unknown or other
  misc_feature (507)..(507): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgagaagcctggggcctcagtgaaggtttcctgcaaggcctctggatacaccttcagtgacaatactttgcattgggtgcgccaggcccccggacaagggcttgtttggatgggatggatcaacgctggcaatggtaacacaaaatattcaacagaagttccagggcagagtcacatcacagggacacatccgcgagcacagccctacactggagttgagcagcctgagaaatgaagacacggctgtatattactgtgcgagagggaatggcctccgacaacgggcccagtcggtccttccccgnggaccnccctcctccgaacg

SEQ ID NO: 292807 - DNA, 566 bp, Homo sapiens
  misc_feature: GYAE6OF01DLRA2.52.67.G01.1.454.CMB.1.raw
  modified_base (277)..(277): a, c, t, g, unknown or other
  misc_feature (277)..(277): n is a, c, g, or t
  modified_base (293)..(293): a, c, t, g, unknown or other
  misc_feature (293)..(293): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgactaatactttgcattgggtncgccaggcccccgganaagggcttgttggatgggatggatcaacgctggcaataggtacaacaaatattacacagaagttcagggcagagtcaccatcaccagggacacatccgcgagcacacgctacatggagttgagcagccgtgagaaactgaagaaccaggtactgtagtacttacgtgtgacgaaggtaggggaaactcgggtaccgtaccgaacccgaagggcccctaagttcccggtacccttcccccgttacgggacccacccccgtctacccgtaaacgg

SEQ ID NO: 292808 - DNA, 585 bp, Homo sapiens
  misc_feature: GYAE6OF01DAQUA.52.67.G01.1.454.CMB.1.raw
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgacaatactttgcattgggtgcgccaggccccgacaagggcttgtttggatgggatggatcaacgctggcaagtggtaacaacaaaatattacacagaagttccagggcagagtcacatcacgaggacacatccgacgagcacagccctacgatggagttgaacgtcaacgcctagaacgaaatgaagacgacggtctaggtatagttactgtagcggtaggaaggggaaacgtcggacccttacccgaaccgtaaacggggccccctaaggttcccggtacccgtttaccccccgtacgggaccctaacccccgtccgtcccgaaacgg

SEQ ID NO: 292809 - DNA, 575 bp, Homo sapiens
  misc_feature: GYAE6OF01CA9H2.52.67.G01.1.454.CMB.1.raw
  modified_base (294)..(294): a, c, t, g, unknown or other
  misc_feature (294)..(294): n is a, c, g, or t
  modified_base (472)..(472): a, c, t, g, unknown or other
  misc_feature (472)..(472): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcgagtgaaggtttcctgcaaggcctctggatacaccttcagtgacaatactttgctattgggtgcgccaggcccccgganaacggggctttggtttggagtgggatggatcaacgctggcaagtggtaacaacaaaaatgttacaacagtaagttccaggacagagtcacatcaccgaggacacatccgcgagcacgacgacctacagtggagttgagtcagcctagagaatgaacgcgacggactagtatagttacngtgacgaaggagggaaatcgggacctaccggaccgaacgggtcccaaggttcccggtaccctttacccccgacggaccctaccccgtccgtaacccgtaacgg

SEQ ID NO: 292810 - DNA, 641 bp, Homo sapiens
  misc_feature: GYAE6OF01B67SQ.52.67.G01.1.454.CMB.1.raw
  modified_base (281)..(281): a, c, t, g, unknown or other
  misc_feature (281)..(281): n is a, c, g, or t
  modified_base (298)..(298): a, c, t, g, unknown or other
  misc_feature (298)..(298): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcaggtgaaggtttcctgcaaggccctgtggactacaccttcagtgactaatactttgctattgggtncgccacggcccccgganaagggcttgttggagtgggatggatcgaacgctgggactaagtggtaacacaaaatattacacagaagttccgaggcagagcacgtatacgacaggacacataccgcgagcacagacctacacgtaggtagttagacgcgaacgtctagacgtaaagtgaacgacgtaacggctaggttaactaacgtttactagggttcgacggtagggaaagggggtaacttcgggacccgttacccgaccggaaacgggggttcccccgaacggttacccccgggttacccgtttcccccccggtaccggacccccgttaccccctccccggttaccctaaaccccgggg

SEQ ID NO: 292811 - DNA, 595 bp, Homo sapiens
  misc_feature: GYAE6OF01DEA9M.52.67.G01.1.454.CMB.1.raw
  modified_base (256)..(256): a, c, t, g, unknown or other
  misc_feature (256)..(256): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtnacaatactttgcattggtgcgccaggcccccggagaacgggcttggtttggagtgggatggatcgaacgctggcaagtggtaacaactaaaaatacttacaacgtagaaacgttccgaaggcaagacgtcacatcaacgaggacacacgtccgacgagcacacgcctaacatcggagttgagcacgcctagaagaagtagaaacgcacggtctaggtaattagttactggtagacggaaggtaggggaaacgtggacccgttaccgacccgaacggggcccctaaggttcccgggtacccttcccccgtggaccccctacccttcccgtacgtaaccgg

SEQ ID NO: 292812 - DNA, 628 bp, Homo sapiens
  misc_feature: GYAE6OF01AOX7B.52.67.G01.1.454.CMB.1.raw
  modified_base (241)..(241): a, c, t, g, unknown or other
  misc_feature (241)..(241): n is a, c, g, or t
  modified_base (270)..(270): a, c, t, g, unknown or other
  misc_feature (270)..(270): n is a, c, g, or t
  modified_base (492)..(492): a, c, t, g, unknown or other
  misc_feature (492)..(492): n is a, c, g, or t
  modified_base (607)..(607): a, c, t, g, unknown or other
  misc_feature (607)..(607): n is a, c, g, or t
tcagcgcagtacgacacgaccggtgctcgatttagagtatacatattgggtttggggtacccgaacaaccacatccctcctcagaagccccagagcacaacgcctcaccatggactggacctggaggatcctctttttggtggcagcagccacaggtggccactcccaggtccagcttgtgcagtctggggctgaggtgaagaagccgtgggcctcagtgaaggtttcctgcaaggccctntggatacgacctttcagtgacatacttgnagttggtgtcgccgtacggacccccggacgaacgggtcgttacggtttggagttgggatgggatacgaacggtctcggtcgtaagtcggtaacacaaaagtattcgaacagtaacgttacgaggtacagtaagtcaacgactacgacacgggacacgagtccgacgacgtcgaacgacgtaccacgtacgtaggacgttgacgtcgacgcgtagacgtaagngaacgcgaacgcgtagtagtattacgtagttggagaacgggtagggaacggtacgtccggaccgtaccggaacggccccgaacgttaccggtcccgtttccccggacggtacccnccccgttcctacccggaacgg

SEQ ID NO: 292813 - DNA, 556 bp, Homo sapiens
  misc_feature: GYAE6OF01A796P.52.67.G01.1.454.CMB.1.raw
  modified_base (293)..(293): a, c, t, g, unknown or other
  misc_feature (293)..(293): n is a, c, g, or t
  modified_base (455)..(455): a, c, t, g, unknown or other
  misc_feature (455)..(455): n is a, c, g, or t
  modified_base (538)..(538): a, c, t, g, unknown or other
  misc_feature (538)..(538): n is a, c, g, or t
  modified_base (546)..(546): a, c, t, g, unknown or other
  misc_feature (546)..(546): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagccgtggggcctcagtgaaggtttcctgcaaggcctctggatacaccttcagtgacaatactttgcattgggtgcgccaggcccccgganaagggccttgttggagtgggatggatcaacgctggcaatggtaaacacaaaatattacacaagaagttccaaggcagatcaccatcacagggacacatccgacgagccaacacgtccctaacgagtggagttgagccagcctagaagaatgaacgcaacggntagtatattactgtagcggaagaggggaatcggacctaccgacgaaccgggcccagtcccggttaccctccccgtcggacccnccctcccnccgtaaacgg

SEQ ID NO: 292814 - DNA, 645 bp, Homo sapiens
  misc_feature: GYAE6OF01B7QIG.52.67.G01.1.454.CMB.1.raw
  modified_base (430)..(430): a, c, t, g, unknown or other
  misc_feature (430)..(430): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtcgtggggctggaggtgaagaagccgtggggcctcgagtgaaggtttcctgcaaggcctcgtggatacaccttcagtgacaatactttgctattgggtgcgccgacggcccccggacaaggggtcttggtttggatgggactggatcaacgctggacaagtggtaacacgtaaaatgttacaacaagtaagttcgaggcagcgtacactatacaccagggacacgatccgacgagcacacgcctaanagtaggagttcgagtcagcctaggaacgaataggaacgaccgaacgggtctaggttaactaagtttacgtaggttagacgggtaagggaaagggggtaaacttcgggaccccgttaaccgaacccgggaaacgggtcccccgaaagttccccgggtttacccgttcccccccgtagggtacccccctaacccccgttccgttaccccgaaaccgg

SEQ ID NO: 292815 - DNA, 698 bp, Homo sapiens
  misc_feature: GYAE6OF01AIT9N.52.67.G01.1.454.CMB.1.raw
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagagcctggggcctcagtgaaggtttcctgcaaggcctcgtggatacaccttcgagtgacaattactttgctagttgggtcgcgccgtacggcccccggagaagggtccttggtttagggagtgggatggactcgaacggcgtggactaagtacggtaaacaacgtaaaatacttacgaacgtacggtaaacgtttccgaacgggacaaggtacgtacaaccgataccgaaccgaggaccacacgtccgacgacgacacgacgacctacgagtacggtagttacgacgtcgacgtacgtagaacgaagtacgaacggacgtaacgggtcttaagttaacttacgtttaacgtacggtaggaacgggtaacgggtaacgggtaacgtacccggtacccgtacccggaacccggtaacgggtcccgtaaccggttccgggtttacccccgttaccccgggtccggaccccgtacccccgttacccgtaccgtaaacccggg

SEQ ID NO: 292816 - DNA, 734 bp, Homo sapiens
  misc_feature: GYAE6OF01DF4TD.52.67.G01.1.454.CMB.1.raw
  modified_base (292)..(292): a, c, t, g, unknown or other
  misc_feature (292)..(292): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgacaatactttgcattggtgcgccacggcccccgganaacgggcttgtttggatgggatggatcaacgctggcaatggtaacaacaaaatattacacagtaacgttccgagggacagacgtcaaccatccaaccgagggtaccactacgtacccggaccgaggaccaaccgaacgaccccttaaccgaagttcgggaggtttacgaacggaccgtaacggcccttaaggaagaaacgtacgggaaagaacccgacggggtacccgttaggttaacttaacgtttaaccgttagggttacggccgggaaaaggggtaaagggggaaaaacgtttccggggaccccgttaaccccgaaccccggtaaaccgggggtacccccctaacggttacccccggggtttaccccgtttaccccccccggttacggggtaccccctaaaccccccggtttcccccgtaaccccgggtaaaacccggg

SEQ ID NO: 292817 - DNA, 560 bp, Homo sapiens
  misc_feature: GYAE6OF01EYMQD.52.67.G01.1.454.CMB.1.raw
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgacaatactttgcattgggtgcgccaggcccccggacaagggcttgtttggatgggatggatcgaacgctggcaagtggtaacacaaaatattcaacagaagttccaggcagagtcacatcacaggacacatccgcgagcacagcctaacatggagttgagcagcctagaacgaaatgaagacacggctagtaatattactgtagcgaaggaggggaaatcgggccctaccgaaccgaacgggcccctaaggttcccggtccctttccccccgtaggaccctaccccttcccgtcccgtaaacgg

SEQ ID NO: 292818 - DNA, 610 bp, Homo sapiens
  misc_feature: GYAE6OF01EZ0UK.52.67.G01.1.454.CMB.1.raw
  modified_base (278)..(278): a, c, t, g, unknown or other
  misc_feature (278)..(278): n is a, c, g, or t
  modified_base (292)..(292): a, c, t, g, unknown or other
  misc_feature (292)..(292): n is a, c, g, or t
  modified_base (344)..(344): a, c, t, g, unknown or other
  misc_feature (344)..(344): n is a, c, g, or t
  modified_base (408)..(408): a, c, t, g, unknown or other
  misc_feature (408)..(408): n is a, c, g, or t
tcagcgcagtacgacacgaccggtgctcgatttagagtatacatattgggtttggggacccaacaaccacatcccctcctcagaagcccccagagcacaacgcctcaccatggactggacctggaggatcctctttttggtggcagcagccacaggtggccactccccaggtccagcttgtgcagtctggggctgaggtgaagaagcctggggcctcagtgaaggtttcctgcaaggcctctggatacaccttcagtgacaatactttgcattgggtncgccaggccccganaggcttgttggatgggatggatcgaacgctggcaagtggtaacaacaaaatnttacaactagaagttccagggtacagtacgtcaacctatcgaacgaggacacacgtccgacgancaacgagaccctaacgagtggagttgagcagcctagaagaaatgaaacgacacggtctagtattattacgtagtcgacggtaggaagggtaaacgtcgggtaacccgtaccgtaacggaaccggggtacccaacggttcccggttaccccgtttcccccggtacgggaccccctaaccccgttccccgtacggtaaacccgg

SEQ ID NO: 292819 - DNA, 642 bp, Homo sapiens
  misc_feature: GYAE6OF01EN2V0.52.67.G01.1.454.CMB.1.raw
tcagcgcagtacgacacgaccggtgctcgatttagagtatacatattgggtttggggacccaacaaccacatccctcctcagaagcccccagagcacaatgcctcaccatggactggacctggaggatcctctttttggtggcagcagccacaggtggccactcccaggtccagcttgtgcagtctggggctgaggtgaagaagcctggggcctcagtgaaggtttccctgcaaggcctctggatacaccttcagtgacaatactttgcagttgggtgcgccaggcccccggagaacgggcttggtttggatgggatggatcgaacgctggcaatggtaaacacaaaatattacacagaagttccagggcagacgtcaccatcaaccagggacacactccgacgacgcaacacgcctaacgacgtagggagttaggacgtacgacggtcctaggaacgtaaagtacgaaaggaccgaacgggtcgttagttaagttacgttaacgttggtacgacggtaagggacgggggtaaatacggggtaccctaacccggaacccggaaccggggaccccgtaacggtcccgggttaccccttaccccccggtacggtaccccctaaccccgtccccgtaaaccccgg

SEQ ID NO: 292820 - DNA, 601 bp, Homo sapiens
  misc_feature: GYAE6OF01A1KRH.52.67.G01.1.454.CMB.1.raw
  modified_base (140)..(140): a, c, t, g, unknown or other
  misc_feature (140)..(140): n is a, c, g, or t
  modified_base (228)..(228): a, c, t, g, unknown or other
  misc_feature (228)..(228): n is a, c, g, or t
  modified_base (280)..(280): a, c, t, g, unknown or other
  misc_feature (280)..(280): n is a, c, g, or t
  modified_base (285)..(285): a, c, t, g, unknown or other
  misc_feature (285)..(285): n is a, c, g, or t
  modified_base (295)..(295): a, c, t, g, unknown or other
  misc_feature (295)..(295): n is a, c, g, or t
  modified_base (341)..(341): a, c, t, g, unknown or other
  misc_feature (341)..(341): n is a, c, g, or t
  modified_base (348)..(348): a, c, t, g, unknown or other
  misc_feature (348)..(348): n is a, c, g, or t
  modified_base (401)..(401): a, c, t, g, unknown or other
  misc_feature (401)..(401): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggnggcagcagccacaggtgccacttcccaggtccagcttgtgcagtctggggctgaggtgaagagcctggggcctcagtgaaggtttccnggcaaggcctctggactacaccgtttcagtcgacaatactttgcattgggtncgccnggccccgganaagggcttgttggatgggactggagtcaacgctggcaatggtaacncaaaatntcaacagaagttccaggtcagagtcaccgtatcgacagggacacgtatcccgngacgcacagccctacagtcgacgttgacgtcagtccgtgagtaactgaacgcgtaccggctacgggtactacgttacgtcggtacgaccggagtacggggtaaacttgggacccgttcggaacccgtaacgggtccccgtaagttccggttacccgttcccccggtaggaccctaccccgtaccgtcccgtaaaccgggg

SEQ ID NO: 292821 - DNA, 644 bp, Homo sapiens
  misc_feature: GYAE6OF01CRVT2.52.67.G01.1.454.CMB.1.raw
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgacaattactttgctattgggtgcgccacggcccccggacaagggcttgtttggatgggatggatcaacgcgtggcaagtggtaaacaacgaaaatattacactagaacgttccagggcagagtcaccataccaccgagggacacatccgcgagcacagcctacgatggagttgagcgagccgtagaagaaataggaagaaccgacgggaccttaggtaattaacgtttaacgtaggttacgacgggaaggtaaagggggtaaacgtcgggacccgttacccgaacccggaaacggggtacccctaaaccggttcccgggttaccccgtttcccccccggtaccgggtacccccgtaaccccccgttccccgtaccccgtaaaacccgg

SEQ ID NO: 292822 - DNA, 711 bp, Homo sapiens
  misc_feature: GYAE6OF01EOF6Q.52.67.G01.1.454.CMB.1.raw
  modified_base (151)..(151): a, c, t, g, unknown or other
  misc_feature (151)..(151): n is a, c, g, or t
  modified_base (300)..(300): a, c, t, g, unknown or other
  misc_feature (300)..(300): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctcttttggtggcagcagccanacccggtggccactcccaggtccagcttgtgcagtctggggctgaggtgaagaagccgtggggcctcagtgaaggtttcctgcaaggcctctggatacaccttcagtgactaattactttgctagttgggtgcgccacggcccccgganaagggtctttgtttcggatgggatggatcgaacgctggacaagtggtaaacaacgaaaatacttacaacgagtaacgttccgaaggggcaaggtaacgtccgaaccactaccgaaccgaagggaaccaacgacgtacccgacgacgacaacgacgtaccctaacagtagggagttaggacgtacacggaccgttaggaacgtaaacgtagggaaacgtaaccgaaccgggtacgttaggttaaatttaaccgtttaacgtggttacggaccggaagggtaacggggtaaaagtccgggtaccccgtacccggaaccggaaacccggggccccttacgggttaccccgggttcccccgtttaccccccggtaccggtacccctaccccccggttacctacccggaaacccgg

SEQ ID NO: 292823 - DNA, 814 bp, Homo sapiens
  misc_feature: GYAE6OF01CXMS9.52.67.G01.1.454.CMB.1.raw
  modified_base (232)..(232): a, c, t, g, unknown or other
  misc_feature (232)..(232): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacgaggtcgccactcccgaggtccagcttgtgcagtctgggctgaggtgaagagccgtgggcctgagtggtaaggttttccnggacaacggctacgtggactaccacctttcgagttgaacctaagttaccgttttgacgtaggtttgggagcccggaccgaccggggaccccccggacgtaaacggggttccgtttagggttttacgggaagtttcggggaagttcggaacgttaccggaacggtccgtagggtacctaaagtacgggttaaaacaaacgttaaaaacgtcgtttaaccgaaaccgtaaggtaaacggtttacccggaagggttaaccaacggtaacggttaccaacccgtaagtcccgtaaaccggagggtaacccacgtacgaccggacgacgaccgaacgtacgtacccgttaacgacgttacgggtagttacgacggtacacgtcgtacggaaagtaacgtagaacggtacgaacggtaccgtagtaacgtttataccgtaggttacgaacgggtaacggggtaagggaaacggtccggtaccccgtaacccggaccggtaaaccggtacccgttaaccggtcccgggtttaccccctttccccccggacgttaccccgtacccccgttccgtaacccgtaaacccggg

SEQ ID NO: 292824 - DNA, 675 bp, Homo sapiens
  misc_feature: GYAE6OF01EGNLK.52.67.G01.1.454.CMB.1.raw
tcagcgcagtacgacacgaccggtgctcgatttagagtatacatattgggtttggggacccaacaaccacatccctcctcagaagcccccagagcacaacgcctcaccatggactggacctggaggatcctcttttggtggcagcagccacaggtggccactcccaggtccagcttgtgcagtctggggctgaggtgaagaagccgtggggcctcagtgaaggtttcctgcaaggcctcgtggactacaccttcagtgacaatactttgcattgggtgcgccaggcccccggacaagggctttgtttggatggggatgggatcaacgctggcaatcggtaacaacaaaaatattacaacgagaaagtttcccgaagggtcaagacgtacaccaatccaaccgaagggaccacacgtcccgacgacggacacacggccctaacacgttagggagtttggagtcaacgcccgttaggaacgaaagtggaaacgaaccgaacgggtaccgtaggttaacttaatttaacgtggttaggacgggaagggaagggggtaaatcgggtacccgttacccggaaacccgaaccggggtccccaacggttcccgggtttaccccgtttaccccccggtacgggaccccctaaccccccggttcccctcccggtaaaacccggg

SEQ ID NO: 292825 - DNA, 532 bp, Homo sapiens
  misc_feature: GYAE6OF01BS8G1.52.67.G01.1.454.CMB.1.raw
  modified_base (436)..(436): a, c, t, g, unknown or other
  misc_feature (436)..(436): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgacaatactttgcattgggtgcgccaggcccccggacaagggcttgttggatgggatggatcaacgctggcaatggtaacacaaaatatcacagaattcaggcagagtcacatcaccagggacacatccgcgagcacagccctaacactggagttgagcagccctgaacgaaatgaagaanacggctgtaatattaactgtgcggagaggggaaatggaccgtccaaccgaacgggcccatccggtccttccccctaggccaccctccctccaaacg

SEQ ID NO: 292826 - DNA, 528 bp, Homo sapiens
  misc_feature: GYAE6OF01DTJ0N.52.67.G01.1.454.CMB.1.raw
  modified_base (292)..(292): a, c, t, g, unknown or other
  misc_feature (292)..(292): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgacaatactttgcattgggtgcgccaggcccccgganaagggcttgttggatgggatggatcaacgctggcaatggtaacaacaaaatattacacagaagttccaggcagagtcacatcacgaggacacatccgcgagcacacgcctacatggagttgagcagcctgaagaatgaagacacggctagtatattacgtgtgcgagagggaaatcggacctcgaccgacggcccacgtccggtccttccccgtggcctacccctccgtccgaacg

SEQ ID NO: 292827 - DNA, 722 bp, Homo sapiens
  misc_feature: GYAE6OF01CCGNA.52.67.G01.1.454.CMB.1.raw
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagccgtggggcctcagtgaaggtttcctgcaaggcctctggatacacttcagtgacaatactttgcattgggtgcgccacggcccccggacgaaggggtcttggtttggagtgggatgggatcaacgctggacaagtggtaaacacaaaagtattcaacagaagttcgaggcagagtcacatcaccgagggacacactccgacgagccaacacgacccttacaagtcgggtagttgggaacgccgtaggcccttaaggaacggtaaaagttacgggaaaggacccgtaacgggtaccgtttaaggttaagttaaacgttttaccgtagggttaccggtaaccgggtaaggggtaaacggggggtaaaacgttaccggggtaaccccgttacccccggaaacccggaaaccgggggtaccccccgtaaacggttttccccggggttacccccgttttacccccccgggtaccgggtaacccccgttacccccccgttaccccgtaccccggtaaaaccggg

SEQ ID NO: 292828 - DNA, 532 bp, Homo sapiens
  misc_feature: GYAE6OF01AKCH7.52.67.G01.1.454.CMB.1.raw
  modified_base (406)..(406): a, c, t, g, unknown or other
  misc_feature (406)..(406): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgacaatactttgcattgggtgcgccaggcccccggacaagggcttggtttggatgggatggatcaacgctgggcaatggtaacacaaaatattcacagaagttcaggcagagtcacatcaccagggacacatccgcgagccacagccctanatggagttgagcagcctgaacgaatgaagacacggctgtatattactgtagacgaggagggaaatggacctccgaaccgacgggcccagtccggtccttccccgtaggccaccctccgtcaaccgg

SEQ ID NO: 292829 - DNA, 611 bp, Homo sapiens
  misc_feature: GYAE6OF01AVTMN.52.67.G01.1.454.CMB.1.raw
tcagcgcagtacgacacgaccggtgctcgatttagagtatacatattgggtttgggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagccgtggggcctcgagtgaaggtttcctgcaaggcctcgtggatacaccttcgagtgacaatactttgcattgggtgcgccaggcccccggacaagggtcttcggtttggaagtggggatggattcgaacggtctggcaagtggtaacacgaaaatattcaacagattccgaggcagacgtcacatcaacgagggacacactccgagacgcacacgacctacatggaattgacgtgacgcctaggaagaaactgaaagacgacgtacgtagttaatacgtttactaggttagaccggtaaggaagggaaacgtcgggaccgtacccgaacccgaacggggtccccaacggttcccggtacccgttcccccggtacggtaccccgacccctttcccgcccgtaaacccgg

SEQ ID NO: 292830 - DNA, 782 bp, Homo sapiens
  misc_feature: GYAE6OF01BBFE4.52.67.G01.1.454.CMB.1.raw
tcagcgcagtacgacacgaccggtgctcgatttagagtatacatattgggtttggggacccaacaaccacatccctcctcagaagccccagagcacaacgcctcaccatggactggacctggaggatcctctttttggtgggcagcagccacgaggtggccactcccaggtccagcttgtgcagtcgtggggctgaggtgaagagccgtggggcctcagtgtaaggtttcctgcgaaggcctgtggactacaccttcgagtagacctaattactttgactagttgggtgccgaccggacggccccccggaagtaacggggtcctttggtttaggagttgggattcggacgtacgaacggcgtagggactaaagttcggtaaaacaactaaaaattacgtaccgaaacgtaaggaacgtttaccggaagggtccaaggacgttaccaacctaactacgaacggaacgggaaccacgaacgtcccgagacgaccacgtacgacccgtacgacgtacgggagttaggacgtaccaacggtccgtaaggaagaaacgtagggaaacggaccgtacggggtaccttaagttaagttaaccgttttaacggtcgggtaaggtaaccggggtaaaggtaacgggggttaaaacgtccgggtaaacccccgttaccggaaaccccgggtaacggggtacccccttaaccgggtttaccccgttaccccggttaccccccggttacccgggaaccccttacccccgtacccggttacccggtaaaacccgg

SEQ ID NO: 292831 - DNA, 550 bp, Homo sapiens
  misc_feature: GYAE6OF01A6ZNB.52.67.G01.1.454.CMB.1.raw
  modified_base (277)..(277): a, c, t, g, unknown or other
  misc_feature (277)..(277): n is a, c, g, or t
  modified_base (282)..(282): a, c, t, g, unknown or other
  misc_feature (282)..(282): n is a, c, g, or t
  modified_base (429)..(429): a, c, t, g, unknown or other
  misc_feature (429)..(429): n is a, c, g, or t
  modified_base (467)..(467): a, c, t, g, unknown or other
  misc_feature (467)..(467): n is a, c, g, or t
  modified_base (532)..(532): a, c, t, g, unknown or other
  misc_feature (532)..(532): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagccgtggggcctcagtgaaggtttcctgcaaggcctctggatacaccttcagtgacaatactttgcattgggtncgccnggccccggacaagggcttgtttggatgggatggatcaacgctggcaagtggtaaacacaaaatattacaacagtaacgttccgaggcagacgtcaccatcacgaggacacactccgacgagccacacgccctacagtaggagttgancagcctagagaatgaacgacgacggtatgtatattacngtcgacgtagagggtaatcggtcctaccgacgacggcccagtccgtccttacccccgtggacccncccctccgtcgtaaccgg

SEQ ID NO: 292832 - DNA, 565 bp, Homo sapiens
  misc_feature: GYAE6OF01EGSNC.52.67.G01.1.454.CMB.1.raw
  modified_base (291)..(291): a, c, t, g, unknown or other
  misc_feature (291)..(291): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgacaatactttgcattggtgcgccaggcccccgganaagggcttgttggatgggatggatcgaacgctggcaatggtaacacaaaatattacaacagaagttccaggcagagtcacatcacgaggacacatccgcgagcacagacctacagtggagttgacgcagcctagaagaatgaagacgacggctagtattaagttactggtacgagaaggaaggggtaaagtcggacccgtaccgaacccgaacgggtccccaagttcccggttacccttcccccgtacggaccctaccctcccgtccgaaacgg

SEQ ID NO: 292833 - DNA, 736 bp, Homo sapiens
  misc_feature: GYAE6OF01DFREC.52.67.G01.1.454.CMB.1.raw
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctggaggtgaagaagccgtggggcctcgagtgaaggtttcctgcaaggcctcgtggactacaccttcagtgaactaattactttgctagttgggtgccgccgacgggcccccggagaagggtctttggtttggagttgggatggactcgaacgctgggacaagtaggtaaacaactaaaaagtattaccgaacaaggtaacgtttacccgaaggggctaaggacgtaccaaccagttaccgaaccgacgggaaccacgtacgtcccggaccgagaccaacaacggtaccctaacgtacgtagggtacgttacggaagccgtacgcccgttaggaaagaaacgtggaaacgaacgtaccgggtacttaaggttacttaacgttacttgggtacggaacgggtaaacggggtaaacggggtaaaacgttccgggacccttaaccccggaaaccgggtaaacccggggcccctacggtttaccccggttcccccgtttaccccccgagggtccccctaacccccgttcccgtaacccggtaaaaccggg

SEQ ID NO: 292834 - DNA, 813 bp, Homo sapiens
  misc_feature: GYAE6OF01EFJLC.52.67.G01.1.454.CMB.1.raw
  modified_base (255)..(255): a, c, t, g, unknown or other
  misc_feature (255)..(255): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagccgtggggcctcgagtgaaggtttcctgcaaggcctcgtggatacaccttnagtgaacaatactttgcattggtgcgccaggcccccgagaaggtcgttgttggagtgggatggatcgaaacgctggacaagtagggtaaacaaacgtaaaaatacttacaacagtaaaggttcccaaggggtaccaaggtacggttaccaaccgtaacgttaccaaacccgaaggggaccaaccggaacgttcccggacgaacggaccgaacgtaacggccccttaaacgaacggttaccggggtaagtttacgggaacgtaccgaacggtaccccgttaagggaacgtaaaaagttacgggaaaacgtaacccggtaaccggggtactttaccggggtttaaatttaaacgttttacgttacgggtaacggtaccgggtaaaggggtaaacggggggtaaaaacgttccggggaacccccgttaaccggaaacccccggaaaaccggggggtccccctaaaaccgggtttccccgggttaccccccgttttaaccccccggtcgggtaccccccgtaaaccccccgtttcccccgtaaacccggtaaaaaccccggg

SEQ ID NO: 292835 - DNA, 817 bp, Homo sapiens
  misc_feature: GYAE6OF01D7YNY.52.67.G01.1.454.CMB.1.raw
  modified_base (215)..(215): a, c, t, g, unknown or other
  misc_feature (215)..(215): n is a, c, g, or t
tcagcgcagtacgacacgaccggtgctcgatttagagtatacatattgggtttggggacccaacaaccacatcccctcctcagaagcccccagagcacaacgcctcaccatggactggacctggaggatcctcttttggtggcagcagccacaggtggccactcccaggtccagcttgtgcagtctggggctgaggtgaagaagcctggggcctnagtgtaaggtttcctgcaaggcctctggatacaccttcagtgaactaatactttgctagttgggtcgccgccgaccgggccccccggaataacggggtcctttggtttaggacgttaggggatgggactaccgaacggtcgtggacgtaagtacggaaactaacgtaaaattcttacgaacaacggtaaacgttcccggaagggtaccaaggtaacgtccaaccctacgtaccgaaaccgaagggtacccaactaccggtacccgacggacgaccgaaccgaacgtaccccgtaacgtaacgttagggaacggtttggaacgcccgtaacggtcccgttaagggaaaccggtaaaaggttacgggaaaacggaaccggtaaccgggtaccgttaaggggttaactttaacgtttaaccgttacgggtagggtaacccggggtaaaggggtaaacggggtaaacggttaccgggtaccccgttaacccgggaaaccggaacccgggggtacccctaacgggtttacccggttaccccccgtttacccccggttaccggtaccccgtaacccccccgtttcccggtaaccccgtaaaccccggg

SEQ ID NO: 292836 - DNA, 657 bp, Homo sapiens
  misc_feature: GYAE6OF01DXLZY.52.67.G01.1.454.CMB.1.raw
  modified_base (339)..(339): a, c, t, g, unknown or other
  misc_feature (339)..(339): n is a, c, g, or t
tcagcgcagtacgacacgaccggtgctcgatttagagtatacatattgggtttggggacccaacaaccacatccctcctcagaagccccagagcacaacgcctcaccatggactggacctggaggatcctctttttggtggcagcagccacaggtggccactcccaggtccagcttgtgcagtctgggctgaggtgaagagccgtggggcctcgagtgaacggtttcctggacaacggcctctaggactacacctttcagtcgacaattactttgctagttgggtgcgccgacgggcccccggagaagggctttggttggagtgggatggatcgaacgngtggctaagtaggtaaacaacgaaaatacttacaacgaagtaacgttaccgaagggtcaagagtccgacacgtaccaaccggacgggaacacgacgtacccggacgacgacgacaacgacctaacgagttacgggacgttgacgcgacgacctaggaagaagtagaacgacgacggtacttaggtacttagttacgtgtacggacgaagggaaggggtaactccggacccgtaaccgaaccggaacgggtaccccgacgttccgggttacccctttcccccggacgtaccccgtaacccctcccgtaccgtaaaccgg

SEQ ID NO: 292837 - DNA, 764 bp, Homo sapiens
  misc_feature: GYAE6OF01A3H19.52.67.G01.1.454.CMB.1.raw
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggttttcctgcaaggtcctctggatacaccttcagtgacaatactttgctagttgggtgcgccacggcccccggaacaaggtactttgtttacggagttgggatgggatccgaacggctggacctaagtacgggtaaacaacgtaaaattacttacaactaaggaaacgtttccgaacggggacaacggtacggtaccaaccgataccgaaccgaacgggaaccaccgaacgtacccggacgaacgccaacgacgtaccccgtaacgaaccgttgggtacggtttacgggaacgtccgtacgtacccgtaagggtaacgtaaaacgttacgaaaacggtacccgaaccgggtcgttaacgggttaactttaacgtttaaccgtaggttacgttacggggaaacggtaaagggggtaaacgtcccgggtacccgtaccccgaaaccgggaaccgggtacccccgttaagggttccccggttaccctttacccccccgggtaggtacccccctaacccccgtttcccgtaacccggtaaacccgg

SEQ ID NO: 292838 - DNA, 809 bp, Homo sapiens
  misc_feature: GYAE6OF01BNH9X.52.67.G01.1.454.CMB.1.raw
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagccgtgggcctcagtgaaggtttcctgcaaggcctcgtggatacacctttcagtgaacaattacgtttgctagttgggtacgtccgccgaccgggcccccggagaagggtctttaggtttggagtgggatggactcgaacgcgtggactaagtacggtaaacaactaaaaattactacaacaagtaacgttccgaagggacaggtacgtacaaccactaccaaccgaacgggaccaacgtaacgtcccggacggaaccgaccaccgtaaacgccccttaaacgagttacgggtaacgtttacgggacggtaccgtaacgggtacccgtaagggtaaacgaaaacggttagggaaaccggtaaacggtaacccgggtacgtttaacgggtttaaacttttaaggtttaaccgtagggtttaacggaaccggggttaaagggggaaacggggggttaaaacgttccgggggtaaaccccgtaaccccggaaacccgggaaacccggggtccccgtaaacgggttcccccggtttaaccccgtttccccccccgggtacggttaaccccccgtacccccgtttacccccgtaacccggtaaaacccggg

SEQ ID NO: 292839 - DNA, 649 bp, Homo sapiens
  misc_feature: GYAE6OF01ED2QA.52.67.G01.1.454.CMB.1.raw
tcagcgcagtacgacacgaccggtgctcgatttagagtatacatattgggtttggggacccaacaaccacatccctcctcagaagcccccagagcacaacgcctcaccatggactggacctggaggatcctcttttggtggcagcagccacaggtggccactcccaggtccagcttgtgcagtcgtggggctgaggtgaagagccgtggggcctcgagtgaaggtttcctgcaaggcctcgtggactacaccttcgagtgaactaattactttgactagttgggtgccgccgacggccccccggaacgaagggtcctttggtttcggagttggggatgggactcgaacggctggcaagtaggtaaacaactaaaatacttacaacgtagtaaacgttccgaagggcaagacgtaccaaccagtaccaaccgaagggacacacgtccgacgacgccaacgacgccctaacagtagggtagttgagacagccgtagaagaatgaacgacgaacggtctagtaattacttacgtagtacgacggaggtaaggggaaactcgggtaccctaccgaaccggaaccgggccctacggttcccggttaccccgttccccgtacgggacccctacccgttcccgtaccgaaacccgg

SEQ ID NO: 292840 - DNA, 746 bp, Homo sapiens
  misc_feature: GYAE6OF01BMLRW.52.67.G01.1.454.CMB.1.raw
  modified_base (231)..(231): a, c, t, g, unknown or other
  misc_feature (231)..(231): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctcttttggtggcagcagccacaggtggccactcccaggtccagcttgtgcagtcgtggggctgaggtgaagaagccgtggggcctcgagtgaaggtttccngcaaggcctgtggatacaccttcagtcgaacaattacttgctagttgggtgcgcacggccccgagaggtcttgttgagtggatggatcgaacgtcgtcggactaagttacggtaaactaacgtaaaaattcttacaacgtaacgtaacgttaccgagggtaacaggtaacgtaccaaccgtactaccgaaccgacgggaacaacgacgtaccgacgacgacctaacgacgaccctaacgacgtacggtaaggttgaacgcgtaacggacccgtaaggaaacgtaaacgtacgggaaacgaaccgtaacgggtaccgttaaggttaaacgtttaacgtttaacgttagggttaccggaacgggttaaacggggtaaacggggtaaaacgtcccgggtaaccccggtaacccggtaacccgggtaaaccgggtccccgtaacggttaccccggttacccccgttacccccgggtaccgtacccccgtaacccccttcccgtaacccggtaaacccgg

SEQ ID NO: 292841 - DNA, 580 bp, Homo sapiens
  misc_feature: GYAE6OF01DEDLL.52.67.G01.1.454.CMB.1.raw
  modified_base (293)..(293): a, c, t, g, unknown or other
  misc_feature (293)..(293): n is a, c, g, or t
  modified_base (344)..(344): a, c, t, g, unknown or other
  misc_feature (344)..(344): n is a, c, g, or t
  modified_base (350)..(350): a, c, t, g, unknown or other
  misc_feature (350)..(350): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgacaatactttgcattgggtgcgccacggcccccgganaagggctttggtttggatgggatggatcaacgctggacaagtaggaacaanaaaatnttacacaagaacgttaccgagggcaagacgtacaccatacaaccgagggaccactacgtaccggcaggaccaacgacgccctaacgagtacggtagttcgagcagcctaggaagaagtgaacgaacacggtactagtatattactgtgacgagggaggaaatcggacctaccgaccgaacgggccctaagttcccggtccttccccgtagccctaccctcctacgaaccg

SEQ ID NO: 292842 - DNA, 836 bp, Homo sapiens
  misc_feature: GYAE6OF01BIKP4.52.67.G01.1.454.CMB.1.raw
  modified_base (231)..(231): a, c, t, g, unknown or other
  misc_feature (231)..(231): n is a, c, g, or t
  modified_base (255)..(255): a, c, t, g, unknown or other
  misc_feature (255)..(255): n is a, c, g, or t
  modified_base (299)..(299): a, c, t, g, unknown or other
  misc_feature (299)..(299): n is a, c, g, or t
tcagcgcagtacgacacgaccggtgctcgatttagagtatacatattgggtttggggacccaacaaccacatccctcctcagaacgcccccagagcacaacgcctcaccatggactggacctggaggatcctcttttggtggcagcagccacaggtggccactcccaggtccagcttgtgcagtcgtggggctgaggtgaagacgccgtggggcctcagtgaaggtttccngcaaggcctctggataccaccttnagtgacaatactttgctattgggtcgcgccacggcccccggaanaagggtccttggtttggagttgggaatggactacgaacgtcgtgggacaagttacgggtaaacaactaaaaagttctttaccgaaccgtaaggttaaacccgtttaccgaacggggtacgtaacggtaaccgggttaaccaacccggtaacgttaaccccgaaacccggaacgggggaaaccctaaccgtaaccgttaccccggtaacgaaccggaccgaacccgaaccggtaccccttaaaccgaaggttacggggtaaacggtttacgggaacgacccggaaggtaccccgttaaggtaaaccggtaaagtaacgggaaacggtaaccgtaaccgggtacgttaacggttaattaacgtttacccggtagttacgggaacgggtaagggaaacggggtaaacgttacggggtaccccgttacccggaacccggaaacccggggtccccgttaaccggttaccccgggttacccccgttccccccggtacgtaaccccccgtaaccccgttccccgtaaacccggtaaaccccggg

SEQ ID NO: 292843 - DNA, 699 bp, Homo sapiens
  misc_feature: GYAE6OF01CPZGW.52.67.G01.1.454.CMB.1.raw
tcagcgcagtacgacacgaccggtgctcgatttagagtatacatattgggtttggggacccaacaaccacatccctcctcagaagcccccagagcacaacgcctcaccatggactggacctggaggatccttctttttggtggcagcagccacaggtggccactcccaggtccagcttgtgcagtcgtggggctgaggtgaagaacgccgtggggcctcagtgtaaggttttcctgacgaacggtcctgtaggactacctaccttcagtagaactaattacttgactagtttgggtcgccgccgaccggcccccggaagacggtctttggtttggagtgggtagtggatacgaacgtcgtaggactaagtaggtaaacaaacgtaaaatacttacaactaaggtaacgttaccgaaggcaagacgtaccacatccaacgaggacacagtccgcgaacgccaacgacgacctagagtaggagttgacgcaggactagaaagtaatacggaagaccgacgggtactttagttaacttagtttacgtggtacggacgggaagggtaacggggtaaacttccggggaaccctacccggaaacccggaacccggggtcccctaaaccggtttccccggttaccccgttacccccccgggttacggaccccccttaccccccgtccgttaaacccccgtaaacgg

SEQ ID NO: 292844 - DNA, 649 bp, Homo sapiens
  misc_feature: GYAE6OF01ERJKN.52.67.G01.1.454.CMB.1.raw
  modified_base (258)..(258): a, c, t, g, unknown or other
  misc_feature (258)..(258): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagccgtggggcctcagtgaaggtttcctgcaaggcctcgtggatacaccttcagtnacaatactttgcagttgggtgcgccacggccccccggacgaagggctttggtttggagtggggatgggatcgaacgctggctaagtggtaaacaacaaaaattattcaacagtaacgttcgagggcagacgtcaaccatcaccgaggacacactccgacgagaccacacgccctaacgagtcgggtagttgaacgtcacgccgttaggaagtaaacgtggaaacgacgaacgggtcttaagttacttaagtttacgtaggtaggacggagggaacggggtaaagtcccgggacccgtacccgaaaccggtaacggggccccctaaggttccccgggttcccttccccccggtacgggccccctacccccttcccgtacccgtaaacccggg

SEQ ID NO: 292845 - DNA, 941 bp, Homo sapiens
  misc_feature: GYAE6OF01D6CR8.52.67.G01.1.454.CMB.1.raw
  modified_base (229)..(229): a, c, t, g, unknown or other
  misc_feature (229)..(229): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtgccactcccaggtccagcttgtgcagtctggggctgaggtgaagaagccgtggggcctcagtgaaggtttccngcaggcctcgtggatacaccttcagtgacaattactttgctagttcgggtgccggccgacgggccccccggaacgaacggggtccgtttggtttacgggagttcgggggtagttcgggaactaccgaaaccggtcgtagggaaccgtaagttaacgggtaaaacaaaacgtaaaaaacttacgtttaaccgaaacgtaacggtaaacggtttacccggaaggggaccgaaacggtaacggtacccaaacccggtaactacccgaaacccggaaggggaacccaaccgtaacgttacccggaccggaacgacccgtaacgaaccggtacccctaaccgtaaggttcgggtaaacggtttcggggaaaccgacgtaaccggggtaacccgttagggaaaaggttaaaacggtaacggaaacggaaccccgtaaccggggttacggttaagttttaaacgtttaaacccgttttaacggtttaacggggtacggtaaaccgggggtaaacggggttaaaggggggggtaaaaacccgtttacggggtaaccccccccggttaacccggaaaacccccgggttaaaccgggggtaacccccgttaacccgggtttccccccgggttaaacccccgggttttcccccccggttaaccccggggtacccccgtttaaacccccccgtttccccggtaaacccggtaaaacccccgggg

SEQ ID NO: 292846 - DNA, 883 bp, Homo sapiens
  misc_feature: GYAE6OF01DFRJ6.52.67.G01.1.454.CMB.1.raw
  modified_base (139)..(139): a, c, t, g, unknown or other
  misc_feature (139)..(139): n is a, c, g, or t
  modified_base (316)..(316): a, c, t, g, unknown or other
  misc_feature (316)..(316): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctcttttggnggcagcagccacaggtggcccactcccaggtccagcttgtgcagtctggggctgaggtgaagaagccgtgggcctcagtgaaggtttccagcaaggcctcgtaggactacgaccttcgagtgaacaataccttttagcgatttcggggtacgccgaccgagggaccccccccggaanaaacggggtccttttaggttttacggggaacttggggaatttggggaacttaccgaaaccggcttcggggacctaaagtacgggttaaacaaacctaaaaaattcttaacgaaccgaaggtaaacggtttacccgaacggggtactaaacggaacggttccaaacccgtaagttacccgaaacccggaacggggaaaccaaccggtaacgtaaccccgggtaaccgacgggaacctaaccgaacgacccgttaaccgaagttacgggtaagtttacggaacgtaccgtacgacccgttaaggaaacgtaaagttacggaaacggtaaaccgaaccggggtacgtttaaccggttaaagtttaacgtttaaccgttagggttacggaccgggttaaagggaaacggggggtaaacttccggggaacccccgtttaaacccggaaaccccggttaaaccggggtacccccgtaaacggttcccccgggtttaacccccgtttacccccccggaacggggttacccccctaacccccggttacccccgttaacccggtaaaaccccgggg

SEQ ID NO: 292847 - DNA, 568 bp, Homo sapiens
  misc_feature: GYAE6OF01EG5SM.52.67.G01.1.454.CMB.1.raw
  modified_base (229)..(229): a, c, t, g, unknown or other
  misc_feature (229)..(229): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttccngcaaggcctctggatacacctttcagtgacaatactttgctattgggtgcgccacggcccccggacaagggcttggtttggagtgggatggatcaacgctggcaagtggtaacaacgaaaatattacacagtaagttccaggcagagtcacatcacgaggacacatccgacgacgacacacgcctaacagtggagttgacgcagccgtagaagaatagaagacgacggctagtattattcgtgtacgcgaaggagggtaaagtcggaccctaccgaccgaacgggccccagttcccggtacccttcccccgtcggaccccacccctccgcccgtaacgg

SEQ ID NO: 292848 - DNA, 778 bp, Homo sapiens
  misc_feature: GYAE6OF01CFOEA.52.67.G01.1.454.CMB.1.raw
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccaatcccaggtccagcttgtgcagtcgtggggctggaggtgaagaagcctggggcctcagtgaaggtttcctgcaggcctctggatacaccttcagtgacaatactttagctagttgggtgcgccgacggcccccggagaagggtcttggtttggagtgggatgggatcgacgcgtcggacaagtaggtaacaactaaaattactacaacgaagaacgttccgaaggactaagacgtccaacgtactaccgaaccggaggaaccacgtacgtcccggacggaacgacctaaccggacgtacccctaacgtacggttagggtaacggtttacgggaacggtaccgaacggtaccgttaacgggaaacggtaaaacgttacgggaaaacggtaaccgtaaccggggtaaccgtttagggtttaaactttaaccggtttaaccgtagggttaggtaaccgggtaaaggggtaaacgggggtaaaacgttccggggtaacccctaccccggtaaaccgggaaaacccggggtccccgttaaccgttccccggggttacccccttaccccccgggttcggtaaccccccgtaccccctttaccccggaacccgtaaacccgggg

SEQ ID NO: 292849 - DNA, 762 bp, Homo sapiens
  misc_feature: GYAE6OF01B643O.52.67.G01.1.454.CMB.1.raw
tcagcgcagtacgacacgaccggtgctcgatttagagtatacatattgggtttgggacccaacaaccacatccctcctcagaagcccccagagcacaacgcctcaccatggactggacctggaggatcctctttttggtggcagcagccacaggtggccactcccaggtccagcttgtgcagtctggggctggaggtgaagaagccgtggggccctgagtgaaggtttcctgcgaaggcctcgtaggactacgaccttgagtagactaattacgtttgcgtagttcgggtgccgaccgtaccggacccccggagaacgggtctttggtttaggagtgggtagtcggatacgaacgcgagtacaaagtacggtaaacaataaaattagttaccaagtaacgtaagttaccggaaggtaacaacggtaaactaaaccgatacccgaaccgaaggaccacgtaccgtaccgaacgacgaccctaacgaacggtacctaacgtaggtaacgggtagttagacgtcgtaacggacctaaggaacgtaaagtaacgggaaccgtaaccgacggtaacttacggttaactttaacgttacggtacgggtacgtaacgggaaacgggggttaaacgggaaacgttcccgggtaaccccgtaacccgaacccgggtaaacccgggccctaacccgggtttcccccggttaccccgtcccccggttaccgggacccccttaccccgttacccgaaccgtaaccggtaacccg

SEQ ID NO: 292850 - DNA, 775 bp, Homo sapiens
  misc_feature: GYAE6OF01BODIG.52.67.G01.1.454.CMB.1.raw
tcagcgcagtacgacacgaccggtgctcgatttagagtatacatattgggtttggggacccaacaaccacatccctcctcagaagccccagagcacaacgcctcaccatggactggacctggaggatcctctttttggtggcagcagccacaggtggccactcccaggtccagcttgtgcagtctggggctgaggtgaagaagcctggggcctcgagtgaaggtttcctggcaaggcctcgtggatacaccttcagtgacaatactttgctattgggtgcgccgacggcccccggacaagggccttgtttggagtcgggatggatcgaacgcgtggacaagtacgggtaaacaacctaaaaagttattaccaaacgtaacggtaaacgtttccccgaaggggaccaaacgggtaacggttaccaaccctaagttacccgaaacccggtaacggggtaacccaaccgtaccgttacccgggaccggaacgaccgaacaaccggtacccctaaccgtaagtacgggtaacggtttacggacgtacgtacgacccgtaggaaacgtaaagtacggaaacggtaacccgaacgggtaccgtttaaggtaacgtttaacgttaaccggttaggttacggaacggtaaggggtaacggggtaaacgttcgggtaccccgtaccggaacccggaaaccggggtcccctaacggttccccgggttacccttccccccggtacggtacccccgtaccccgttccccgtaacccggtaaacccgg

SEQ ID NO: 292851 - DNA, 828 bp, Homo sapiens
  misc_feature: GYAE6OF01BF3G5.52.67.G01.1.454.CMB.1.raw
  modified_base (140)..(140): a, c, t, g, unknown or other
  misc_feature (140)..(140): n is a, c, g, or t
  modified_base (229)..(229): a, c, t, g, unknown or other
  misc_feature (229)..(229): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggnggcagcagccacaggtgccactcccaggtccagcttgtgcagtcgtgggctggaggtgaagacgcgtgggcctgagtgtaaggtttccngacaaggcctctggactacacttcagtgactaatactttgctagttgggtcgcgaccgacggaccccccggagaacggggtcctttagggtttcggaaggttgggattgggacttaccgaaacggtcgttagggactaaagttagggtaaaccaaactaaaaacgttactttaccgaacgtaaggtaaaccggtttaccgaacggggacgtaaacggtaacggttaccaaacccgtaagttaaccccgaaaccggtaacggggaaaccctaaccgtaccggttaccccggaccggtaacgaccgtaaacccggtacggtaacccctaaacgtaggttacggggtaagtttacgggaacggtacgtacggtaccccgtagggaaacgtaaaacggtaggtaaacgaaccgtaaccgggtcgttaagggttaaacttaacgtttacgtacgggtaggaaccgggtaaggggaaacgggtaacggtacccggtacccgtaccggtaacccggaacgggtacccccgtacggttacccggtaccccgtttacccccggtaccggaccccgttaacccccgttccccgtaaccggtaaacccgg

SEQ ID NO: 292852 - DNA, 708 bp, Homo sapiens
  misc_feature: GYAE6OF01DVUIR.52.67.G01.1.454.CMB.1.raw
  modified_base (280)..(280): a, c, t, g, unknown or other
  misc_feature (280)..(280): n is a, c, g, or t
  modified_base (297)..(297): a, c, t, g, unknown or other
  misc_feature (297)..(297): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtcgtggggctgaggtgaagaagccgtggggcctcagtgaaggtttcctgacaaggcctcgtggatacaccttcagtgacaatacttgctattgggtncgccacggcccccgganacgggcttggttggagtgggatggatcgaacgcgtggacaagtggtaacaacgtaaaatgttaccagaacggtaaagttccgagggtcaggacgtccaaccgatccgaaccgaagggaccaacgtatcccggagacgaccaacgacgtaccctaacgagtacgggagttacggagccgaacgtccgtaggaagaaacgtaggtaaacgaaccgtacggtacgttagttaacgttaacgtttaaccgttggtacggtaacgggtaaagggaaacgggggtaaacgttccgggaaccccgttacccggaaacccggtaacccggggtaccccgtaaaccggttccccgggttcccctttaacccccccggtcgggaccccctaaccccccgttcccgtacccgaaaacccggg

SEQ ID NO: 292853 - DNA, 769 bp, Homo sapiens
  misc_feature: GYAE6OF01DMCFI.52.67.G01.1.454.CMB.1.raw
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtcgtggggctggaggtgaagaagccgtggggcctcagtgaaggtttcctgcaaggcctcgtgatacaccttcagtagactaattactttgctagttggggtgccgccacgggccccccggagtaacgggtctttggtttgggagtgggtaagtggactcaacggtcgtcggactaagtagggtaaaaccaaacgtaaaaacttaatttaccgaaacgtaaggtaaaacggtttaccgaaggggtacaaggaacggttaccaaacccattacccgaaccgaacgggaaccaacctacgtacccggacacggacaacgtaacgtacccctaacgtaagtgggtacgttagggaacgtcgacgacccgtaggaaagaaagtacggaaacgaaccgtaacgggtacttaggttaattacgtttaaccttggggttaggaccgggtaaaagggaacgggggtaaacttaccgggaccccgttaacccgaaaccccgggaaaccgggtccccgtaacggttccccggttacccccgtttccccccgtacgggtaccccccctaccccgttaacccgtaccccgaaaaccggg

SEQ ID NO: 292854 - DNA, 740 bp, Homo sapiens
  misc_feature: GYAE6OF01BA576.52.67.G01.1.454.CMB.1.raw
  modified_base (140)..(140): a, c, t, g, unknown or other
  misc_feature (140)..(140): n is a, c, g, or t
  modified_base (231)..(231): a, c, t, g, unknown or other
  misc_feature (231)..(231): n is a, c, g, or t
  modified_base (519)..(519): a, c, t, g, unknown or other
  misc_feature (519)..(519): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggnggcagcagccacaggtggccactcccaggtccagtcttgtgcagtctggggctaggaggtgaagagccgtgggctcagtgtacggtttccngcaaggcctgtggactacaccttcagtgaacaattactttgctagttgggtagtccgccgaccgggtacccccggacgtaacggggtccgtttggtttgggacggttggggtagtacgggactaccgaacggtccgtaggaccgtaagtacgggtaaacctaaacgtaaaattacgttaacaaacgtaaggtaaacgttacccgaagggaccaaggtaacgtaccgaaccactaccgaacggaacggacaccacgtaccggacgacgaccgaccacggaccctaacgngttacgggagttacggacgtaccgacgtacgagaagaacgtaggaacacggtacggtacgttacgtaagttacgttacgtaggtcggaacggtaagggaacgggtaaacgtacgggtaccccgttaaccggaacccggaaccgggtccctaaccggttcccgtcccccgtttaccccggtacccggtacccgtaccccgttccccgtacccgtaaacccgg

SEQ ID NO: 292855 - DNA, 590 bp, Homo sapiens
  misc_feature: GYAE6OF01DP1W8.52.67.G01.1.454.CMB.1.raw
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtcgtggggctgaggtgaagaagccgtggggcctcagtgaaggtttcctgacaaggcctcgtggatacaccttcagtgacaatactttgcagttgggtgcgccgacggcccccggagaaggtcttgttggagtgggatggatcgacgctggacaagtaggtaacaataaatatacagagaacgttccgaggcagagtacaacagtacaccgaggacacacgtaccgacgacgacaacgacgacctagagtggagttgagcgagcgtagaagtaagtagaagacaggtacttagtattatcgtgtacggaggaggaacggggaaactcggacccgtaccgaacgtaacgggccctaacggttcccggtacccttccccggacgtccctacccctccgaccgtaaaccgg

SEQ ID NO: 292856 - DNA, 889 bp, Homo sapiens
  misc_feature: GYAE6OF01CMFSW.52.67.G01.1.454.CMB.1.raw
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctgggcctcagtgaaggtttcctgcaaggcctcgtggatacaccttcagtgaacaattactttgctatttggggtgccgtaccgacgggaccccccggaacgtaacggggtcgtttcggtttggaagtcggggtatgggataccgaacgcgtaggtacaaagttaggtaaaccaaacgtaaaattattaccgaactaaggtaaaacgtttccgaaggggtccaaaggtacgtaccgaaacccgacttaacccgaacccgaacggggtaaacccaacgtaccgtacccgaccggtaacggaaccaaccggaccggtacccttaaaccgaagttacggggtaaggtttcggaacgtaccgaacggtacccgtaaggaaacgtaaacgtaagggaaacggtaacccgtaaccggggttaccttaacgggttaaacgtttaaacgttttaaaccggtacgggtttaccgggaaacggggttaaacggggtaaaaacggggggttaaaaccggtacccgggtaacccccgggtttaaccccgggaaaacccccggggttaaaccggggaacccccccgttaaacgggttttaaccccccgggttaccccccgttttacccccccggtacccggggtaccccccttaaacccccccggttacccccgtaaccccggttaaaaaccccggg

SEQ ID NO: 292857 - DNA, 735 bp, Homo sapiens
  misc_feature: GYAE6OF01BLUSD.52.67.G01.1.454.CMB.1.raw
tcagcgcagtacgacacgaccggtgctcgatttagagtatacatattgggtttggggacccaacaaccacatccctcctcagaagcccccagagcacaacgcctcaccatggactggacctggaggatccttctttttggtggcagcagccacaggtggccactcccaggtccagcttgtgcagtcgtggggctggaggtgaaggaagccgtggggcctcgagtgaaggtttcctgcgaaggcctcgtggactaccacctttcagtgacaatactttgctagttggtgcgccgacggcccccggacgacgggtcttggttggagtgggatggactcgaacggctggactaagtacggtaaaacaacgtaaaactatttaccaacgtaaggtaaacgttccgaagggtccaaggacgtccaacgtactccgaaccggagggtaaccactaccgtcccggacggaacgtaccgaccgaacgaccctaacgtaggttacggaacggtttggaaccggtacgtaacggtccccggttaaagggaacgtaaacgtacgggaaaacgggaacccgtaacggggtactttaacggttaaagtttaaccgtttacggtaggtacggtacggaaggggtaacggggtaaacgtccggttacccgaccgtaacccggaacggggcccttaaggtccccggttacccgttccccgaccggtacccaccccttcccgacggtaaccg

SEQ ID NO: 292858 - DNA, 847 bp, Homo sapiens
  misc_feature: GYAE6OF01AMWJ9.52.67.G01.1.454.CMB.1.raw
tcagcgcagtacgacacgaccggtgctcgatttagagtatacatattgggtttggggacccaacaaccacatccctcctcagaagccccagagcacaacgcctcaccatggactggacctggaggatcctctttttggtggcagcagccacaggtggccactcccaggtccagcttgtgcagtctgggctgaggtgaagaagccgtggggcctcgagtgaacggtttcctgcgaacggcctcgtggacttaaccaccttacgagttcgaacaacttacctttgacgtagtttggggtcgccggtcccgaacggggaccccccggaacggtaacggggtccttttagggtttcgggagttcggggataggtacgtaccgaacggtcgtcgggactaacggtacggtaaaacctaaactaaaagttacctttaccgaactaaggtaaaccgtttacccggaagggggtacaaaccgggtacgttaacccaaccccgtaacgtacccgaacccggaacgggaaccctaccgaaccgtcccgacgtaccggacctaacccgaacgtacccgtaacgtagttaacggtaggtttacgaaccgtcgtaaccggtccgtaagggtaacgtaagtaacggaacggaacccgacggtacgttaaggttaacgtttaacgtttaacggtcggtaacgggtacgggtaaaggggtaacgggtaaacgggttacccgacccgttaacccggaaacccggtaaccgggaccccctttaccgggttccccggttaccccccggttcccccggtacccggtacccccgttacccccgttaaccccgtcccggtaaacccggg

SEQ ID NO: 292859 - DNA, 709 bp, Homo sapiens
  misc_feature: GYAE6OF01BFBMQ.52.67.G01.1.454.CMB.1.raw
  modified_base (240)..(240): a, c, t, g, unknown or other
  misc_feature (240)..(240): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagccgtggggcctcagtgaaggtttcctgcaaggcctntggatacaccttcagtgacaatactttgctagttgggtcgcgccgaccggcccccggacgaacggggtctttggtttggagtcgggtagtggactcgaacgtcgtaggactaagtaggtaaacaactaaaatacttacaacgtaagtaaacgttaccgaagggtacaacggtacgtaccaactacgtaccgaaccggacgggaacacgacgtcccggacgacgaccaacgaacgtacccgtaactagtacgggtaacgttacggaagtccgaacggtaccgtaacggtaaagaaacgtaaggaacgaacgtacgggtacttagttaacttacgttacgtaggtacggaacggtaagggtaagggtaaacgtcggtacccgtaccggaacccggaacgggtccccgtaacggttcccggttacccgttcccccggtacgacccctaccccgtcccgtaaccgtaacccgg

SEQ ID NO: 292860 - DNA, 902 bp, Homo sapiens
  misc_feature: GYAE6OF01DKTAO.52.67.G01.1.454.CMB.1.raw
tcagcgcagtacgacacgaccggtgctcgatttagagtatacatattgggtttggggacccaacaaccacatccctcctcagaacgcccccagagcacaacgcctcaccatggactggacctggaggatccttctttttggtggcagcagccacgaggtggccacctcccaggtccagcttgtgcagtcgtggggctggaggtagaagaggccgtggggcctcgaggtggtaacggtttcctgacgaacggtccttacgtaggtactaaccgtaccttacgagtacgaactaacttacgtttgacgtaggttcgggtcgccggccgacccgggacccccggagaacggggtcgtttgggtttggagtgggatggaactccgaacggtcgtaggactaagtacggtaaacaaagtaaattactacgaacgtaagtaacgttaccggaagggacaaggtaccgtacaaccgaactacccgaacggacggtaaccacgtaccgtacccgaacgacgacccgtaacgaccgtaacccgtaaggtaacggttgggtaacgtacgggaccgacgtaccgggtactaaagggaaaaggttaaacgtaacgggaaacggaaccgggtaccggttactttaaacgggtttaacgttaaaccgttgggttacgggaacgggtaacgggggtaaaacgggtaaacggggggttaaaccgttcccccggggtaacccccgggttaaaccccggaaacccggggttaaacccccgggggtcccccttttaaaccgggggtttcccccccggtttaaccccccccggggttttaccccccggttaaccccggggttaaccccccccttaaaccccccggggttccccccgtaaaacggggttaaacccccccgggg

SEQ ID NO: 292861 - DNA, 688 bp, Homo sapiens
  misc_feature: GYAE6OF01A1YBS.52.67.G01.1.454.CMB.1.raw
  modified_base (132)..(132): a, c, t, g, unknown or other
  misc_feature (132)..(132): n is a, c, g, or t
  modified_base (211)..(211): a, c, t, g, unknown or other
  misc_feature (211)..(211): n is a, c, g, or t
  modified_base (223)..(223): a, c, t, g, unknown or other
  misc_feature (223)..(223): n is a, c, g, or t
  modified_base (244)..(244): a, c, t, g, unknown or other
  misc_feature (244)..(244): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctnttttggtggcagcagccacaggtggccactcccaggtccagcttgtgcagtctgggctgaggtgaagagcgtgggcctnagtgagtttccngcaggctctggactacacttnagtgacaattacttgctagttgggtcgcgccgtacgggcccccggacgtaacgggtccgtttggtttcgggaagtgggtaagtcggtagtccgtaacgccgttaggaccgtaagtacgggtaaactaacgtaaaacttcgttaaccaacgaagtaaacgttcgaagggaccgtaagtaacggtaccaacctacgtaccgaaccggtaacgggaactaacgtacgttaccggaccgacgaccgacacgtaccctaacgtagtacggtaagttcgaacggtaccagtacgtagtaacgaagtaacgaacgacgtaccgtagtacgtaatattaccgtagtacggacgagggtaacggaaagttccggaccgtaccgtaaccgaacgggtccctacggtaccggtcccgttaccccgcgtaccctacccgtaccgtacgtaacccgg

SEQ ID NO: 292862 - DNA, 780 bp, Homo sapiens
  misc_feature: GYAE6OF01CHMN3.52.67.G01.1.454.CMB.1.raw
  modified_base (140)..(140): a, c, t, g, unknown or other
  misc_feature (140)..(140): n is a, c, g, or t
  modified_base (225)..(225): a, c, t, g, unknown or other
  misc_feature (225)..(225): n is a, c, g, or t
  modified_base (232)..(232): a, c, t, g, unknown or other
  misc_feature (232)..(232): n is a, c, g, or t
  modified_base (238)..(238): a, c, t, g, unknown or other
  misc_feature (238)..(238): n is a, c, g, or t
  modified_base (241)..(241): a, c, t, g, unknown or other
  misc_feature (241)..(241): n is a, c, g, or t
  modified_base (245)..(245): a, c, t, g, unknown or other
  misc_feature (245)..(245): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggnggcagcagccacaggtggccactcccaggtccagcttgtgcagtctgggctgaggtgaagagcctgggcctcagtgaagtttccngcagctngatacnctnagtnacaatactttgctattgggtgcgccacggcccccggacaagggtccttggtttggagtgggactggatacgaacgtcgtggactaagtacgggtaacaaacctaaaaagtacttaccaaactaaggtaaacgtttacccggaaaggggtccaaacgggtacgtttacccgaaacccaagttaaccccgaaacccggaacgggggaaccctaacccggtaacgtccccgggaccggaaacggaccgaaccaaccgggtaccccttaacaacggttaggggtaacgtttagggaaccggtacgacggacctaggtaaacggaaacttaaggaacggaacgtaacccggtagttacgttaaagtttacttaaccgttggtacgggaacgggaacgggtaaggggtaaacgtacggggtaaccccgttaccccgaacccgggtaaaccgggtccccgtaaacggttcccccggttaccccggtttaccccccggacggtacccccttaccccccgttacccgtacccgtaaaacccggg

SEQ ID NO: 292863 - DNA, 715 bp, Homo sapiens
  misc_feature: GYAE6OF01EUADC.52.67.G01.1.454.CMB.1.raw
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagccgtggggcctgagtgtaggtttcctgcgaacggcctcgtggactaccaccttcgagtgactaattactttgctagttgggtgccgaccgaccgggcccccggaaggaacgggtcgtttgggtttaggagtgggacgtggactacgaacgcgtaggactaagttacggtaaacaaagtaaaattacttaccaacgaaggtaaacgttaccgaaggggtacaaaggaacgtacccaacgtaactaccgaaccggaagggaccctaacgacgtcccgacgacgaccacgaacgtccctaacagtcgggtagttacggagaccgtacgccgtaggaacgtaagtagaacgacgacggtacgttaagttaattaacgttacgtaggtacggaaggaagggaaggggtaaaccgtccggacccgttacccgaaccggtaaccgggacccgttaccggttaccccggttaccccttcccccggacggaccccctcccccgtacgtacccgaaaccgg

SEQ ID NO: 292864 - DNA, 770 bp, Homo sapiens
  misc_feature: GYAE6OF01COMFO.52.67.G01.1.454.CMB.1.raw
  modified_base (141)..(141): a, c, t, g, unknown or other
  misc_feature (141)..(141): n is a, c, g, or t
  modified_base (523)..(523): a, c, t, g, unknown or other
  misc_feature (523)..(523): n is a, c, g, or t
tcagcgcagtacgacacgaccggtgctcgatttagagtatacatattggggtttggggacccaacaaccacatccctcctcagaacgccccagagcacaacgcctcaccatggactggacctggaggatcctctttttggnggcagccagccacgaggtggaccactcccaggtccagcttgtgcaggtcgtggggctaggaggtgaagaacgtccgtcggggcctcgaggtgtaacggtttcctaggaccgaaggcctacgtaggacttaacgccttacgagtcgaaactacgttacttgctagttgggtcgccgaccgaccggtcccccgaagtacgggtctttaggttggacgttagggtactcggggaactccgaacggtccgttggaaccttaaggtaacggtaacctaaacaaaaacgtttgttacccaacggtaacggtaacgttcccggaaagggcgaaacggtactaccgaaccgtactacccgaaaccggacgggtacaaccgcgtaccccgnggaacgtaccgaacgtcggtacccttaacgaacgttagggtacgttacggagtacctaacgggtctagtaaagtaacgtaggaacgaccgtacggtacgtagtaattacgttactagggtaccgacgggtaaaggggtaacgggaccgtacgggtaccctaacccggggtaacccgtaacggtccccgtaacggttccccgtttaccggttccccgagtcccccgaaccgtttcccgaaacgtaccg

SEQ ID NO: 292865 - DNA, 694 bp, Homo sapiens
  misc_feature: GYAE6OF01B79YG.52.67.G01.1.454.CMB.1.raw
  modified_base (231)..(231): a, c, t, g, unknown or other
  misc_feature (231)..(231): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtgccactcccaggtccagcttgtgcagtctggggctggaggtgaagagccgtggggcctcgagtgtaaggtttccngcaaggccctcgtggactaccacctttcaggtagactaattactttgactagttgggtcgcgccgacggcccccggagaagggtcttggtttggagtgggactggactacgaacgtcgtggactaatacgggtaaacaactaaaaattgtaccaagtacgtaacgttccggaaggtactaggacgtaccaacgtataccgaccgagggaccagaccgtaccgcgacgaccgacgacgtaccgtaacgacggtaggtaagttcgaagtaccgagaccgtagaaacggtaaactagggaacgaacgtaccggtcgttaagttaaccgttaattacgtaggtacggaaggtaagggaacggggtaaatccgggacccgtaaccgaacccggaaccggtacccgtacggttccccggttacccgttccccggtaccggcccctaccccggtccctaccggtaaaccg

SEQ ID NO: 292866 - DNA, 734 bp, Homo sapiens
  misc_feature: GYAE6OF01C9BM0.52.67.G01.1.454.CMB.1.raw
  modified_base (243)..(243): a, c, t, g, unknown or other
  misc_feature (243)..(243): n is a, c, g, or t
  modified_base (255)..(255): a, c, t, g, unknown or other
  misc_feature (255)..(255): n is a, c, g, or t
  modified_base (262)..(262): a, c, t, g, unknown or other
  misc_feature (262)..(262): n is a, c, g, or t
  modified_base (281)..(281): a, c, t, g, unknown or other
  misc_feature (281)..(281): n is a, c, g, or t
tcagcgcagtacgacacgaccggtgctcgatttagagtatacatattgggtttggggacccaacaaccacatccctcctcagaacgcccccagagcacaacgcctcaccatggactggacctggaggatccttcgtttttggtggcagcacgccacgaggtcgcccacctcccgaggtccagtcttgtgaccgtagtcgtgggctggaggtagaacgagccgtgggcctcgagtgtacgttcngacgacgctcgngactacnctcgagcgaatattcgttngtagttggcgcgaccgccggaccccggagtacggtctttggttacggagtagggtacgtacggaacgtacgacgtcgtagggactaaagtaacggaaaaccaaagtaaacttactacgaaacgtaacgttacggtaccggagggaccaagtaccgtaccaacgtaacgaccgaaacggaacggaacaaccgtccgtacccggacgacgacctaaccggaccgtaccgtaacgtaggttacggtacggtacgacgtaccgacgtagaagtaacgaagtacgaacgtacgaacgttctaagttactaacggttgtacgggaggtacggaaagggttaacggacctacccggaacccgttaacccggaaccgggtaccggtacccgttccggttacccccggttcccgtacccccggtaccgaccccgttaaccccgttcccggaacccggtaccg

SEQ ID NO: 292867 - DNA, 743 bp, Homo sapiens
  misc_feature: GYAE6OF01AI7PH.52.67.G01.1.454.CMB.1.raw
  modified_base (255)..(255): a, c, t, g, unknown or other
  misc_feature (255)..(255): n is a, c, g, or t
  modified_base (718)..(718): a, c, t, g, unknown or other
  misc_feature (718)..(718): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtcgaagaagcctggggcctcagtgaaggtttcctgcaagctctgatacacttcagtganaatacttgcatggtgcgtccgacggtcccccggacgaagggtacttgtttacggagtggatacggagtacgtaacgtcgtggacgtaagtacgggtaaaacctaacgaaaaacttaactttacaaaccgtaacgtaaaacggtttacccgaaggggtaccgtaacggtaacggtaccctaaccgaaacctaccgaaaccccggaacgggaaaccgaacgtaccgtacccgacggtaacgacccgaacgaaccggaaccccttaaccgtaacgttagggtaaggttacgaaggacacggaccgttagaacgtaaagtacggaaacgtaaccgacgggcgttacggtaacttaacgttacgttacggtacggacggtaagggaacgggtaaaagtcggtacccgtaccaaccggaacggccccgtaccgttaccgggttcccttacccccggtaccggtaacccnccccgttaccctcccgtaaacccgg

SEQ ID NO: 292868 - DNA, 761 bp, Homo sapiens
  misc_feature: GYAE6OF01DB3A7.52.67.G01.1.454.CMB.1.raw
  modified_base (248)..(248): a, c, t, g, unknown or other
  misc_feature (248)..(248): n is a, c, g, or t
  modified_base (418)..(418): a, c, t, g, unknown or other
  misc_feature (418)..(418): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatccttctttttggtggcagcagccacaggtggccactcccaggtccagcttgtgcagtcgtggggctggaggtagaacgaaggccgttgggggcctacgaggttaggtaagggttttcccnggaccgaaggtcccttacgtaggactacctacctttcgaagtcgaactaaatttaccgtttagcgtaaggtttcggggtcggtacccgcccggaaccggggaccccccgggtaaggaacgggttccgttttgggtttaggaggtagggtagttcgggactacgaaccggngtacggtacgaaagttacgaaacctaaataaaatattaccaagtaacgtaacgtacgaagggtcgaagaccgtacaaccacgtaccgaaccggaggaaaccacgtacgacccggtacgagtaccaacgaccgtcctaacgaggttacggagttacggacgacgaacgtaccgaggaaagaacgtaagaacggtaacacgggtactagttaacttagttagttggacgaacgggtaaggtaaggacgtcggacccctaaccgggacccgtaaccggggccctacggttcccggttccccgttacccccgacggtaccccctccccgtccgtaacccggaaccgg

SEQ ID NO: 292869 - DNA, 774 bp, Homo sapiens
  misc_feature: GYAE6OF01CKB8N.52.67.G01.1.454.CMB.1.raw
  modified_base (231)..(231): a, c, t, g, unknown or other
  misc_feature (231)..(231): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctggaggtgaagaagccgtggggcctcagtgaaggtttccngcaaggcctcgtggatacaccttcgagtagactaattacgtttgctagttgggtgcgccgacggcccccggagaacgggtcttggtttaggagtcgggagtcggatacgaacggtcgtaggtaccaagtacgggtaaaccaaacgtaaaaagttactttaaccgaacgtaaacggtaaacggtttacccgaaggggtacaacggtaacgtaaccaaccgtaactaccgaaacccgtacgggaaccaaccgtacgtacccggacgtacggaccaacgaccgtaaccctacgaacgtaggtacggttacggacgaccgtacgacccgttaaggaaacgtaaacgtaggaaacggaccgtaaccggtacgttaacgttaattaacgtttacgtgggttacggaacgggtaaggggtaacgggtaaacgttccgggtacccgtaacccggtaacccgggaaccgggttcccgtaacggttccccgggttaccccgttccccggttaccgggacccctaccccgttccccgtaacggtaaaccccggg

SEQ ID NO: 292870 - DNA, 787 bp, Homo sapiens
  misc_feature: GYAE6OF01BSG2C.52.67.G01.1.454.CMB.1.raw
  modified_base (183)..(183): a, c, t, g, unknown or other
  misc_feature (183)..(183): n is a, c, g, or t
tcagcgcagtacgacacgaccggtgctcgatttagagtatacatattgggtttggggacccaacaaccacatccctcctcagaacgcccccagagcacaacgcctcaccatggactggacctggaggatccttcgtttttggtggcagcagccacgaggtggccactcccaggtccagcttgngcagtctggggctggaggtgaaggagccgtgggcctgagtagtaaggtttccaggacgaacggtcctcgtaggacttaaccacctttagagtacgaactaagtttaccgtttgaccgtagtttcggggtacgccggtacccggtaacccggggaccccccgggtaagtaaacgggggttcccgttttaggggttttacgggggaaggttagggggtaaagttacgggaacgtttaaccgaaaccgggtcgtacggggaacttaaacgggtacggttaaaaccaaaacgtaaaagtttacttaaccgaaacgtaaacggtaaacgttacccgaaggggtacaacggaacgttacaacccgtacgtaccgaacggaacgggaccactacgtaccgacgacgaacacgacgtacctaacgagtaggtagttacggagagaccgtacgtaggaacgtaaagtcggaacgaacgtaggacgtagttaagtagtttacgtaggagtacggaagggtaaggaacgtacggtaccgaacccgtacggaacggtccctacgttcccggtacccttccccggtacggtacccctacccttccgtaccgtaacgg

SEQ ID NO: 292871 - DNA, 854 bp, Homo sapiens
  misc_feature: GYAE6OF01AY88D.52.67.G01.1.454.CMB.1.raw
  modified_base (655)..(655): a, c, t, g, unknown or other
  misc_feature (655)..(655): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctcttttggtggcagcagccacaggtggccactcccaggtccagtcttgtgcagtcgtggggctgaggtgaagagccgtggggcctcgagtgtaaggtttcctgacgtaacggtcctcgtaggactacctaccgtttcagtacgaacctaagttactttgaccgttagttggggtacgccggacccggtaccgggggaccccccgtaacggtaacggggttccttttaggggtttacgggaggtttacggggacggttcggggaactaccggtaacggtccggtacggtaacgtaagttacgggtaaaaaccaaacttaaaaacgttacttaaccgaaacgtaacgtaaacggttcccgaaacggggacgaaggtaaccggtacaacctaacgtcccgaaaccggtacggtaccaacgtaccgtacccggaccgaacgtacccgaacgtaaccgtacccgtaacgaacggttacgggtactttacgggaacgtaccgacggtacccttaggaaacgtaaacggtanaaaccgggtacgaccggtacgtaaggttaacgttattaccgtaggtaaccggtaggaacggggtaacgggtaagtcccggggaaacccgttacccgaacccggtaacccggggccccttaaaccgggttccccgttacccccggtacccccggttaccggtcccccttaccccggttacccgtaacccgtaaacccggg

SEQ ID NO: 292872 - DNA, 775 bp, Homo sapiens
  misc_feature: GYAE6OF01CVZ2P.52.67.G01.1.454.CMB.1.raw
  modified_base (174)..(174): a, c, t, g, unknown or other
  misc_feature (174)..(174): n is a, c, g, or t
  modified_base (228)..(228): a, c, t, g, unknown or other
  misc_feature (228)..(228): n is a, c, g, or t
  modified_base (482)..(482): a, c, t, g, unknown or other
  misc_feature (482)..(482): n is a, c, g, or t
  modified_base (488)..(488): a, c, t, g, unknown or other
  misc_feature (488)..(488): n is a, c, g, or t
tcagcgcagtacgacacgaccggtgctcgatttagagtatacatattgggtttggggacccaacaaccacatccctcctcagaacgcccccagagcaacaacgcctcaccatggactggacctggaggatcctcgtttttggtggcagcagccacaggtgccactccagtccancttgtgcagtctggggctgaggtgaagaagccgtgggcctcagtagagtttccngtacaaggtcctgtaggactacaccttgagtacgaactaattactttagctaggttcgggtcgaccgtaccgacccgggacccccggtaaacggaacggggtccgtttgggtttacgggacgttaggggaacgtcggacgttaccgaaaccggtcgtacgggaataaacggtaataaacgaaactaaaatacgttaacaacgtaaggtaacgttaccgaaggactaaggcgtacaactacgtacacggaacganaccgtnaccgtacgacgactacacgtacgtacagtaaggtaggtagacgtacgtacgtaccgtagaaacggtaaatacggaaacgaaaccgaacggtaacgttacggttaacgttattaaacggttggtaaccggtaagggtaaaacgggtaaaggggtaaaccgttcgggtaccccgtaaaacccgtaaccggtaaacccgggtaaacgtaccccgggtttacccgttaaccccggttccccccgtaacggtaccccccgttaaaccccttcccgtaaccccggaaaacggg

SEQ ID NO: 292873 - DNA, 725 bp, Homo sapiens
  misc_feature: GYAE6OF01C84JL.52.67.G01.1.454.CMB.1.raw
  modified_base (135)..(135): a, c, t, g, unknown or other
  misc_feature (135)..(135): n is a, c, g, or t
  modified_base (143)..(143): a, c, t, g, unknown or other
  misc_feature (143)..(143): n is a, c, g, or t
  modified_base (240)..(240): a, c, t, g, unknown or other
  misc_feature (240)..(240): n is a, c, g, or t
  modified_base (262)..(262): a, c, t, g, unknown or other
  misc_feature (262)..(262): n is a, c, g, or t
  modified_base (267)..(267): a, c, t, g, unknown or other
  misc_feature (267)..(267): n is a, c, g, or t
  modified_base (271)..(271): a, c, t, g, unknown or other
  misc_feature (271)..(271): n is a, c, g, or t
  modified_base (332)..(332): a, c, t, g, unknown or other
  misc_feature (332)..(332): n is a, c, g, or t
  modified_base (402)..(402): a, c, t, g, unknown or other
  misc_feature (402)..(402): n is a, c, g, or t
tcagcgcagtacgacacgaccggtgctcgatttagagtatacatattgggtttggggacccaacaaccacatccctcctcagaacgcccccagagcacaacgccctcaccatggactggacctggaggatccttntttttggnggcagcagccacaggtgccactcccaggtccagtcttgtgctagtcgtggggctgaggtagaagacgccggtggggcctgaggtgtaacggtttccngacgacggcctgtggtactacnccttnagtnaactacttcttgcttaggttggccgccgccgaccggcccccggagtaggtctttggttggnggtacggtgtagtcacggtctggcaacgtaggaactaacaaatatacacgaagaagttccgacgggcganacgtactaccacgtacgaccgaacggggtacaccgtacgtccgaccgagaccacacgtacctactaacgtggaacgggtttacgagggaccctacgtccgacggtaaagtaaggttaacgaacggtaccgtaacggtcgttaacggttattaacgtttacgtaggtcgggaaacgggaggtaagggggtaacaccgggtcccggttaaacccgaccgggttaaacccggaccccgggttcgttacccccgttaaccccggtttccccccccgttaacgggaccccctaacccccgttcctaaacccccgtacgggtaccccgg

SEQ ID NO: 292874 - DNA, 771 bp, Homo sapiens
  misc_feature: GYAE6OF01BXL49.52.67.G01.1.454.CMB.1.raw
  modified_base (238)..(238): a, c, t, g, unknown or other
  misc_feature (238)..(238): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatccttctttttggtggcagcagccacaggtggccacctcccgaggtccagcttgtgcagtcgtggggctgaggtgaagacgccgtcggggcctcgaggtgtaacgtttccnggcacggcctctggactaccaccttacgagtgactattacttgacgtagttgggtcgcgccgaccgggaccccggacgaagggttctttggtttacggaggttggggagtagggtactaccgaaccggtcgtacggacgtaagttacggtaaaacaaacctaaaattacgtactaacgaacggtaacgtaccgaggggtacaagggtaccgtaccaactaacgtaccgaaccggaacgggtacccaacgaccgtccggacgtacgaccacgaccgtaccctaacgtaggtacggtaggttacggacgtaccgacgaccgtaggaacgaaagtaacgaaggtaaccgagttacgttagttaacttagttacggtaggtacggaacgggtaggggaaacgggtacgtacccggttacccgaacccggtaaccccggaacccgggtcccgttaaccccggttcccggttaccccccgtttacccccggtacccggttacccccgtaacccccgttccccgaaccccggtaacccgg

SEQ ID NO: 292875 - DNA, 848 bp, Homo sapiens
  misc_feature: GYAE6OF01CHWIH.52.67.G01.1.454.CMB.1.raw
tcagcgcagtacgacacgaccggtgctcgatttagagtatacatattgggtttgggacccaacaaccacatccctcctcagaacgcccccagagcacaacgcctcaccatggactggacctggaggatccttctttttggtggcagcagccacaggtgccactcccaggtccagtcttgtgcagtctgggggctggaggtgaagagccgtgggcctcagtgtaaggtttcctgacgaacggtcctcgtggtactacctaccttcgagttagaactaattaccgtttgacgtagtttgggtcgcccgaccgaccggggaccccccgggaacgtaacggggttcgtttagggttttacgggagttggggagtacggtactaccgaacggtcgtacggtacgtaagttaacgggtaaacaactaaaaagttacttaccgaacgtaaacggtaacgttacccgggaagggtacctaggtaaccgtaccaaccctacgtaaccgaacccggtaacgggaccaacgtacgtacccggacggaaccgtacccgaacgacgtaacccgtaacgtacggtacgggtagttacggacgtaccggtaacgtaccgaaggtaaacgaaaggtaacggaaacggtacccgtacggtaaccgttaagttaacgtttaagttaccgttacggtaacgggtaacggtaacggggtaaacgggtaaccggtaccgggttaaccccgtaaacccggaacccgggtaaaccgggtacccccgttaacggttacccccgggtttcccccgttaacccccgggtcggttaaccccccctaccccggtttacccgaaacccggtaaccgg

SEQ ID NO: 292876 - DNA, 760 bp, Homo sapiens
  misc_feature: GYAE6OF01DXKJB.52.67.G01.1.454.CMB.1.raw
  modified_base (309)..(309): a, c, t, g, unknown or other
  misc_feature (309)..(309): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagccgtggggcctcagtgaaggtttcctgcaaggcctcgtaggataccaccttcgagtgaactaattactttgctaagttgggtacgccgccgacggcccccggaanaagggtctttggtttcggagtgggatggactacgaacgcgtggacaagtacggaaacaacgaaaatattacaacaggtaacgtccgaagggcaagtacgtacaaccactaccgaacggtaagggacccaacgtaccgtacccggacgaacgacccaacgaacccgtacccgtaacgagttacgggtaacggttaggaacgacgtaacggcccttaagggaaacgtaaagtacgggaaacggaccgtaacggtcgttaagttaacgttaacgtttaacggtcggttacggaacgggtaaagggtaaacgggggtaaacgttaccggggtacccttaccccgggaaacccgttaaaccgggggtccccctaaacgggtttccccggttacccccgtttaccccccggtacgggacccccttaacccccgttcccgtaaccccgtaaaaccggg

SEQ ID NO: 292877 - DNA, 887 bp, Homo sapiens
  misc_feature: GYAE6OF01DSRTS.52.67.G01.1.454.CMB.1.raw
  modified_base (143)..(143): a, c, t, g, unknown or other
  misc_feature (143)..(143): n is a, c, g, or t
tcagcgcagtacgacacgaccggtgctcgatttagagtatacatattgggtttgggacccaaacaaccacactcccctcctcagaacgcccccagagcaacaacgcctcacatggactggacctggagattccttcttttggnggcagcagccacgaggtcgcccactcccgaggtccaagtcttgtgactagtcgtggggcttaggaggtagaaacgaacgtccggtacgggtcctacgagttacggttaacggtttccctaggaaccgtaacggtcccttcgtaggaacctaccgttaccttacgaggtacaaacttaacttacctttagtactaaggttgggtaccgccgacccgacggaacccccccggaagtaacgggttcgtttaggtttacggaggttagggacgttacggaacgtaccgtaaccggtggacgtaacgtaaacggtaaggtaaacctaaaaccaaagttttacaaccgtaacgtaaccggtaaacgtttacccggacggacgtaaacggtaacctaccgaaaccacgttaacccgaacggaaacggtaacctaacggacgttaacccggacgaacggtaaccaccgtaaacgaccccttaaggaaaccgttagggtaccgttaggaaccgtacccggtaagtacccgttaaggaaacgtaaaggttaccgaaacgggtaaaccgttaccggtaaacgttaggttaaatttacggtaacgtttacgggcgttaaacggggaaagttaaccggggtaaagtccccgggtaccaaaacccggaaccggtaccggaacccgtaaaccggttcccggttaacccccgtttcccggacccggtaccccctaacccgtccgttaaccggaaaacccg

SEQ ID NO: 292878 - DNA, 850 bp, Homo sapiens
  misc_feature: GYAE6OF01CFIDU.52.67.G01.1.454.CMB.1.raw
  modified_base (227)..(227): a, c, t, g, unknown or other
  misc_feature (227)..(227): n is a, c, g, or t
tcagcgcagtacgacacgaccggtgctcgatttagagtatacatattgggtttggggacccaacaaccacatccctcctcagaagccccagagcacaacgcctcaccatggactggacctggaggatcctctttttggtggcagcagccacaggtggccactcccaggtccagcttgtgcagtcgtgggctgaggtgaagagccgtgggcctcagtgtacggtttcngcaacggcctcgtggacttacgtaccttcaggttagaactaattaccttttgactagtttcggggtcgaccgccgaccgggccccccggaagtaacggggtcctttggtttaggagtggggtatcgggaacttcggaaacgtcgtaggactaagtaggtaaactaaacgtaaaacttaattaccaacgaacgttaaacggttacccgacgggtaacggaacgacggtacaacccgtactaccgaaccggaacggtaacaccgtacgtaccggaccggtaacaccgaaccgtaacgtaccccgttaacgtaaggttacggtagggtttaaccggacggtaaccggtaacgtacggtaacggtaaaacggtaaacgtaaagggaacccggaacgtaacccggggtacgtttaacgggttaaccttaaggttttaacccgtacggggttaggaccggtaaacggggtaaaacgggggtaaaccgttaaccgggtaccccggtaacccggaaacccgggtaaaccccggggtcccgtaccggtttacccccgggttaaccccggttaccccccgggtttacggaaccccccgtaccccgtttaaccccgaacccggtaaaaacccgg

SEQ ID NO: 292879 - DNA, 812 bp, Homo sapiens
  misc_feature: GYAE6OF01A1AFA.52.67.G01.1.454.CMB.1.raw
  modified_base (231)..(231): a, c, t, g, unknown or other
  misc_feature (231)..(231): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtgccactcccaggtccagcttgtgcagtctggggctggaggtgaagagccgtggggcctcgagtgaacggtttccngacaacggccttgtggactacctaccttcgagtagaactaatttactttgacgtagttggggtcgccgaccgaccgggcccccgggaacgtaacggggttcctttaggtttacgggacgttgggtagtggtaactccggaacgtcgtaggacgtaaggtacggtaaaccaacgtaaaattcgttacaacgtagtaacgttccgaaggacaaggtacgtccaacgtactaccgaaccggaggacctacctacgtaccgagacgaccacgacgtacctaagagttacgggagttacggaagtaccgtacggtaccgtaagaaacggtaaatacggaaacgtaccggaaccggttacgttaaacggtttaagtttaccggtttaagtacgggtacggtaacgggaaagggggtaaccgggttaaaagtcccccggggttaaccgtaacccccggggtaaacccgggtaaccccggggtaccccttaaccccggggttaccccggttttaccccccgttaccccccgggtaacccgtaccccccccggtttaacccccgtaccccgttaaccccgggaaacccgg

SEQ ID NO: 292880 - DNA, 772 bp, Homo sapiens
  misc_feature: GYAE6OF01BQHPR.52.67.G01.1.454.CMB.1.raw
  modified_base (228)..(228): a, c, t, g, unknown or other
  misc_feature (228)..(228): n is a, c, g, or t
tcagcgcagtacgacacgaccggtgctcgatttagagtatacatattgggtttggggacccaacaacacatccctcctcagaagccccagagcacaacgcctcaccatggactggacctggtaggatcctctttttggtggcaggcagccacaggtgccactcccaggtccagcttgtagcagtctggggctggagtgagagccgtggggacctcagtgaagtttccngtcaaggtcctacgtggtataccgactttcagtcgacaattacgtttagctagttggtcgtacgtccaccggtccccggaacgaacggtcttaggtttggatgggattacggatcgaacgcgtaggcgtaagttaggtaacctaacctaaaaacgttcttaaccgtaacgtaaggtaaaccgttacccggacgggtaacgtacggaacggtttaccaaacccggtaacttacccgaaaccccgtaggggaacctaccgtaccggttaccggaccgacgtaccgaacgttaacgggaccctttaacggaacgttacgggtagttagggacgtaccagggacccttaggaaaccgtaagtaacggaacggtacgaaccgggtacgttaaccggttagttactttaacccgtcggtagtaccgggtaaaggacggggtaaagtaccggtacccgtactaacccggttaacggggaccccacggttacccggttacccggttcccccgttacgggtacccctaccccgtcccgtacccgtaaaccggg

SEQ ID NO: 292881 - DNA, 795 bp, Homo sapiens
  misc_feature: GYAE6OF01BDBC9.52.67.G01.1.454.CMB.1.raw
  modified_base (142)..(142): a, c, t, g, unknown or other
  misc_feature (142)..(142): n is a, c, g, or t
  modified_base (155)..(155): a, c, t, g, unknown or other
  misc_feature (155)..(155): n is a, c, g, or t
  modified_base (185)..(185): a, c, t, g, unknown or other
  misc_feature (185)..(185): n is a, c, g, or t
  modified_base (226)..(226): a, c, t, g, unknown or other
  misc_feature (226)..(226): n is a, c, g, or t
  modified_base (282)..(282): a, c, t, g, unknown or other
  misc_feature (282)..(282): n is a, c, g, or t
tcagcgcagtacgacacgaccggtgctcgatttagagtatacatattgggtttggggacccaacaaccacatccctcctcagaacgccccagagcacaacgcctcaccagtggactggacctggagactccttcgttttggngcagcagccacgnggtcgtcactcccgaggtccagtctttgcnctagtcgtggggcttggaggtcgaaggacgcgtcgggcctnaggtcggtaacgtttccaggacgacggtccttgcggtactaacctccttgacgttnaactacttcgtttagcgtagttcggtgccgtaccgtcggacccccggaagtacggtcgttttacggtttggtaacggttcggggtaattacgggaacgtttaccgaaaccggtcggtaaccgggtaccgttaaaacgggttaacccgggtaaaactaaaaaccggttaaaacgtttaaccgtttaaccggtaaaacggtaacgggttaaacgtttaaccggaaccgggaactacgggtaaccgtaccgtaaccgtacgtaacccgtaaccggaaaccgtacaaccgaccgttacccgaccggtacgacctaaccgcgaccccgtaacgtaaggtccgtaggttacgacgtacggtacgaccgtagaacggtagtacgaagtaccgacggttacgtagtaacttacgtacggtcggacgtaggtaggaacggtaacttccggaacccgtcgtaccgacggtccctaacgttcccgtacccttcccgacggtacccctccgtccgcgtaacccgg

SEQ ID NO: 292882 - DNA, 706 bp, Homo sapiens
  misc_feature: GYAE6OF01DN6JF.52.67.G01.1.454.CMB.1.raw
  modified_base (386)..(386): a, c, t, g, unknown or other
  misc_feature (386)..(386): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtcgccactcccaggtccagcttgtgcagtcgtggggctggaggtgaagaagccgtggggcctcgaggtgtaacggtttcctgcaaggcctacgtggactaccacctttcgaagtcgaactaattacctttgctagttgggtcgccgaccgacggcccccggagaacgggtcttggttggagtgggatggactacgaacggctaggactaagtagtaaactaacgtaaaatnttaccaacgaagtaacgttaccgagggtacaagacgtaccaaccgtagccaaccggacggaccacgacgtccggacgaacgtaccaacgtacgtaccctaagaacggttgggaagtcgaacgtcgacgtaccgtagaaacgtaagtacgaacgaccgacggtcctaagttaattacgttcgttacgggtcgaagggaaacgggtaaggggtaaacgtccggacccgttaaccccggaacggtaacccgggtccctacggttcccggttacccccgttccccgacggtaccccctacccccgttaccctaccgggtaaacg

SEQ ID NO: 292883 - DNA, 781 bp, Homo sapiens
  misc_feature: GYAE6OF01AZGLZ.52.67.G01.1.454.CMB.1.raw
  modified_base (242)..(242): a, c, t, g, unknown or other
  misc_feature (242)..(242): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatccttctttttggtggcagcagccacagggtggccactcccgacggtccagtcttgtgtcaggtctgggggctggaggtgaaggaagccgtggggcctcaggtgtaaggtttccngtacgaacggcctcgtaggaactaccgtacctttcagtacgaacctaattactttgctagttggtgccgccgtacgggcccccggacgagggtcgtttggttcgggtagttgggtagtaggtactaccgtaaccgcgtaggtacaagtacgtaactaaactaaagttacgtacaacgtaagtaaccgttaccggacggtaccgaagtaccgtaccgaaccctacgtaccgaccggtacggaacctaccggtacgtcccgccggtacaaccgtacgaccgtaccctaacgtagtacggtagtacggacgccgtaagtacccgaagtaacgaacgtaagtaagaaccgtaaccggttaccgtaagttaagtttaccgtttaacgttacgggtacgaaacgggacgggtaaagggggtaacgtaccggggtaccggtaccccgtaacgggtaacccggtcccgtaaccgtttcccccggttacccggtacccccggttacccgggtaccccacccccgtttacccgtacccgtaaacccggg

SEQ ID NO: 292884 - DNA, 717 bp, Homo sapiens
  misc_feature: GYAE6OF01BI6VX.52.67.G01.1.454.CMB.1.raw
  modified_base (140)..(140): a, c, t, g, unknown or other
  misc_feature (140)..(140): n is a, c, g, or t
  modified_base (510)..(510): a, c, t, g, unknown or other
  misc_feature (510)..(510): n is a, c, g, or t
  modified_base (595)..(595): a, c, t, g, unknown or other
  misc_feature (595)..(595): n is a, c, g, or t
  modified_base (623)..(623): a, c, t, g, unknown or other
  misc_feature (623)..(623): n is a, c, g, or t
tcagcgcagtacgacacgaccggtgctcgatttagagtatacatattgggtttggggacccaacaaccacatccctcctcagaacgccccagagcacaacgcctcaccatggactggacctggaggatcctctttttggnggcagcagccagaggtcgccactcccaggtccagcttgtgcagtctggggctggaggtagaagacgccgtgggcctacgagtgtaacggtttccagacgtaacggtcctagtaggaactaccgaccctttagagtacgaacgtaacttacgttcgacttagttgggctacggacccgaccgggtacccccggaggtaacggtcgtttaggttacggaggtaggagtacggtactacggaccggtgtacgagtaacgtaggaaacctaataagtctaagacgtaagtacgtacgagactaggacacgaacctactacgacggtaacggacacgttacgccgaacgcaaccggtaccacgttacccgtaagnggttacggtacgtcgacgaacgcgtaaccgttaggaacgttaacgaccgaacgtaccgacggtacttaacggtaattcttacggnggaagaccgggtagggaaacgggtaacncccgggtaaccacccgggtaaacggcccggtacttacccgttccggacccccgttaccggcgtaaccccctcccggtaaattcccggaaaccgg

SEQ ID NO: 292885 - DNA, 799 bp, Homo sapiens
  misc_feature: GYAE6OF01AHZKZ.52.67.G01.1.454.CMB.1.raw
  modified_base (86)..(86): a, c, t, g, unknown or other
  misc_feature (86)..(86): n is a, c, g, or t
  modified_base (233)..(233): a, c, t, g, unknown or other
  misc_feature (233)..(233): n is a, c, g, or t
  modified_base (242)..(242): a, c, t, g, unknown or other
  misc_feature (242)..(242): n is a, c, g, or t
  modified_base (256)..(256): a, c, t, g, unknown or other
  misc_feature (256)..(256): n is a, c, g, or t
tcagcgcagtacgacacgaccggtgctcgatttagagtatacatattgggtttggggacccaacaaccacatccctcctcagaacnccccagagcacaacgcctcaccatggactggacctggaggactccttctttttggtggcagcagccacaggtggccacgtcccaggtccagcttgtgcagtcgtgggctgaggtgaagacgccgtgggcctcgagtgaaggtttccngcaggctgngatacacttcagtnactatcttgctagtggtcgcgccgaccggccccggaagtacgggtctttggttcgggagtgggtactggacgtccgaacgtcgtggactaagtacggttaaacaactaaaatcttcgaaccgtaaggtaacgttacggaacggactaacggtacgtaccaacccggtataccggaaccggaacgggaaccaacgaacgtcccggaacggtaacaccgaaccacgtacccctaagtagggtaacggtacggttacgacgaccgtacggaccgtaggaaaacgtaagtaaacgggaacgtacggtaaccgggtatttagtttaaaccttacggttaacgttacgggtaggtaacgggaacggggtaaacggggtaaaccgtaccgggtaccccgttaccccgggtaaaacccgggaaccccggggttaccccgttaacccggggttacccccgggttttaacccccttttacccccccgggggtaccgtaaaccccccccggtttccccgttttaccccccggaaacccggggtaaaacccccgg

SEQ ID NO: 292886 - DNA, 937 bp, Homo sapiens
  misc_feature: GYAE6OF01AZBRF.52.67.G01.1.454.CMB.1.raw
  modified_base (151)..(151): a, c, t, g, unknown or other
  misc_feature (151)..(151): n is a, c, g, or t
  modified_base (185)..(185): a, c, t, g, unknown or other
  misc_feature (185)..(185): n is a, c, g, or t
  modified_base (220)..(220): a, c, t, g, unknown or other
  misc_feature (220)..(220): n is a, c, g, or t
  modified_base (236)..(236): a, c, t, g, unknown or other
  misc_feature (236)..(236): n is a, c, g, or t
  modified_base (915)..(915): a, c, t, g, unknown or other
  misc_feature (915)..(915): n is a, c, g, or t
tcagcgcagtacgacacgaccggtgctcgatttagagtatacatattgggtttggggaccaacaaccacatccctcctcagaagcccccagagcacaacgcctcaccatggactggacctggagatccttcttttggtggcagcagccacnggtggccactccaggtccagcttgtagcagttcnggggctggaggtagaagaacgccgtggggccctgnggtgtaacggtttccnggacgtacggacctcgtacggacttacctaccgttacaacggtacgtaacctaaacgtttacgttttaccggtacttaacggtttcgggggtaccgtaccccggtaccccggtaaccccgggggtacccccccgggttaaacggtaaacccgggggttaccgtttttcggggttttacgggtaaccggggtttaggggggtaacgtttccggggttaaacgttacccgggaaacccgggttcccggttagggtaaccctaaacgggttaaacgggttaaaacccaaaagtaaaaaaccgttttacttaacccggtaaaccgtaacgggtaaaccggtttaaccccggaacggggtaccgttaaacgggtaacccgttaccggaaacccctaaacgtttaacccggaaacccgtaaacgggggacctaacccgtaaccggtccgggaaccgtaacggtaaccgaaccgaaccgtacccttaacgaacggttacggtaggttacggacgccgtaacgtaggtacgaaacgttaaggaacgaacggtaaccgtcgtacgtagttacgtaattaacggtaggttaccgaggggtaaacggagggtacgtacccggtaccgaccgtaacccgggacccgtcccgtaaacggttcccgtaccccgttcccggtcccggtaacccnccccgtaccgtaaccgaacccg

SEQ ID NO: 292887 - DNA, 814 bp, Homo sapiens
  misc_feature: GYAE6OF01CTHFH.52.67.G01.1.454.CMB.1.raw
  modified_base (143)..(143): a, c, t, g, unknown or other
  misc_feature (143)..(143): n is a, c, g, or t
  modified_base (193)..(193): a, c, t, g, unknown or other
  misc_feature (193)..(193): n is a, c, g, or t
  modified_base (255)..(255): a, c, t, g, unknown or other
  misc_feature (255)..(255): n is a, c, g, or t
  modified_base (374)..(374): a, c, t, g, unknown or other
  misc_feature (374)..(374): n is a, c, g, or t
  modified_base (446)..(446): a, c, t, g, unknown or other
  misc_feature (446)..(446): n is a, c, g, or t
  modified_base (540)..(540): a, c, t, g, unknown or other
  misc_feature (540)..(540): n is a, c, g, or t
  modified_base (602)..(602): a, c, t, g, unknown or other
  misc_feature (602)..(602): n is a, c, g, or t
tcagcgcagtacgacacgaccggtgctcgatttagagtatacatattgggtttggggacccaaacaaccacactccctcctcagaacgccccagagcacaacgcctcaccatggactggacctggaggatcctcgtttttggnggcagcagccactaggtggcctactcccgagtccagcttgtagcagtcgngggctgaggtacaagtaacggccgtaggggtcctacgagttacggtaaacggtttttcccgnggaccgtaaacgggtccccttacgggtacggtaacttaaccgtacccgtttacggagtttacgaaacctaaagttctttagcgacgtttagggcgaccggaccgtacggaccccggaanagggtcctttgtacgggatggacttggataccggagtctaggacctaagtaacggtaacaaccgtaaaagtnttaccggaactaacggtaaacggttcccgaaggtccaaggtaaccgtcgaaccctagtaccgaacgaggtaactaacgctaccggtacgtaacncgtacgaccgttacgacgtaacggtcggtacgttacgacgacgaacggtacccgtagtaaanaacgggttaacgaaccgtacgtaccggtcgttaactaacggttaaccttacggttacggacggtacgggtaaacggtaacggggtactttaaccgggaccccgtaggaacccgggtaacccgggtaaccgttaccggttacccgggttaaccccgttaacccccgggtacgtaaccccccctttacggttcccgtaaaaacccgtaaccggg

SEQ ID NO: 292888 - DNA, 794 bp, Homo sapiens
  misc_feature: GYAE6OF01BZKXN.52.67.G01.1.454.CMB.1.raw
  modified_base (143)..(143): a, c, t, g, unknown or other
  misc_feature (143)..(143): n is a, c, g, or t
tcagcgcagtacgacacgaccggtgctcgatttagagtatacatattgggtttggggacccaacaaccacatccctcctcagaacgcccccagagcacaacgcctcaccatggactggacctggaggactccttcgttttggnggcagcagccacgaggtcgccactcccgaggtccagtcttgtgcaggtcgtggggctaggaggtgaagacgccggtgggccctagagtaggtacgtttccagacgaggtcctacgtaggacttacctaccgttagtaggtacgaactacgttactttacggacttagggttcgggaccggacccggtaccggacccgggaaccccccggtaggtaacggggttcgttttcgggttaggaggtacggttaagtacggtaaccgtaccgaaccgtcggtagaaccgtaagtaaccggtaacaacgtaatactacgaacgtacgtacgtacgcggacgtagaccgtaacacctactacccgaacggtacgaccacgtaccgtaccgacgtacgaccgaaccgtacgtacctaacgaacggtagggtacgtaggtaccgacggaccgtaccgaagtaaacgtaagtaaaccgggacgtaaccggtacggtaaccttacggttaacttacggttcgacgggtacggtaacgggtaacgggtaacggtaccggtcgtaaccccggtacgaaacccgggacgttccccgaaggttaccccccgttacccgtaccccggtacccggtacccctaacccgtccccgtaaaggtacccccg

SEQ ID NO: 292889 - DNA, 920 bp, Homo sapiens
  misc_feature: GYAE6OF01AWIN9.52.67.G01.1.454.CMB.1.raw
  modified_base (144)..(144): a, c, t, g, unknown or other
  misc_feature (144)..(144): n is a, c, g, or t
tcagcgcagtacgacacgaccggtgctcgatttagagtatacatagttgggtttggggacccaacaaccacatccctcctcagaacgccccagagcacaacgcctcaccatggactggacctggaggactccttcgtttttggnggcagcagccacgagggtcgcccacctcccgacggtccagtcttgtcgctagtcgtgggctggaggtagaagacggtccggtcgggtcctacgtaggttaggtaaccggtttccgaggaccggtaaccgtccgttacggtacggtaaccttaccgtaccgttacggtaaggtactaaacgtttaaccgttttacggtttcggaacggtttaggggtttccggggacccgtacccgggtaccccgggtaaccccgggggacccccccgggtaaggtttaaccgggggtttccccggttttggggtttaaacggggacgggtttaccggggggtaattaaccggggttaaccgtaaccggggtaacccggtacgggtacggtaaacgtaaaccggtttaaaaccgggaaaaccctaaaaatttaaacgttaccgtaaccggtaaacgttaacggttaaaccggtacggggaaccggtactaaccgggtactacccgaaccgtacgaaccggaacggtaacgaaccgtacgaccggtaccgacgacgtaccaacgtacctaaccggtagacgggtaaggttacggtaacgacggtaaccctcgggtaaccgaaggtaacgtaacggacgaacggtccggtaattaccggtaagttttaccacggttcgtaaggaggtaccgggtaaaggaccgggtactacccggaaccgtacccggaggtaaccccggtccgtaccgttaccccgtcgacccgtcctacccctcggtacgccgtaacg

SEQ ID NO: 292890 - DNA, 893 bp, Homo sapiens
  misc_feature: GYAE6OF01CQIQV.52.67.G01.1.454.CMB.1.raw
tcagcgcagtacgacacgaccggtgctcgatttagagtatacatattgggtttggggacccaacaaccacatccctcctcagaacgcccccagagcacaacgcctccaccatggactggacctgggaggactccttcgtttttggtggcagcacgcccacgagggtcggacccacccgtccccgacgggtcccacggtctttggtcgccgtaggtcggtgggggctgggagggtaggaacggacggtccggtcggggcctacggtaggtacggttaacggttttcccgtggaccgtaacggtccgtacgtacggtacctaccgtaccttacgaggtacgtaacttaacgtttaccgtttcggtacgttacggtttggggcgtcccggaccggacccggggacccccggtaacggtaacggggttcgtttacggggttagggtaggtacggggtacgtagggtacgtaccggaaccgtcggtacgggacgtaaacggtaacggtaaacgtaaaactaaaacttaactaaccgtaaacggtaacggtaaaccggttaccggaacggacgtaacggaaccgtacctaacgtaccgaccggtaaccggaacgggaccaccgaaccggtccggacgaccgaccgaaccgaccgtaccctaaggtaggtacgggtagtacgtcgaccgtaccgtacgtaaggaaacgtaaggacggaacgtaacgaccggtagttaactagttagttacgcgggtaggtaacggacgggaagggtaaccgtcgtaaccccccggacggtaaaccccggccgggtcccgtttacccggtcccccgggttacccccgtttaccccgcccggtaaaccccctcccccgttaaccgtaaccccgggtaaaccg

SEQ ID NO: 292891 - DNA, 825 bp, Homo sapiens
  misc_feature: GYAE6OF01EZ1DA.52.67.G01.1.454.CMB.1.raw
  modified_base (152)..(152): a, c, t, g, unknown or other
  misc_feature (152)..(152): n is a, c, g, or t
  modified_base (229)..(229): a, c, t, g, unknown or other
  misc_feature (229)..(229): n is a, c, g, or t
  modified_base (246)..(246): a, c, t, g, unknown or other
  misc_feature (246)..(246): n is a, c, g, or t
  modified_base (251)..(251): a, c, t, g, unknown or other
  misc_feature (251)..(251): n is a, c, g, or t
tcagcgcagtacgacacgaccggtgctcgatttagagtatacatattgggtttggggacccaacaaccacatcccctcctcagaagccccagagcacaacgcctcaccatggactggacctggaggatcctctttttggtggcagcagcacnggtggccactcccaggtccagcttgtgcagtctggggctggaggtgaagacgcgtggggcctcgaggtgagtttccngacaggctcgtgatacnccttnagtcgactaatactttgacgtagttgggtcgcgccacggccccggagacgggtctttggttggacgtgggtacgtggtaactcgaacggtcgtggacgtaacgttacgtaaacaataaaaacttcgttaccaacggtaaggtaaacggtttccgaaggggtactaacggtaccgtaccaacccgtaatacccggaacggaacgggtaacccaacgtccgtacccgaccggtaacgagtaacccccccccccgagtacccgtaaacgtacgtaggttacgtacggtacgtacgtacgtaccgtaaggaaacgtaacgtaacggaaacgtaacgtaccggtacgttacgttaacgtttaacgttacgttacgggtacggtaacgggtaacgggtaaacggggttaaaccggtaccgggttaaccccggtaaccccggtaaacccggggttaaacccggggtaccccggttaaccgggtttaccccgggtttacccccgtttaacccccggggtttaaccccggttaccccccggttaaacccgttacccccggttaacccggttaaacccccgggg

SEQ ID NO: 292892 - DNA, 853 bp, Homo sapiens
  misc_feature: GYAE6OF01DUIXB.52.67.G01.1.454.CMB.1.raw
  modified_base (141)..(141): a, c, t, g, unknown or other
  misc_feature (141)..(141): n is a, c, g, or t
tcagcgcagtacgacacgaccggtgctcgatttagagtatacatattgggtttggggacccaacaaccacatccctcctcagaagcccccagagcaacaacgcctcaccatggactggacctggagatcctcgtttttggnggcagcagccacgaggtggcccactcccgaggtccagcttgtgcagtcgtgggctggaggtgaagaagccgtgggcctcgagtagtaacgggtttcctaggacgaacggtccctcgtaggtaccttaacccgtaccgtttcgaaggtacgaaacttaaactttaccgtttcgaccgttaaggtttggggtaccggtcccggacccggaaccccggggtacccccccgggaaggtaacggggttccgttttagggttttaggggaacggttaggggtagttacgggtaacgtaccgaaccgggtcgtacggtaacgttaaaaggtaacggtaaaacctaaaactaaaacgttactaacgtaaccgtaaaggttaccgttaaccggaggccaaggtaacgacctaaccacgtaccgaacggtaacggaacaacctcggaccgaccgacaaccgtacgaccgtacccgtaatacgggtagtcggttacgacgtcccgaacgtacgtaaggaacgtaacgtaacgggaacgaaccggtacgtacgttagttaacgttagttacgaggtccggaaggttaaacggggaacggtaaccggtaccgggtacccgtaaacccggtaaacgggtacccggtaaccgtaccccggttcccgtttaccccccggtacccggtacccggtaccccaaccccggttcccgaaaccgggtaacccg

SEQ ID NO: 292893 - DNA, 703 bp, Homo sapiens
  misc_feature: GYAE6OF01D5BPX.52.67.G01.1.454.CMB.1.raw
  modified_base (567)..(567): a, c, t, g, unknown or other
  misc_feature (567)..(567): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctcttttggtggcagcagccacaggtggccactcccaggtccagtctgtgcagtcgtggggctggaggtgaagagccgtggggcctgagtgtacggttcctgcaaggcctcgtaggactacacttcagtcgaactaacttcttgactagttgggtcgtcgccgaccggacccccggaagtaacgggtctttaggttacgggagtgggatggtactacggaacgtcgtggaactaagtacggtaaacaaacgtaaaattacttaaccgaacgtaacgtaacggtaccgaggactaagacgtaccaacacgtaccgaaccggacggtacaacgtcgtaccgacgacgaccacgtacgactacgagtcgtagtcgagcgacgtccgaagaaggtaacgtacgaacgaccggtaggtacttaacgttaactaagtttaccgnggtacggtacggaaaggggttaacggaaacgtcccggtaacccgtaccggtaaaccgggaccggttaccgtaccgggttccccgttaccccgttccccgaccggtaaccccttacccccgtccgacgtaaacccgg

SEQ ID NO: 292894 - DNA, 773 bp, Homo sapiens
  misc_feature: GYAE6OF01AM53C.52.67.G01.1.454.CMB.1.raw
  modified_base (141)..(141): a, c, t, g, unknown or other
  misc_feature (141)..(141): n is a, c, g, or t
  modified_base (198)..(198): a, c, t, g, unknown or other
  misc_feature (198)..(198): n is a, c, g, or t
  modified_base (376)..(376): a, c, t, g, unknown or other
  misc_feature (376)..(376): n is a, c, g, or t
tcagcgcagtacgacacgaccggtgctcgatttagagtatacatattgggtttggggacccaacaaccacatccctcctcagaacgcccccagagcacaacgcctcaccatggactggacctggaggatcctctttttggnggcagcagccacaggtggccactcccaggtccagctgtgcagtctggggctgaggtnaagagccgtaggggcctcgagtgaacggtttcctgcaacggcctcgtcgatacaccttcacgtgactaattacttgactagttgggcgtccgccgaccggcccccggacgaagggctttcggttggtagtgggtagtggtactaccgaacgtccgtaggtacctaagttacgggtaanaaaccgtaaaatcttaaccaacgttaaggtaaacgtttccggaaggacgtaaggtacggtaccaaccccacgttacccgaaacggtaccgggaaactactaccgtacccgcgaccggacaaccgtaccgtacccaaccgtagtacgggttacgttagggaaccgtaccgaggtacccgaagaacggtaacgtaaggaacgaacccggtaacgtccgtaagttacgttaacgttacggttacgacggtaaccggaagggggtaacggtaaacggttcccggtaaccccgacccgggttaaacccgaaccgggtccccgtaaccgttacccgggtttaccccgttcccccggtaccgtacccccggttacccccgtcccgtaaccccggtaaaccccgg

SEQ ID NO: 292895 - DNA, 714 bp, Homo sapiens
  misc_feature: GYAE6OF01EEQDB.52.67.G01.1.454.CMB.1.raw
  modified_base (273)..(273): a, c, t, g, unknown or other
  misc_feature (273)..(273): n is a, c, g, or t
  modified_base (319)..(319): a, c, t, g, unknown or other
  misc_feature (319)..(319): n is a, c, g, or t
  modified_base (329)..(329): a, c, t, g, unknown or other
  misc_feature (329)..(329): n is a, c, g, or t
  modified_base (348)..(348): a, c, t, g, unknown or other
  misc_feature (348)..(348): n is a, c, g, or t
  modified_base (543)..(543): a, c, t, g, unknown or other
  misc_feature (543)..(543): n is a, c, g, or t
tcagcgcagtacgacacgaccggtgctcgatttagagtatacatattgggtttggggacccaacaaccacatccctcctcagaacgcccccagagcacaacgcctcaccatggactggacctggaggatccttctttttggtggcagcagccacagggtcgccactcccaggtccagcttgtgcagtcgtgggctggaggtgaagacgccgtggggctcgagtggtaacggtttcctggacacggtcctcgaggtatacctaccttcaggtanaactattacgtttgcgtagttggcgcgccgacggccccgagaggtntttggttggngtgggagtgcgtacgacgngcgataagtcgtaacataaaatcgttacaaacgtagtaacgttaccggaggacgaagtacgaccgaacctacgtaccgaaccggaacggaccaacgtaacgtcccggacgacgtaccaaccgtacggtaccctaacgtaggtaagggtactacggtaacgacgtacccggtacgtaagaagtaactacgggaacnccggacggttagtaggttaacttacggttacggtgtacggaacgggaagggtaaacgggtacgtacccggtacccgtaacccgaaccggggacccggtaccgttacgttccccgggttacccccttaccccgggtaccctaccctaccccggttcgaaccggtaacccggg

SEQ ID NO: 292896 - DNA, 540 bp, Homo sapiens
  misc_feature: GYAE6OF02G1PNV.52.67.G01.1.454.CMB.1.raw
tcagcgcagtacgacacgaccggtgctcgatttagagtatacatattgggtttggggacccaacaaccgacatcccttcctcagaagcccccagagcacaacgcctcaccatggactggacctggaggatcctctttttggtggcagcagccacaggtggccacttcccaggtccagcttgtgcagtctggggactgaggtcgaagtaagccctgggggccctcgaggtgaaggttttcctaggcaagggcctctggatacaccttcagtgacaatactttcgcattggtgcgcaggcccccggacaagggcttggtttggagtggggatgggatcgaacgctggcaatggtaacacaaaatatcaacagaagttccagggcagagtcacatcacagggacacatccgcgagcacagcctacatggagttgagcagcctgagaaatgaagacacggctgtatattactgtgcgagagggaatggacctcgaccgaagggcccagtccggtcttccccgtggcccaccctcctaccaacgg

SEQ ID NO: 292897 - DNA, 505 bp, Homo sapiens
  misc_feature: GYAE6OF02G49Y8.52.67.G01.1.454.CMB.1.raw
  modified_base (292)..(292): a, c, t, g, unknown or other
  misc_feature (292)..(292): n is a, c, g, or t
  modified_base (402)..(402): a, c, t, g, unknown or other
  misc_feature (402)..(402): n is a, c, g, or t
  modified_base (492)..(492): a, c, t, g, unknown or other
  misc_feature (492)..(492): n is a, c, g, or t
  modified_base (501)..(501): a, c, t, g, unknown or other
  misc_feature (501)..(501): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgacaatactttgcattgggtgcgccaggcccccgganaagggcttgtttggatgggatggatcaacgctggcaatggtaacacaaaatattcacagaagttccagggcagagtcacatcacaggacacatccgcgagcacagcctanatggagttgagcagcctagagaaatgaagacacggctagtatattactgtgcgagagggaatggacctcacgaggccagtcgtctcccgngccacctcncacg

SEQ ID NO: 292898 - DNA, 515 bp, Homo sapiens
  misc_feature: GYAE6OF02H7ZXK.52.67.G01.1.454.CMB.1.raw
  modified_base (449)..(449): a, c, t, g, unknown or other
  misc_feature (449)..(449): n is a, c, g, or t
  modified_base (509)..(509): a, c, t, g, unknown or other
  misc_feature (509)..(509): n is a, c, g, or t
tcagcgcagtacgacacgaccggtgctcgatttagagtatacatattgggtttggggacccaacaaccacatccctcctcagaagccccagagcacaacgcctcaccatggactggacctggaggatcctctttttggtggcagcagccacaggtggccactcccaggtccagcttgtgcagtctggggctgaggtgaagaagcctggggcctcagtgaaaggtttcctgcaaggcctctggatacaccttcagtgacaatactttgcattgggtgcgccaggccccggacaagggcttgttggatgggatggatcaacgctggcaatggtaacacaaaatattcacagaagttcaggcagagtcaccatcaccaggacacatccgcgagcacagctacatggagttgagcagcctgagaaatgaagacacggctgtatattactgtgngagagggaatcggactcaaccgaaggcccagtccggtccttccccgtgcccaccttcccnctaacg

SEQ ID NO: 292899 - DNA, 518 bp, Homo sapiens
  misc_feature: GYAE6OF02GAD6R.52.67.G01.1.454.CMB.1.raw
  modified_base (344)..(344): a, c, t, g, unknown or other
  misc_feature (344)..(344): n is a, c, g, or t
  modified_base (500)..(500): a, c, t, g, unknown or other
  misc_feature (500)..(500): n is a, c, g, or t
  modified_base (505)..(505): a, c, t, g, unknown or other
  misc_feature (505)..(505): n is a, c, g, or t
  modified_base (513)..(513): a, c, t, g, unknown or other
  misc_feature (513)..(513): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgacaatactttgcattgggtgcgccaggcccccggacaagggcttgtttggatgggatggatcaacgctggcaatggtaacacaaaatnttcacagaagttccagggcagagtcaccatcaccagggacacatccgcgagcacacgcctacatggagttgagcagcctagagaaatgaagacacggctgtatattactgtgcgagagggatggacctcgaccgaggcccagtcggtccttccccnggccncccgtccncaacg

SEQ ID NO: 292900 - DNA, 518 bp, Homo sapiens
  misc_feature: GYAE6OF02F5JXD.52.67.G01.1.454.CMB.1.raw
  modified_base (292)..(292): a, c, t, g, unknown or other
  misc_feature (292)..(292): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgacaatactttgcattgggtgcgccaggcccccgganaagggcttgtttggatgggatggatcaacgctggcaatggtaacacaaaatattcacagaagttccagggcagagtcacatcaccagggacacatccgcgagcacagcctacatggattgagcagcctgagaaatgaagacacggctagtatattactgtgcgagagggaatggacctcgaccagggcccagtccggtcttccccgtggccaccctcctaccaacg

SEQ ID NO: 292901 - DNA, 533 bp, Homo sapiens
  misc_feature: GYAE6OF02I6ITA.52.67.G01.1.454.CMB.1.raw
  modified_base (372)..(372): a, c, t, g, unknown or other
  misc_feature (372)..(372): n is a, c, g, or t
  modified_base (384)..(384): a, c, t, g, unknown or other
  misc_feature (384)..(384): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgacaatactttgcattgggtgcgccacggcccccggacaagggcttggtttggatgggatggatcaacgctggcaatggtaacacaaatattacacagaagttcaggcagagtcacntcacaggacacntcgcgagcacagctacatggacgttgagtcagcctagagaactgaagacgacggctagtattattacgtgtcgagagtagggatcggaccgtccgaacacgggcctaagtccggtccttccccgtggccctcccgtaccgtcccaacgg

SEQ ID NO: 292902 - DNA, 552 bp, Homo sapiens
  misc_feature: GYAE6OF02F3CQR.52.67.G01.1.454.CMB.1.raw
tcagcgcagtacgacacgaccggtgctcgatttagagtatacatattgggtttggggacccaacaaccacatccctcctcagaagccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgacaatactttgcattgggtgcgccaggcccccggacaagggcttgtttggatgggatggatcaacgctggcaatggtaacacaaaatattcaactagaagttccagggcagagtcacatcacaggacacatccgacgagcacacgcctacagtggagttgagcagcctgaagaaatgaagacgacggctagtataattacgtgtgacgaggaaggggaactgggacctaccgaaccgaacggggccctaagtccggtaccttcccccgtaggtcccaccccttcccgtaccgaacgg

SEQ ID NO: 292903 - DNA, 711 bp, Homo sapiens
  misc_feature: GYAE6OF02IU8CU.52.67.G01.1.454.CMB.1.raw
  modified_base (273)..(273): a, c, t, g, unknown or other
  misc_feature (273)..(273): n is a, c, g, or t
  modified_base (286)..(286): a, c, t, g, unknown or other
  misc_feature (286)..(286): n is a, c, g, or t
  modified_base (308)..(308): a, c, t, g, unknown or other
  misc_feature (308)..(308): n is a, c, g, or t
tcagcgcagtacgacacgaccggtgctcgatttagagtatacatattgggtttggggacccaacaaccacatccctcctcagaagccccagagcacaacgcctcaccatggactggacctggaggatcctctttttggtggcagcagccacaggtggccactcccaggtccagcttgtgcagtctgggctgaggtgaagaagccgtgggcctcagtgaaggtttcctgcaaggcctctggatacaccttcagtgacaatactttgcattggtngcaggcccccganaaggcttagttggatggatggntcaacgctggtcaatggtaaacacgtaaaatagttcaactagaaagtttccaagggcaagacgtcaaccgatcaccaagggacaacacgtccgacggacgacacgaacggcccttaaacgacgttacgggtaacggtttacggaacggcttaaacggcccgttaaggaaacgggaaaattacgggaaacgtaaaccgaaccggggtaaccctttaagggttaaacgttaacgttttaaacgtcgggtttaacggacccgggttaaagggaaccgggggttaaaagtccggggtacccgttacccggtaaacccggaacggggtacccccgtaggttaacccccggttcgttacccccccggttaggcccccgtaaccccgttaccccgttacccaaacccggg

SEQ ID NO: 292904 - DNA, 564 bp, Homo sapiens
  misc_feature: GYAE6OF02I82QU.52.67.G01.1.454.CMB.1.raw
  modified_base (276)..(276): a, c, t, g, unknown or other
  misc_feature (276)..(276): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgacaatactttgcattgggtncgccaggcccccggacaagggcttgtttggatgggatggatcaacgctggcaatggtaacacaaaatatacacagaagttccagggcagagtcaccatcaccaggacacatccgcgagcacagcctacatggagttgagcagcctagaagaaagtgaacgacacggctagtattacttagtgtgacgaggaggggaatggacccgtaccgaacccgaacgggaccccagttcccgggttacccttccccccggtaggaccctaccccgttacccgtcccgtaaaccgg

SEQ ID NO: 292905 - DNA, 637 bp, Homo sapiens
  misc_feature: GYAE6OF02GDY13.52.67.G01.1.454.CMB.1.raw
  modified_base (302)..(302): a, c, t, g, unknown or other
  misc_feature (302)..(302): n is a, c, g, or t
  modified_base (357)..(357): a, c, t, g, unknown or other
  misc_feature (357)..(357): n is a, c, g, or t
tcagcgcagtacgacacgaccggtgctcgatttagagtatacatattgggtttggggacccaacaaccacatccctcctcagaagcccccagagacacaacgcctcaccatggactggacctggaggatcctcttttggtgggcagcagccacaggtggccacgtcccaggtcccaggcttgtgcagtctggggctgacggtgaagagcctggggcctcagtgaggtttcctgcaaggcctctggatacgaccttcagtgacaatacctttggacgtagtggtgcgccgacggcccccgganaagggtcttggtttggagtgggactcggactccaacgctaggcaagtggtaacanaaatattacaacagaacgttacaaggacaagtacgtccaccgatccacagggacacagtccgacgagacgacgacgcctaacgagtacggagtgacgcagcctagaaggaacgtaggaacggacgtaccgggcttaggtagtacgttacgtcgtaggccgtaaggaggggtactcgggtacccgtacccgaaccgtaaaccggggccccgtaacgttcccgggttacccgttccccccggtcgggtaccccctaccccgttaccccgtacccgtaaccgg

SEQ ID NO: 292906 - DNA, 590 bp, Homo sapiens
  misc_feature: GYAE6OF02HX3I9.52.67.G01.1.454.CMB.1.raw
  modified_base (237)..(237): a, c, t, g, unknown or other
  misc_feature (237)..(237): n is a, c, g, or t
  modified_base (274)..(274): a, c, t, g, unknown or other
  misc_feature (274)..(274): n is a, c, g, or t
  modified_base (289)..(289): a, c, t, g, unknown or other
  misc_feature (289)..(289): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagagcctgggcctcagtgaaggtttcctgcaaggcctntggatacaccttcagtgacaatactttgcattgggtncgccaggcccccganaagggcttgtttggatgggatggatcaacgctggcaatggtaacacaaatatcaacagaacgttcagggcagatcaccatcacgagggacacatccgcgagcacagcctacgagtggagttgagcgacgctagaagaaagtgaagaccgacgcgtagtaagtattaacgttgtacgacggaggtaggggaacttcgggaaccctccgaacccggaaacggggtaccccaaggttacccgggttaccccttaccccccggtacggaccccgtaacccccgttacccgtaccccgtaaaccgg

SEQ ID NO: 292907 - DNA, 586 bp, Homo sapiens
  misc_feature: GYAE6OF02FRZZE.52.67.G01.1.454.CMB.1.raw
  modified_base (277)..(277): a, c, t, g, unknown or other
  misc_feature (277)..(277): n is a, c, g, or t
  modified_base (293)..(293): a, c, t, g, unknown or other
  misc_feature (293)..(293): n is a, c, g, or t
  modified_base (340)..(340): a, c, t, g, unknown or other
  misc_feature (340)..(340): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctggaggtgaagaagcctggggcctcagtgaaggtttcctgcaaggcctctggatacaccttcagtgacaatactttgcattgggtncgccaggcccccgganaacgggcttgtttggatgggatggatcaacgctggcaatggtaacanaaaatattacacagaagttccaggcagagtcacatcaaccagggaccacatcccgacgacgcaacaggaccctaacgactgggagttggaaggtcaagcccttaggaacgtaaagtgaaacgtacaacgggtctagtaacttattacgtgtacgacggagaaggggtaatcgggctacccgaaccgaacgggccacgttccggtcccttccccgtcggtacccaccccgttccgtacccgaaccgg

SEQ ID NO: 292908 - DNA, 545 bp, Homo sapiens
  misc_feature: GYAE6OF02FLD4L.52.67.G01.1.454.CMB.1.raw
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgacaatactttgcattgggtgcgccaggcccccggacaagggcttgtttggatgggatggatcaacgctggcaatggtaacacaaaatattacacagaagttcagggcagagtcacatcaccaggacacatccgcgagcacagcctacagtcgggagttggagcagcctaggaagaaatgaaagacacggctagtatattactgtgacgaggagggaatcggacctaccgaaccgaacgggccctagtaccggttccttccccgtggccctaccccgtccctaccaacgg

SEQ ID NO: 292909 - DNA, 565 bp, Homo sapiens
  misc_feature: GYAE6OF02IH2XL.52.67.G01.1.454.CMB.1.raw
  modified_base (292)..(292): a, c, t, g, unknown or other
  misc_feature (292)..(292): n is a, c, g, or t
  modified_base (344)..(344): a, c, t, g, unknown or other
  misc_feature (344)..(344): n is a, c, g, or t
  modified_base (390)..(390): a, c, t, g, unknown or other
  misc_feature (390)..(390): n is a, c, g, or t
  modified_base (537)..(537): a, c, t, g, unknown or other
  misc_feature (537)..(537): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagccgtggggcctcagtgaaggtttcctgcaggcctctggatacaccttcagtgacaatactttgcattgggtgcgccaggcccccgganaagggcttgtttggatgggatggatcaacgctggcaatggtaacacaaaatntacacagaagttccaggcagagtcacatcaccaggacacgatccgngagcaacagcctacatggagtgagcagctagaacgaaatggaaagacgacggactagtaatatttacgtgtagacgaggaaggggtaactcgggaccctaccgaacccgaacgggacccctaaggtcccggtccctttacccccggnggaccctacccctcccgtacccgaacgg

SEQ ID NO: 292910 - DNA, 518 bp, Homo sapiens
  misc_feature: GYAE6OF02F7VNC.52.67.G01.1.454.CMB.1.raw
  modified_base (292)..(292): a, c, t, g, unknown or other
  misc_feature (292)..(292): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgacaatactttgcattgggtgcgccaggcccccgganaagggcttgtttggatgggatggatcaacgctggcaatggtaacacaaaatattcacagaagttccagggcagagtcacatcacaggacacatccgcgagcacagcctacatggagttgagtcagcctgagaaatgaagacacggctagtatattactgtgcgagagggatggacctcgaccaagggcccagtccggtccttccccgtggccaccctcctccaacg

SEQ ID NO: 292911 - DNA, 598 bp, Homo sapiens
  misc_feature: GYAE6OF02F4XHD.52.67.G01.1.454.CMB.1.raw
  modified_base (414)..(414): a, c, t, g, unknown or other
  misc_feature (414)..(414): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctcttttggtggcagcagccacaggtggccactcccaggtccagcttgtgcagtctggggctgaggtgaagaagcctggggcctcagtgaaggtttcctgcaaggcctctggatacaccttcagtgacaatactttgcattgggtgcgccaggccccccggacaacgggcttgtttggatggggatggatcaacgctggcaatggtaacacaaaatatcacagaagttccagggcagagtcaacatcaaccagggaccacactccgacgacgcacacgccctaanagtcgggattggacgcagccctgaagaataggaacgacaacggctagtatacttacgtgtaggacgtaagggaaggggtaactgggacccgtaccgaaacccgtaaacggggccccctaagtcccgggttacccgtttaccccccggtacggaccccctaccccgttaccctaccccgtaacgg

SEQ ID NO: 292912 - DNA, 525 bp, Homo sapiens
  misc_feature: GYAE6OF02JBX7H.52.67.G01.1.454.CMB.1.raw
  modified_base (291)..(291): a, c, t, g, unknown or other
  misc_feature (291)..(291): n is a, c, g, or t
  modified_base (451)..(451): a, c, t, g, unknown or other
  misc_feature (451)..(451): n is a, c, g, or t
  modified_base (468)..(468): a, c, t, g, unknown or other
  misc_feature (468)..(468): n is a, c, g, or t
  modified_base (509)..(509): a, c, t, g, unknown or other
  misc_feature (509)..(509): n is a, c, g, or t
  modified_base (514)..(514): a, c, t, g, unknown or other
  misc_feature (514)..(514): n is a, c, g, or t
  modified_base (520)..(520): a, c, t, g, unknown or other
  misc_feature (520)..(520): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgagaagcctggggcctcagtgaaggtttcctgcaaggcctctggatacaccttcagtgacaatactttgcattgggtgcgccaggcccccgganaaggggcttgtttggatggggatggatcaacgctggcaagtggtaacaacaaaatacttcaacaagaagttccgaggcagagtccacatcaccgaggacacatccgacgagcaaccagcctacagtggagttgagcagcctgagaaatgaagacgacggntagtatattacgtgtgngagagggatggcctacaccgaaggccagtcgtccttcccgngcccncctccncaacg

SEQ ID NO: 292913 - DNA, 543 bp, Homo sapiens
  misc_feature: GYAE6OF02GB03K.52.67.G01.1.454.CMB.1.raw
  modified_base (276)..(276): a, c, t, g, unknown or other
  misc_feature (276)..(276): n is a, c, g, or t
  modified_base (291)..(291): a, c, t, g, unknown or other
  misc_feature (291)..(291): n is a, c, g, or t
  modified_base (410)..(410): a, c, t, g, unknown or other
  misc_feature (410)..(410): n is a, c, g, or t
  modified_base (424)..(424): a, c, t, g, unknown or other
  misc_feature (424)..(424): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgacaatactttgcattgggtncgccaggcccccganaagggcttgttggatgggatggatcaacgctggcaatggtaacacaaaatattcacagaattccaggcagagtcacatcacaggacacatccgacgagcacagcctacatggattggancagcctagagaaangaaagcacggctagtatattacgtgtagacgagaggggaatcgggaccctaccgaaccgaacgggccccaagttccggtacccttcccccggtcggcctacccccgttcaccctaacgg

SEQ ID NO: 292914 - DNA, 542 bp, Homo sapiens
  misc_feature: GYAE6OF02GPLR7.52.67.G01.1.454.CMB.1.raw
  modified_base (346)..(346): a, c, t, g, unknown or other
  misc_feature (346)..(346): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgacaatactttgcattgggtgcgccaggcccccggacaagggcttgtttggagtgggatggatcgaacgctggcaatggtaacacaaaatnttcacagaagttccaggcagatcaccatcaccgagggacacagtccgcgagcacagcctacagtggagttgagcagcctgaagaatgaagacacggctagtatattactgtcgcgaggagggaatcggacctaccgaaccgaacggcccagttcccggtccttcccccgtgtaccctaccccgtccctaccgaacg

SEQ ID NO: 292915 - DNA, 530 bp, Homo sapiens
  misc_feature: GYAE6OF02H29N2.52.67.G01.1.454.CMB.1.raw
  modified_base (344)..(344): a, c, t, g, unknown or other
  misc_feature (344)..(344): n is a, c, g, or t
  modified_base (401)..(401): a, c, t, g, unknown or other
  misc_feature (401)..(401): n is a, c, g, or t
  modified_base (438)..(438): a, c, t, g, unknown or other
  misc_feature (438)..(438): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgacaatactttgcattgggtgcgccaggcccccggacaagggcttgttggatggggatggatcaacgctggcaatggtaacacaaaatnttacacagaagttcaggcagagtcacatcacaggacacatccgcgagcacagcctanagtggagttgagcagcctagagaaatgaagacacggntgtaatattacgtgtagcgagagggaatcggcctacaaccgaagggcccagtccggttaccttccccgtggccctacccgtcctaccgaacg

SEQ ID NO: 292916 - DNA, 659 bp, Homo sapiens
  misc_feature: GYAE6OF02JWLPE.52.67.G01.1.454.CMB.1.raw
  modified_base (274)..(274): a, c, t, g, unknown or other
  misc_feature (274)..(274): n is a, c, g, or t
  modified_base (288)..(288): a, c, t, g, unknown or other
  misc_feature (288)..(288): n is a, c, g, or t
tcagcgcagtacgacacgaccggtgctcgatttagagtatacatattgggtttggggtacccgaacaaccacatccctcctcagaagccccagagcacaacgcctcaccatggactggacctggaggatcctcttttggtggcagcagccacaggtgccactcccaggtccagcttgtgcagtctggggctgaggtgaagagcctggggcctcagtcgaaggtttcctgcaaggcctcgtggataccacttcagtgacatacttgcagttggtncgcacggccccganaacgggcttgttcggatggatggatcgtaacgcgtcggacaagtcggtaacaacgaaaagttacttcaactaacggtaacgtttccgaaggggtacaacggtaacgtcgaacctaacgtacaaccgtacggggaactacgacgtaccgacggaacgacgaacgacgtaccctagacggtacggtacgttagacgcgacgtcgtaacgagaaacgtaggaaacgcgtaacggtaccgtagttaacgtactttaacggtgtacggacgtaagggaacgggtaagtccggacgttaacccggaacgacgggacccttaacggtccgttacccgtccccgtacggtccccgtaacccgtttcccgaccgtaacgg

SEQ ID NO: 292917 - DNA, 566 bp, Homo sapiens
  misc_feature: GYAE6OF02I8092.52.67.G01.1.454.CMB.1.raw
  modified_base (276)..(276): a, c, t, g, unknown or other
  misc_feature (276)..(276): n is a, c, g, or t
  modified_base (293)..(293): a, c, t, g, unknown or other
  misc_feature (293)..(293): n is a, c, g, or t
  modified_base (413)..(413): a, c, t, g, unknown or other
  misc_feature (413)..(413): n is a, c, g, or t
  modified_base (423)..(423): a, c, t, g, unknown or other
  misc_feature (423)..(423): n is a, c, g, or t
  modified_base (446)..(446): a, c, t, g, unknown or other
  misc_feature (446)..(446): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgacaatactttgcattgggtncgccaggccccccgganaagggcttgtttggatgggatggatcgaacgctggcaatggtaacagaaaatattcacagaagttccagggcaagacgtcaaccatacgaccagggacacataccgcgagcacagcctanatggactgancagcctgagaatgaagacacggntgtatattactgtagcgagaggggtaatcggtccctaccgaaccgaaacggggtccccaagttcccggttaccctttccccccgtgggtaccccaccccgttacccgttacccaaacggg

SEQ ID NO: 292918 - DNA, 629 bp, Homo sapiens
  misc_feature: GYAE6OF02J1CM6.52.67.G01.1.454.CMB.1.raw
  modified_base (275)..(275): a, c, t, g, unknown or other
  misc_feature (275)..(275): n is a, c, g, or t
  modified_base (419)..(419): a, c, t, g, unknown or other
  misc_feature (419)..(419): n is a, c, g, or t
tcagcgcagtacgacacgaccggtgctcgatttagagtatacatattgggtttggggacccaacaaccacatccctcctcagaagccccagagcacaacgcctcaccatggactggacctggaggatcctcttttggtggcagcagccacaggtggccactcccaggtccagcttgtgcagtctggggctgaggtgaagagcctggggcctcgagtgaaggtttcctgcaaggcctctggactacaccttcagtgacaatacttagcattgggtncgccacggcccccggacaagggtccttggtttggagttgggatggactcgaacgcgtggctaatgggtaacaacgtaaaatacgttacacaaggtaacgttccgaagggtccaagacggtacaccagtccaaccgaggaaccanacgtccgacgacgccaacgagacctacagtggagttgacgctacggctaggaacgaaatcggaaagacgacggcgttagtactagttaacgtgtacggcggtaaggagggtaactcggtacccgaccgtaaccgaacgggtaccccgtaaggtcccggtttcccgttacccccgtacgtaccccgtacccctaccggtaccctaaacggg

SEQ ID NO: 292919 - DNA, 537 bp, Homo sapiens
  misc_feature: GYAE6OF02FPXFX.52.67.G01.1.454.CMB.1.raw
  modified_base (439)..(439): a, c, t, g, unknown or other
  misc_feature (439)..(439): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgacaatactttgcattgggtgcgccaggcccccggacaagggcttgtttggatggggatggatcaacgctggcaatggtaacacaaaatattcacagaagttccagggcagagtcacatcaccagggacacatccgcgagcacagcctacatggattgagcagcctgagaaatgaagacacggntgtatattactgtgacgaggagggaatcggaccgtccgaccgaacggggcccagttccggtccttcccccgtgggcccaccccgtccgtaccaaccgg

SEQ ID NO: 292920 - DNA, 585 bp, Homo sapiens
  misc_feature: GYAE6OF02GUM6Y.52.67.G01.1.454.CMB.1.raw
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgacaatactttgctattgggtgcgccaggcccccggacaacgggcttgtttggatgggatggatcaacgctggcaatggtaacacaaaatattcaacagaagttcaggacagagtacacatcacgaggacacatccgcagcacacgcctacagtcggagttgaggcaggcctagaagaatagaagacgacggctagtattacttacgtgtagacggagaaggggaatcgggtaccctaccggtaacccgaacggggtacccctacggttacccggttccccgtttcccccggtacggtcccctaccccgttcccgtacccgtaaaccggg

SEQ ID NO: 292921 - DNA, 562 bp, Homo sapiens
  misc_feature: GYAE6OF02HZUNW.52.67.G01.1.454.CMB.1.raw
  modified_base (288)..(288): a, c, t, g, unknown or other
  misc_feature (288)..(288): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacacttcagtgacaatacttgcattgggtgcgcaggcccccganaacgggcttgtttggatggggatggatcaacgctggcaagtggtaacaacaaaatatcaacagaagttcaggcagatcacatcaccaggacacatccgcgagacacagctaacatggagttgaacgcgagctagaagaaatgaagacgaggcgtagtaatattacgtgtggacgaggaaggggtaatgggacctaccgaaccgaacgggtccccgtaagtcccggttaccgttccccccgttaggacccgtaccccgttccctaccgaaaccgg

SEQ ID NO: 292922 - DNA, 575 bp, Homo sapiens
  misc_feature: GYAE6OF02FZUOE.52.67.G01.1.454.CMB.1.raw
  modified_base (414)..(414): a, c, t, g, unknown or other
  misc_feature (414)..(414): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggataccaccttcagtgacaatactttgcattgggtgcgccaggcccccggagaagggcttgtttggatggggatggatcgaacgctgggcaatggtaacaacaaaatattacacaagaagttcagggcagagtcaccatcaccgaggacacatcccgagacgcacagccctanataggagttgagtcagcctgaagtaaatggaaagacacggctagtatattactgtagcgaaggaggggactgggacccgtaccgaaccgaacggggtaccccaacggtccggttcccgttcccccggtaggaccccacccccgttccctacccgtaaccgg

SEQ ID NO: 292923 - DNA, 573 bp, Homo sapiens
  misc_feature: GYAE6OF02H7ZMS.52.67.G01.1.454.CMB.1.raw
  modified_base (294)..(294): a, c, t, g, unknown or other
  misc_feature (294)..(294): n is a, c, g, or t
  modified_base (424)..(424): a, c, t, g, unknown or other
  misc_feature (424)..(424): n is a, c, g, or t
  modified_base (454)..(454): a, c, t, g, unknown or other
  misc_feature (454)..(454): n is a, c, g, or t
  modified_base (505)..(505): a, c, t, g, unknown or other
  misc_feature (505)..(505): n is a, c, g, or t
tcagcgcagtacgacacgaccggtgctcgatttagagtatacatattgggttttgggggacccaacaaccacatccctcctcagaagccccagagcacaaccgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgacatactttgctattgggtgcgccaggcccccgganaagggtcttgttggatgggatggatcaacgcgtaggacgtaatagggtaacaacgtaaaatattacacagtaagttccagggcagagtacaccgatcaccaggacacatccgcgacgacacacgcctaanatacgggagttagacgcagcctagaagaanagagacgacggctagtatattactagtagcgtaaggagggaatcggtaccnccgaaccgacgggaccctagtcccggttcccttaccccgtcgtacccgtcccttaccctactaaccgg

SEQ ID NO: 292924 - DNA, 700 bp, Homo sapiens
  misc_feature: GYAE6OF02G4ORX.52.67.G01.1.454.CMB.1.raw
  modified_base (229)..(229): a, c, t, g, unknown or other
  misc_feature (229)..(229): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttccngcaaggcctctggatacaccttcagtgacaatactttgctagttgggtgcggccgacggccccccggaacgaacggggtctttcggtttggagtggggatggatacaacgcgtaggcaagtaggtaactaacaaaaagtacttacaacgaagaacgtttaccgagggacagagtccaaccaatacaaccgagggaccaacgactcccggacgaacgccaacgacgacctaacgacgtagggtacgttaggacgcgacgccgtagaacgtaaagtaggaaacgaccgaccggtcttaacggttaactacgttttaacgtcggttaggaacgggtaagggaacgggggtaaacgttacgggtaccccgtacccggaacccggaaaccggggtacccctaaccggttacccgggttaccccgtttacccccggtccggtacccccgtaccccgttacccgtacccgtaaaccgg

SEQ ID NO: 292925 - DNA, 681 bp, Homo sapiens
  misc_feature: GYAE6OF02JY1NZ.52.67.G01.1.454.CMB.1.raw
tcagcgcagtacgacacgaccggtgctcgatttagagtatacatattgggtttggggacccgaacaaccacatccctcctcagaagcccccagagcacaacgcctcaccatggactggacctggaggatcctctttttggtggcagcagccacaggtggccactcccaggtccagcttgtgcagtctggggctgaggtgaagaagccgtggggcctcgagtgaagggtttcctggcaaggcctgtggattaccaccttcagtgacaattacttgctattgggtgtcgccgacggcccccggagaacgggtcttggttggagtgggtatgggtatcaacggctgggacaagtggaacactaaaagtacttcaacgaagtaacgtcgagggacaggaacgtcacgtacacgtaccgaggtacacatccgcgagcacacgacctacgattacggagttagacgagtacgaccgtgaaacgaagtacggaaagtacgaccggtacgttagtaacgttaattacgtacggttacggaacggtaacgggtaagggtaacgtacgggtaacccgtacccggtaacccggaaccgggtaccccggtaacggttaccccggtttaccccggtttacccccggtaccgggtaccccttaaccccggttaccccgtacccggttaaacccgg

SEQ ID NO: 292926 - DNA, 720 bp, Homo sapiens
  misc_feature: GYAE6OF02GDYPS.52.67.G01.1.454.CMB.1.raw
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtcccagcttgtgcagtctggggctgaggtgaagaagcctggggcctcagtgaaggtttcctgcaaggcctctggatacaccttcagtgacaatactttgcattgggtgcgccacggcccccggacgaagggccttgtttggagtggggatgggatcgaacggcgtggacaagtggtaaacaactaaaaatacttacaacaaggtaaacgtttaccaaggggacaaggaacgtccaaccataccgaaccgtaacggggaccaacgaacgtcccggacgacgaccaacgacgaccctacacgtagggtagttggaacggcgacgaccgtaggaacgtaaagtaggaaacgaccgaacgggcttaaggttaacttaagtttaacgtttggtacggtacgggtaagggaacgggggttaaactcggggtaacccgttccccggaaaccggtaaaccgggggtaccccctaacggtttccccggggttaccccgttttccccccggtaccgggaccccccttaaccccccgtttccccgtaacccggtaaacccgg

SEQ ID NO: 292927 - DNA, 639 bp, Homo sapiens
  misc_feature: GYAE6OF02JZW5G.52.67.G01.1.454.CMB.1.raw
  modified_base (249)..(249): a, c, t, g, unknown or other
  misc_feature (249)..(249): n is a, c, g, or t
  modified_base (622)..(622): a, c, t, g, unknown or other
  misc_feature (622)..(622): n is a, c, g, or t
tcagcgcagtacgacacgaccggtgctcgatttagagtatacatattgggtttggggacccgaacaaccacatccctcctcagaagccccagagcacaacgcctcaccatggactggacctggaggatcctctttttggtggtcagcagccacaggtggccactcccaggtccagcttgtgcagtctgggctgaggtgaagagccgtggggcctcgagtgaaggtttcctgcgaaggcctctggatacncttcagtgacaatacttgctagttggtcgcgccacggcccccggacgaacgggtcttggtttaggagttacgggagttacggacgtacgtaacggtccgtgggactaaagtacgggtaaacctaacgtaaaacgttattaccgaacgtaacggtaaacgttccgaaggggtcaaggtacgtacaaccgagtacccgaaccagggactaaccgacgtccggacgacgacacgacgcctacgagtcggtagtgagacacgcgtagaagtaataggaacgacgtagacgtagtaattacgttagtgtgaacgagtacgggaatcggtaccacgaccggaggaccctagtacccggtccttccccgaggttaccccncgttacccgtcgaacgg

SEQ ID NO: 292928 - DNA, 592 bp, Homo sapiens
  misc_feature: GYAE6OF02J1TZK.52.67.G01.1.454.CMB.1.raw
  modified_base (289)..(289): a, c, t, g, unknown or other
  misc_feature (289)..(289): n is a, c, g, or t
  modified_base (388)..(388): a, c, t, g, unknown or other
  misc_feature (388)..(388): n is a, c, g, or t
  modified_base (395)..(395): a, c, t, g, unknown or other
  misc_feature (395)..(395): n is a, c, g, or t
  modified_base (406)..(406): a, c, t, g, unknown or other
  misc_feature (406)..(406): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgagagcctgggcctcagtgaaggtttcctgcaaggcctctggactacaccttcagtgacaatactttgcattggtgcgccaggcccccgganaagggcttgtttggatgggatggatcgaacgcgtggcaagtcggtaacaacgaaatattcacgtagaagttccgaggcagacgtcacatcacgaggacncatccgnagcacagctanacgtggagttgagcacgtcctagagtaaatggaaacgacgaccggtctagttaattacgttacctggtacgcggaaggagggtaagtcggtaccgtcccgaaccggaaccgggtacccgtacgttccccgggttacccttccccccggtagggacccctacccccgttccggtaacccctaacggg

SEQ ID NO: 292929 - DNA, 724 bp, Homo sapiens
  misc_feature: GYAE6OF02IJDND.52.67.G01.1.454.CMB.1.raw
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagccgtggggcctcagtggaaggtttcctgcaaggcctcgtggatacaccttcgagtcgaacaatactttgctagttgggtagcgccgaggcccccggacgaagggcttggtttaggagtgggataggatcgaacgtcgtggacaagtaggtaacaacgtaaaatattacaactaaggtaagttacccggaggactaggacggttacactactacgacgacgggtaacacgtactcggacgacgcgtaacgacgtacctaacgagttagggaacggttaggaacgaccgtaggaccctaaggaaacgtaaatacggaaacgaccgtaacggtaccgtagttaacttaacgtttacgtaaggttcgggaacggtaaggggaagggggtaaacgttccggggtaccccttacccggaaaaccgggtacgggaaccccgttaacggttccccgggtttacccttaccccccgggttccgtaaccccggtaccccccgttaccccgtttaaccccgaaaacccggg

SEQ ID NO: 292930 - DNA, 606 bp, Homo sapiens
  misc_feature: GYAE6OF02HY9RM.52.67.G01.1.454.CMB.1.raw
  modified_base (240)..(240): a, c, t, g, unknown or other
  misc_feature (240)..(240): n is a, c, g, or t
  modified_base (275)..(275): a, c, t, g, unknown or other
  misc_feature (275)..(275): n is a, c, g, or t
tcagcgcagtacgacacgaccggtgctcgatttagagtatacatattgggtttggggacccaacaaccacatccctcctcagaagccccagagcacaacgcctcaccatggactggacctggaggatcctcttttggtggcagcagccacaggtggccactcccaggtccagcttgtgcagtcgtgggctgaggtgaaggaagccgtggggcctcagtgtaaggtttcctgcaaggcctntggatacacttcagtgacaatacttgcagtgggtncgcctaggcccccgaagagggtcttgtttgggatgggataggtatcgaacgcgtggacaatggtaaacaacgtaaaatattcaactaggaagttccgagggacaagagtacgacatcacgaggacagaacgtccgacgagacctaagacgcctaacgagtacggtaagttcgaacgccgacgtctagtaagaaagtacgaagaccgtaacgcgtagtactatttagcggtgacgaggaggtaagtcggtaccgtacgtaacaacgggtacccgaagttacggtccccgtttaccccgacgtacccggtaccccttaccgaccgtaaaccgg

SEQ ID NO: 292931 - DNA, 660 bp, Homo sapiens
  misc_feature: GYAE6OF02H2WD4.52.67.G01.1.454.CMB.1.raw
  modified_base (228)..(228): a, c, t, g, unknown or other
  misc_feature (228)..(228): n is a, c, g, or t
  modified_base (252)..(252): a, c, t, g, unknown or other
  misc_feature (252)..(252): n is a, c, g, or t
  modified_base (279)..(279): a, c, t, g, unknown or other
  misc_feature (279)..(279): n is a, c, g, or t
  modified_base (298)..(298): a, c, t, g, unknown or other
  misc_feature (298)..(298): n is a, c, g, or t
  modified_base (532)..(532): a, c, t, g, unknown or other
  misc_feature (532)..(532): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagagcgtgggcctcgagtgaaggtttccngcaggcctcgtggatacacccttnagtgactaattactttgcagttgggtncgccgacggccccccgganaagggtcttgttgggatggggattggactcgaacgcgtggcaagtaggtaaacaactaaaatcttacgaactagtaacgttccgaagggctaaggacgtacaacctacgtacaaccgacgggtacaacgacgtccggacgacgacaaccagtacctacacgtggaagttgacggcacgtcgtacgaagtaaacgagaaacgaccgaacgggtactaggttaatacgtttaacgngggttaacgacgggtaagggaagggtaagtccggtacgttacccgaaccggtaacgggacccttaacgttcccgggttacccttcccccggtaccggccccgtaaccccgttccctaccgaaacccgg

SEQ ID NO: 292932 - DNA, 671 bp, Homo sapiens
  misc_feature: GYAE6OF02IMSUJ.52.67.G01.1.454.CMB.1.raw
  modified_base (280)..(280): a, c, t, g, unknown or other
  misc_feature (280)..(280): n is a, c, g, or t
  modified_base (296)..(296): a, c, t, g, unknown or other
  misc_feature (296)..(296): n is a, c, g, or t
  modified_base (494)..(494): a, c, t, g, unknown or other
  misc_feature (494)..(494): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggactacaccttcagttgacaataactttgcagttgggtncgccaggcccccgganaagggcttaggttcggatgggatggatcaacgctgggcaagtcggtaacacaaaagtattacaacaaggtaacttccgaagggcaaggaagtccaacctatacaaccgaagggacacgataccggcaacggacaccgtagcccgtaacacgttaggacgttaggacgtcaaggtccgtagtaacggaaatcgggaaanaaccgacgggtacctaggtaacttagttaaccgtaggtacggaacggtaaggtaaggggtaacttcgggacccttacccggaaccgtaaccggggtaacccttaacggtttaccccggtcccgtttaccccccggtagggtacccctaaccccgttccccgtaacccgtaaacccgg

SEQ ID NO: 292933 - DNA, 639 bp, Homo sapiens
  misc_feature: GYAE6OF02H2ACD.52.67.G01.1.454.CMB.1.raw
  modified_base (329)..(329): a, c, t, g, unknown or other
  misc_feature (329)..(329): n is a, c, g, or t
  modified_base (350)..(350): a, c, t, g, unknown or other
  misc_feature (350)..(350): n is a, c, g, or t
  modified_base (354)..(354): a, c, t, g, unknown or other
  misc_feature (354)..(354): n is a, c, g, or t
  modified_base (418)..(418): a, c, t, g, unknown or other
  misc_feature (418)..(418): n is a, c, g, or t
tcagcgcagtacgacacgaccggtgctcgatttagagtatacatattgggtttgggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgacaatacctttgctattgggtgcgccagggcccccggacaagggcttgtttcggattgggatggatcaacgntggcaatggtaacataaaatnttanacagagttcagggcagagtcaacatacaccgaggacacgactaccgcgagcaacacggacctanacgtcggagttcgagctacgaccgttagaagtaaaacgtgaaacgaccgacggacgttacggttaacttaacgtttacgttcgggtacgtaccgggaagggtaaggggtaaacgttcgggacccgttaaccggaaacccgtaaccggggtaccctacggttcccggttaccccgtttacccccgtgggaccccctaaccccgttccgtaacccgaaaccgg

SEQ ID NO: 292934 - DNA, 554 bp, Homo sapiens
  misc_feature: GYAE6OF02IYLUF.52.67.G01.1.454.CMB.1.raw
  modified_base (340)..(340): a, c, t, g, unknown or other
  misc_feature (340)..(340): n is a, c, g, or t
  modified_base (391)..(391): a, c, t, g, unknown or other
  misc_feature (391)..(391): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgacaatactttgcattgggtgcgccaggcccccggacaagggccttgtttggagtgggatggatcaacgctggcaatggtaacanaaaatattcacagaagttccaggcagagtcacatcaccaggacacatccgngacgcacagcctacatggagtgagtcgacgcctagaagaaatgaaacgacacggactagtatagttactgtgacgaggtaagggaatcggaccgtaccgaaccgaagggaccctacgtccggttacccgttccccgtaggcccacccgttcccgtaccaacgg

SEQ ID NO: 292935 - DNA, 615 bp, Homo sapiens
  misc_feature: GYAE6OF02JBEV6.52.67.G01.1.454.CMB.1.raw
  modified_base (341)..(341): a, c, t, g, unknown or other
  misc_feature (341)..(341): n is a, c, g, or t
  modified_base (430)..(430): a, c, t, g, unknown or other
  misc_feature (430)..(430): n is a, c, g, or t
  modified_base (459)..(459): a, c, t, g, unknown or other
  misc_feature (459)..(459): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgacaatactttgcattggtgcgccacggcccccggacaagggcttggtttggatgggatggatcgaacgctggacatggtaacaanaaaatattacaactaagaagttccgagggacaggacgtcacctataccaaccgaggaccacgactccgacgacgcaacacgaccctaanacgtaggtagttagagtcacgcctagaanaaagtgaaacgacgacggcttagtaattagttactggtaggacggtaagggaaggggtaatccgggaccctaccggaaccggtaacggggaccctacggttcccggttcccttacccccggttcggaccctacccccgttacctacccgtaaacgg

SEQ ID NO: 292936 - DNA, 662 bp, Homo sapiens
  misc_feature: GYAE6OF02HQOHL.52.67.G01.1.454.CMB.1.raw
  modified_base (229)..(229): a, c, t, g, unknown or other
  misc_feature (229)..(229): n is a, c, g, or t
  modified_base (238)..(238): a, c, t, g, unknown or other
  misc_feature (238)..(238): n is a, c, g, or t
  modified_base (251)..(251): a, c, t, g, unknown or other
  misc_feature (251)..(251): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttccngcaggcctntggatacaccttnagtgacaatactttgcattgggtgcgccaggcccccggacaagggcttgttggatgggatggatcgaacgcgtggcaatggtaacactaaaatacttacaactagtaaagttccgagggtacagacgtacaccatacgaaccgagggacacgactccgacgagacctacacgcctacacgtaggagttgaacgcgacgctaggaaagtaatcggaaagtaccgaacggtcttagtaacttaacgttactggtacggacgaaggggaacggggtaacggttaccgggtccccttaacccgaacccggtaaaaccgggggtcccctaaccggggttacccggttaccccgttttaccccccggtaccgggtacccccttaaccccccgttacccgtaaccccgtaaacccggg

SEQ ID NO: 292937 - DNA, 729 bp, Homo sapiens
  misc_feature: GYAE6OF02JELVJ.52.67.G01.1.454.CMB.1.raw
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctcgtggatacaccttcagtgacaatactttgccttgggtgcgccaggcccccggacaagggcttgtttggagtgggatggatcgaacgcgtggcaatcgggtaaacaacaaaagtacttacgaacaggaacgttccgaagggcaaggacgtcaacgactacaaccgagggaaccacgactcccggacgtaacgccgaacacggaccctaacagtagggtaagttcggaagccgacggccctaggaacgaaataacggaagtaacgaaccgggccttaggtaacttaagttaacgttcggttacggaacgggtaaaccgggtaagggggtaaaacgttccggggtaccccgttaaccccggaaacccgggaaaccggggtacccccgtaaaccgggttaccccgggtttacccccggtttacccccccggttacggggtacccccctaacccccggtttacccccgttacccggaaacccgggttaaccccgg

SEQ ID NO: 292938 - DNA, 721 bp, Homo sapiens
  misc_feature: GYAE6OF02JWA3B.52.67.G01.1.454.CMB.1.raw
tcagcgcagtacgacacgaccggtgctcgatttagagtatacatattgggtttggggacccgaacaaccacatccctcctcagaagcccccagagcacaacgcctcaccatggactggacctggaggatcctctttttggtggcagcagccacaggtggccactcccaggtccagcttgtgcagtctggggctggaggtgaagagccgtggggcctcgagtgaaggtttcctgacaaggcctcgtggatacgaccttagagtcgacaatactttgctagttggttgcgaccgacggcccccggacgaaggctttggttggagtcgggtagtggacgttacgaacggtctgggctaacgtagggtaactaacgaaaattagttactaacgaacgtaacggtttacccgaaggggtaccaaggaacgttccgaaacccgtagttacccaacccggtaacggggaacctaacccgacgtaccggcgtaaccggaccaacgtacgacccgtaactacggtacggtaggtagaacgcgacgtcgtagaaacgaagtcgaaagacgacggtacgtagtaacttacgttaacgtacggtcggtacggaacgggttaagggaacgtcggtacccgtaaccggtaaccgaaacggggtccccaacggtttcccggtacccgttttaccccgaccgggtaaccctcccccggttacccgaccccgtaacgg

SEQ ID NO: 292939 - DNA, 650 bp, Homo sapiens
  misc_feature: GYAE6OF02FQVA0.52.67.G01.1.454.CMB.1.raw
  modified_base (357)..(357): a, c, t, g, unknown or other
  misc_feature (357)..(357): n is a, c, g, or t
  modified_base (494)..(494): a, c, t, g, unknown or other
  misc_feature (494)..(494): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagccgtggggcctcgagtgaaggtttcctgcaaggcctctggatacaccttcagtgacaatactttgctattgggtgcgccaggccccccggagaacgggtcttggtttggagtgggatggatcgaacgtctggacaatggtaacaactaaaatnttacacaagacttcgagggacaggatcacgatcaccgaggacacgatccgacgacgcacgacgcctacagtggagtgacgacacgccgtagaagtaaagtgaaacgtacgacgggtacttagtaattacgtttacgnggttacggacggtaagggaacggggtaacgttccgggacccgttacccggaacccggtaaccggggtacccccgttaacggttcccgggttacccccgtttccccccggttaccggacccccttaacccccgttacccgtaaccccggtaaaccgg

SEQ ID NO: 292940 - DNA, 595 bp, Homo sapiens
  misc_feature: GYAE6OF02F961P.52.67.G01.1.454.CMB.1.raw
  modified_base (276)..(276): a, c, t, g, unknown or other
  misc_feature (276)..(276): n is a, c, g, or t
  modified_base (292)..(292): a, c, t, g, unknown or other
  misc_feature (292)..(292): n is a, c, g, or t
  modified_base (479)..(479): a, c, t, g, unknown or other
  misc_feature (479)..(479): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgagaagcctggggcctcagtgaaggtttcctgcaaggcctctggatacaccttcagtgacaatactttgacattgggtncgccaggcccccgganaagggcttgtttggagtgggatggatcgaacgcgtggctaagtggtaacaacaaaatatacacagaacgttcaggacagacgtcacatacaccgacggacaacacgtccgacgacgacaacacgcctacagtggtagttagagacgagcctagaagaaatagaagacgacggtatagtatattacgngtagacggaagaggggaatcggacccgtaccgaaccggaaccggggaccctacggttaccggtccccgtttacccccggtacggtacccctacccccgtacctacccgtaaccggg

SEQ ID NO: 292941 - DNA, 902 bp, Homo sapiens
  misc_feature: GYAE6OF02GDL9C.52.67.G01.1.454.CMB.1.raw
tcagcgcagtacgacacgaccggtgctcgatttagagtatacatattgggtttggggacccaacaaccacatccctcctcagaagcccccagagcacaacgcctcaccatggactggacctggaggatcctcttttggtggcagcagccacaggtggccactcccaggtccagcttgtgcagtctggggctgaggtgaagaagcctgggctcagtgaaggtttcctgcaaggcctctggatacgaccttcagtgacaatactttgctagttgggtcgcgccgacgggccccccggaagaacgggtctttggtttacgggagttggggattcggggattaccgaaacggtccgttaggggaccgtaaagtacgggttaaaccaaaccgtaaaaaagtttaacgtttaccgaaacgtaaacggtaaacggttttaccccgaaagggggtaccgtaaacggtaacggtttaaccaacccccgtaagtttaacccgaaacccggtaaacggggggaaaccctaaaccgtaaccggttaaccccgggaccggtaaacgggtaccccgaaacccggtaaccgtaccccgttaaaaccgttacggttaccggggtaaacggtttacgggaaccggaccgtaacgggacccgttaagggaaacgttaaaacgttaacggaaaccggtaaccgtaacccggggtactttaacggtttaaacttaaccgtttaaccgttaggttacggacggggtaaacggtaacggggggtaactacgggtaccccgttaaacccggaacccggtaaccggggttaccccgtaacggttaccccgggtttaccccccgttacccccggttaaccggggacccccgtttacccccgttaccccgttaacccgggaaacccgg

SEQ ID NO: 292942 - DNA, 767 bp, Homo sapiens
  misc_feature: GYAE6OF02FU6OT.52.67.G01.1.454.CMB.1.raw
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgacaatactttgctattgggtgtcggccgacggcccccggacaacggggtcttggtttaggagtgggtatggatcgaacgctggcaagtggtaacaactaaaattattacaacaaggtaaacgtttacccgaaggggtacctaagggaacgttaccaaacccgtaacgtaccaaacccggtaaggggaaccaaccgtacgtcccggaccggaacgtaccgaacccgtaacggtacccctaaacgaacgttacgggtaaacggtttcgggaacgaccgtaacggtacccgttaacggaaacggtaaagttaacgggaaaccggaaaccggtaacgggtccgtttaaggttaacgttacgttttaaccgttaggttcggtaccgggaaggtaacggggggtaaacttcgggaaccccgttccgaaaccggtaccggggaccccttaaggtccccggtttacccgttacccccggtccggtaacccctaccccgtacccgtacccgtaaacccgg

SEQ ID NO: 292943 - DNA, 643 bp, Homo sapiens
  misc_feature: GYAE6OF02JF24T.52.67.G01.1.454.CMB.1.raw
  modified_base (293)..(293): a, c, t, g, unknown or other
  misc_feature (293)..(293): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgacaatactttgcattgggtgcgccacggcccccgganaacgggctttgtttggatgggatggatcaacgctggcaagtggtaacaacaaaatattacacaagaagttccgaggacagagtcacatcaccgaggacacgactccgacgacgccaacgacgccctaacgagtacgggtagttcgacgtcgagtacccgtaggaagaaagtacggaaacgaccgaacggtcgtaagttaattacgtttacgtcggtagaacgggtaaggaacggggtaactcgggaccccgttacccggaaccgtaaccgggggtacccctaaggttccccgggttcccgtttacccccggtacggacccctacccccgttacccgtacccgtaaaccgg

SEQ ID NO: 292944 - DNA, 729 bp, Homo sapiens
  misc_feature: GYAE6OF02G5XQI.52.67.G01.1.454.CMB.1.raw
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtcgtggggctgaggtgaagaagccgtggggcctcgagtgtaaggtttcctgcaaggcctcgtggatacaccttcagtgaactaatactttgcattgggtgcgccgacggcccccggacaacggggctttggtttggagtgggagtggactcgaacgtcgtggacaagtggtaaacaactaaaaattattaccaacgaagtaacgttaccgaaggggacagtaacgtaccaaccactaccaaccgacgggtaaccacacgtccgacgacgaccacgacgtacccgtaacagttacgggtagttgacggtacgacgtaccgtagaagaaacgtaggaaacgaccggaacggtacttaagttacgttaacttaacgttcgggttacggaacgggtaacgggaagggggtaaacgttccgggtaccccgttaacccggaacccgggtaaccgggtacccccgtaaccgggtttccccgggtttacccctttacccccccgggttccggtaacccccgtaccccccggttacccctaccccggtaacccgg

SEQ ID NO: 292945 - DNA, 548 bp, Homo sapiens
  misc_feature: GYAE6OF02INW3M.52.67.G01.1.454.CMB.1.raw
  modified_base (398)..(398): a, c, t, g, unknown or other
  misc_feature (398)..(398): n is a, c, g, or t
  modified_base (481)..(481): a, c, t, g, unknown or other
  misc_feature (481)..(481): n is a, c, g, or t
tcagcgcagtacgacacgaccggtgctcgatttagagtatacatattgggtttggggacccaacaaccacatcccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgacaatactttgcattgggtgcgccaggcccccggacaagggcttgtttggatgggatggatcaacgctggacaagtggtaacacgaaaatattacacagaagttccagggcagagtcaccatcacaggacacatccgcgancacacgctacatggagttgagcagcctgaagaatgaagacacgggctagtatagttactgtagacgagagggaatcggtaccnccgaacgaacggcccagtacccggtccttcccccgtggaccctaccccgttaccctacccgtaacgg

SEQ ID NO: 292946 - DNA, 715 bp, Homo sapiens
  misc_feature: GYAE6OF02GJ3OB.52.67.G01.1.454.CMB.1.raw
  modified_base (257)..(257): a, c, t, g, unknown or other
  misc_feature (257)..(257): n is a, c, g, or t
tcagcgcagtacgacacgaccggtgctcgatttagagtatacatattgggtttgggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcgagtgaaggtttcctgcaaggcctctggatacacttcagtnacgtaatactttgctattgggtgtcgccacgggcccccggaacgaacgggtctttcggttagggagttcggggattgggaatcgaacgtcgtagggactaaagttacggtaaacaacgtaaaaattacgttaccaacgtaaggaaacgttacccgaagggtacaaggacgttaccaaccgtaactaccgaaccgaacgggtaccaacacgtaccgacgacgacaacgacggtaccctaagacgttagggacggttaggacgcgacgtacccgttaggaaagtaaaacgtagggtaaacgaaccgacgggtccttaaggttaacctaagtttaaccgtgtaacggacggtaaagggaagggggtaactcggtacccgtaaccgaaccggtaacgggcccctaaggtcccggttacccgttcccccggtacggaccctaccccgtaccgtaccaaaccgg

SEQ ID NO: 292947 - DNA, 576 bp, Homo sapiens
  misc_feature: GYAE6OF02I7AEU.52.67.G01.1.454.CMB.1.raw
  modified_base (291)..(291): a, c, t, g, unknown or other
  misc_feature (291)..(291): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagctggggcctcagtgaaggtttcctgcaaggcctctggatacaccttcagtgacaatactttgcattgggtgcgccaggcccccgganaagggcttgtttggatggggatggatcaacgctgggcaatggtaacacgaaaaatattacaacagaagttccaggggcagagtcacatcaccagggacacgactccgcgagcaacagcctacagtggagttgagacagccgtagaacgaaatggaagtaccgacggcgtagtataacttacgttgtgacgacgaaggggaactggtaccctaccgaccgaacgggcccaagttccggttacccgtttcccccgtacgggaccctaccccgtcctacccgtaacgg

SEQ ID NO: 292948 - DNA, 584 bp, Homo sapiens
  misc_feature: GYAE6OF02G9LJV.52.67.G01.1.454.CMB.1.raw
  modified_base (397)..(397): a, c, t, g, unknown or other
  misc_feature (397)..(397): n is a, c, g, or t
  modified_base (401)..(401): a, c, t, g, unknown or other
  misc_feature (401)..(401): n is a, c, g, or t
  modified_base (404)..(404): a, c, t, g, unknown or other
  misc_feature (404)..(404): n is a, c, g, or t
  modified_base (437)..(437): a, c, t, g, unknown or other
  misc_feature (437)..(437): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgacaatactttgcattgggtgcgccagggccccccggacaaggggccttggtttggatggggatgggatcgaacgctggcaagtggtaacaacaaaatattcaacagaagttccaggcagacgtcacatcaccaggacacanccgngancacagcctacagtggagttgagcagcctagaanaaagtgaagacgaacggctagtattacttactggttagacgaggaaggggtaatcgggaccctccgaaccggaacgggtaccccaacggttcccggttacccgtttcccccgtacggacccctaccccttcccctacccgtaaccgg

SEQ ID NO: 292949 - DNA, 735 bp, Homo sapiens
  misc_feature: GYAE6OF02I38DU.52.67.G01.1.454.CMB.1.raw
tcagcgcagtacgacacgaccggtgctcgatttagagtatacatattgggtttgggacccaacaaccacatccctcctcagaagccccccagagcacaacgcctcaccatggactggacctggaggatcctctttttggtggcagcagccacaggtgccactcccaggtccagcttgtgcagtctggggctgaggtgaagagccgtgggcctcgagtgtaaggtttcctgcaaggcctctggataccgaccttcagtgaactaatactttgactagttgggtcgcgccgacgggccccccggaacaacggggtcttttggtttgggagtggggatgggattacgaacgcgtgggactaagtacggtaaacaacgtaaaaattacttacgaacgtaaggtaaacgttaccgaagggaccgaaggtacgttaccgaaaccctactaaccgaacccggaagggtaaccaacgtacgcccggtacgacgaaccaacgacgtacctacagttaggacgttagacgacagtccgaacggaagaaacgtacggaacggtaacgacggtacgttaggttaacttagttaaccgttagtcgtaacgggaagggtaaacggggtaacgttccggacccgtaacccggaaacccggtaacgggtaccccctaggtttacccccggttccccgtttacccccggtacggtacccccgtacccccgttcccgtaaccccgtaaccggg

SEQ ID NO: 292950 - DNA, 802 bp, Homo sapiens
  misc_feature: GYAE6OF02GDNPS.52.67.G01.1.454.CMB.1.raw
  modified_base (134)..(134): a, c, t, g, unknown or other
  misc_feature (134)..(134): n is a, c, g, or t
  modified_base (268)..(268): a, c, t, g, unknown or other
  misc_feature (268)..(268): n is a, c, g, or t
  modified_base (297)..(297): a, c, t, g, unknown or other
  misc_feature (297)..(297): n is a, c, g, or t
  modified_base (770)..(770): a, c, t, g, unknown or other
  misc_feature (770)..(770): n is a, c, g, or t
tcagcgcagtacgacacgaccggtgctcgatttagagtatacatattgggttgggggaccaacaaccacatccctccgtcaggaagccccagaagctacgaacgcctcaccgactggactggaccttggaggtntcctctttttggtggcagcagccactaggtggccactcccaggtccagccttgtgcagtctcgggctgaggtgacgagcgtgggcctcgagtgaacggttttccagcaacggtcctctggacttaacgcctttntacgtcgacaattacttgactagttgggntacgccgtacgggtcccccggaagaacgggtacttacgggttagggacgtcggggtaccttcgggtaactccggtaaaccgtcgtttacgggacaacgttaccggttaaaccaaccgtaaaacgttcgttaccgaagtaacggtaaacggtttcccggaacgggtacgtaaggacgtttaccggaaccctacgttaccgaaccggttaacggtaccaaccgtacgttaccggacgtacgaacccgacgtacgacccgtaatacggtacgggtaacggttaggcggacctacggtcctttaggaaacgtaagttaaccgaacgtaaccggttacggttcgttaaccggtaacgtttacggttaccgttacgggttacggaccggggtaaagggtaacgggtaagttcccggaacgtaaccccggaaacgggtacggtaccccgaagttttcccgggtccctttaacccccgggnggtaccctacccctttaccgtccgaaacccgg

SEQ ID NO: 292951 - DNA, 596 bp, Homo sapiens
  misc_feature: GYAE6OF02HSJ0J.52.67.G01.1.454.CMB.1.raw
  modified_base (201)..(201): a, c, t, g, unknown or other
  misc_feature (201)..(201): n is a, c, g, or t
  modified_base (379)..(379): a, c, t, g, unknown or other
  misc_feature (379)..(379): n is a, c, g, or t
  modified_base (474)..(474): a, c, t, g, unknown or other
  misc_feature (474)..(474): n is a, c, g, or t
tcagcgcagtacgacacgaccggtgctcgatttagagtatacatattgggtttggggacccaacaaccacatccctcctcagaagcccccagagcacaaacgcctcaccatggactggacctggaggatcctctttttggtggcagcagccacaggtggccactcccaggtccagcttgtgcagtctgggctgaggtgaanaagcctggggcctcagtgaaggtttcctgcaaggcctctggatacaccttcagtgacaattactttgcagttgggtagccgccgacggcccccggacgaacgggcttggttggagtgggatggatcgaacgcgtggcaagtggtaacaacaaaatatcaacagtaagtcgaggcaagngtacacatccacgacggacacactcgaccgagaccacgacgccgtacaggtcggtagtgagtctacgcgttagaagaagtagaacgacggacgtntagtattacgttacgtggtacgacggtaagaggggtaactcggacccgtccgaaccggaaccgggaccctacggttcccgtccttaccccggtcgccccctaccgttccctaccgtaaccgg

SEQ ID NO: 292952 - DNA, 644 bp, Homo sapiens
  misc_feature: GYAE6OF02HG7YI.52.67.G01.1.454.CMB.1.raw
  modified_base (253)..(253): a, c, t, g, unknown or other
  misc_feature (253)..(253): n is a, c, g, or t
  modified_base (258)..(258): a, c, t, g, unknown or other
  misc_feature (258)..(258): n is a, c, g, or t
  modified_base (305)..(305): a, c, t, g, unknown or other
  misc_feature (305)..(305): n is a, c, g, or t
  modified_base (330)..(330): a, c, t, g, unknown or other
  misc_feature (330)..(330): n is a, c, g, or t
  modified_base (344)..(344): a, c, t, g, unknown or other
  misc_feature (344)..(344): n is a, c, g, or t
  modified_base (371)..(371): a, c, t, g, unknown or other
  misc_feature (371)..(371): n is a, c, g, or t
  modified_base (414)..(414): a, c, t, g, unknown or other
  misc_feature (414)..(414): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtcgtggggctgaggtgaagaagcctggggcctcagtgtaaggtttcctggcaaggtcctcgtggactacnccttnagtgaactaattactttgctagttggtgcgccgacggtcccccgganacggtcttggtttcggagtggggtntggatacaacgcgngacagtagtaacaacaaattctacganaagtacgtccgaggtcagcgtacacgataccgacgaggaccanacgtccgcggacaccgacacgtacctacgtgtaggtacgttgaacgtcaggcctagaaggtaatacggaacgaccgaacggtctaaggttattaagttacgttggtacggacggtaagggtaagggtacgtacggtaccccggtacccggtaaacggacccgggttccctaaggttaccccggttcccggttacccccgcggtacccgtccccttaaccgtcccgaacgg

SEQ ID NO: 292953 - DNA, 759 bp, Homo sapiens
  misc_feature: GYAE6OF02J0PWS.52.67.G01.1.454.CMB.1.raw
tcagcgcagtacgacacgaccggtgctcgatttagagtatacatattgggtttggggacccaacaaccacatccctcctcagaagcccccagagcacaacgcctcaccatggactggacctggaggatcctcttttggtggcagcagccacaggtggccactcccaggtccagccttgtgcagtctgggctgaggtgaagagcctgggcctcgagtgaaggtttcctgcaaggtcctcgtggatacaccttcgagtgacaatacttgcagttgggtgcgccgacggcccccggagaacgggtcttggtttggagtggtatggtactacgtaacggtccgtagggtacctaaagttacgggtaaacctaaactaaaaacgtactttacgaacgtaacgtaaacggtttcccgaaggggccaaggtacggttaccaaccgtaactaccggaacccgagggaacctacgacgtacccgcggacgcgaaccgacgtaccctagacggttacgggtaagttacgaagtccgtaccggtaccgttacggaaacgttaaacgaacgggtaaagaacccgtaccgggtacgttaaggtaacgttaacgtttaccgtagtacggtaaccgggtaaggggtaaagggtacgttaccggtaccgtaaccggaacccggtaaccggggtacccctaacgttaccccgggtttacccgttaccccccgggaagttcccccggtaaccccttaccccgtaccggtaaacccgg

SEQ ID NO: 292954 - DNA, 721 bp, Homo sapiens
  misc_feature: GYAE6OF02IISI0.52.67.G01.1.454.CMB.1.raw
  modified_base (283)..(283): a, c, t, g, unknown or other
  misc_feature (283)..(283): n is a, c, g, or t
  modified_base (363)..(363): a, c, t, g, unknown or other
  misc_feature (363)..(363): n is a, c, g, or t
tcagcgcagtacgacacgaccggtgctcgatttagagtatacatattgggtttggggacccaacaaccacatcccctcctcagaagcccccagagcacaacgcctcaccatggactggacctggaggatcctctttttggtggcagcagccacaggtggccactcccacggtccagcttgtgcagtcgtggggctggaggtgaagaagcgtggggcctcgagtgaaggtttcctgcaaggtcctgtaggactacctaccttgaggtgaactaaattacgtttnactagttgggtcgccgcccgacgggcccccggacgaacgggtcgtttggttggagtgggacgtggactcgaacgcgtggnaagtaggtaaacaactaaatatacaacgagacgttacgaggcaagtagtaccactactaccaaccggacggacaccgacgtaccgacgacgacctacgacgtacctaacgtaggtaggttaggttacgacgtaccgacgaccgtaagaaagtaaatacggaaacggtaccggaaccggttacgttaaggttaactaacgtttactagggttacggcggtaaagggaacggggtaagtcccgggtacccgtaacccggtaacccggtaccggggtaaccccgtaccgggttaccccggttacccccgtttcccccggtccgtaccccccgtaccccgttaccccgtacccgtaacccgg

SEQ ID NO: 292955 - DNA, 557 bp, Homo sapiens
  misc_feature: GYAE6OF02F36RZ.52.67.G01.1.454.CMB.1.raw
  modified_base (293)..(293): a, c, t, g, unknown or other
  misc_feature (293)..(293): n is a, c, g, or t
  modified_base (421)..(421): a, c, t, g, unknown or other
  misc_feature (421)..(421): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgagaagcctggggcctcagtgaaggtttcctgcaaggcctctggatacaccttcgagtgacaatactttgcattgggtgcgccaggccccccgganaagggtcttagtttggatcgggatggatccaacgctggcaagttcggtaaacacaaaatcttcaacagtaagttaccagggtcagacgtcacatcacaggacacacgtccgacgagccacagccctanagtggagttgagcagcctgaagaatcgaagacacggctagtaatattactgtcgtcgagacgggaatcggacctcgaacgaacgggacccctagtccggtaccttccccgcggtaccctacccgtccctcaaccgg

SEQ ID NO: 292956 - DNA, 776 bp, Homo sapiens
  misc_feature: GYAE6OF02GC2EN.52.67.G01.1.454.CMB.1.raw
tcagcgcagtacgacacgaccggtgctcgatttagagtatacatattgggtttggggtacccgaacaaccacatccctcctcagaagccccagagcacaacgcctcaccatggactggacctggaggatctcttttggtggcagcagccacaggtggccactcccaggtccagcttgtgtcagtctggggctgaggtgaagaagccttggggacctgagtggaagggtttccaggcgtaaacgggtcctcgtagggactaccgtaaccgtttccgagtcgtaacgtaacttacgttagacttacgttaggtaggtcgtccgacgggcccccggtacgtaacggggtacgttcggtttcggacgtggggtagttcgggtatacgtaacggcgttggacgtaaacgtggtaaacctaactaaaatacgtttacaacgtaaggaacgttacctaacgggacgtaacggaagtaccgaaaccgtagtacccgtaacgaacgggacctaaaccgaacgtttacccgacggtaacgcgaaccgaagtaccctaacgacgtacggacgttaggtacgtggaaccgtcggagtaaacgtaagtacgtaacggaagtaccggagttacgtaagttaacgttaaccgttggtaacggtacgggaagggtaaggggaacggttaccggacccgttaaccgaaccgggtaacggtaacccggtagtaaccgggtttccctacccggttaccggtcccggtaaccccgtacccgttaacccggaaccgg

SEQ ID NO: 292957 - DNA, 595 bp, Homo sapiens
  misc_feature: GYAE6OF02GNG7T.52.67.G01.1.454.CMB.1.raw
tcagcgcagtacgacacgaccggtgctcgatttagagtatacatattgggtttgggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagccgtggggcctcagtgaagggttttcctgcaaggcctctggatacaccttcagtgacaatactttgcattgggtgcgccacggcccccggacaacgggcttggttggatggggtatggatcgaacgcgtggcaatggtaacaacaaaatattacacagaacgttcgagggcagacgtacacatcaacgacgggacacgataccgcgagcaacacgacctaacagtggtagttcgagcagcctagaagaaatagaacgacacggtctagtaattacttacgtgtaggacgtagggaacggggtatcggacccgtacgaacccggtaacgggacccgtacgttcccggttccgtccccgttcggaccccaccccgttaccacccgtaaccgg

SEQ ID NO: 292958 - DNA, 602 bp, Homo sapiens
  misc_feature: GYAE6OF02H4JA2.52.67.G01.1.454.CMB.1.raw
  modified_base (218)..(218): a, c, t, g, unknown or other
  misc_feature (218)..(218): n is a, c, g, or t
  modified_base (258)..(258): a, c, t, g, unknown or other
  misc_feature (258)..(258): n is a, c, g, or t
  modified_base (282)..(282): a, c, t, g, unknown or other
  misc_feature (282)..(282): n is a, c, g, or t
  modified_base (296)..(296): a, c, t, g, unknown or other
  misc_feature (296)..(296): n is a, c, g, or t
  modified_base (334)..(334): a, c, t, g, unknown or other
  misc_feature (334)..(334): n is a, c, g, or t
  modified_base (383)..(383): a, c, t, g, unknown or other
  misc_feature (383)..(383): n is a, c, g, or t
  modified_base (448)..(448): a, c, t, g, unknown or other
  misc_feature (448)..(448): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccgaggtccagcttgtgcagtctggggctgaggtgaacgaagcctggggccctnagtagaaggtttcctggcaaggcctcgtggatacaccttnaagtgacaatacttgctagttggncgcacggccccganaaggcttgttagagtggatcgatcgaacgcgaggcaanagtaaacaacaaaaattattcaacaagtaacgtccaagggcagacgtanaccatcaaccgaggacactagccgacgaaggcaacacaccgtacagtaggaagtttgaagaccgngaccgttagaaagtaaaagagaaacgaaccgaaccggtcgtaagttaataattacgtggtgacgaaggaagggaaacgcgtacccgccaaccgaccgggaacccaacgtccggttaccctaccccggtcgaacccgtaccctacgtaccaacgg

SEQ ID NO: 292959 - DNA, 659 bp, Homo sapiens
  misc_feature: GYAE6OF02GJN4X.52.67.G01.1.454.CMB.1.raw
  modified_base (276)..(276): a, c, t, g, unknown or other
  misc_feature (276)..(276): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagagccgtggggcctcagtgaaggtttcctgcaaggcctctggatacaccttcagtgacaatacttgctattgggtncgccacgggccccccggagaacgggtctttggtttgggagtcggggatggatccgaacgcgtagcaagtggtaacaacaaataatcaacagaacgttacgacgggacagacgtcacatacgacgacggactaacactaccgacgacgacacacgactacacgtacggagtagagacgacgcgtacgagaacgtaagaacgaacgaacggtacgtacgtaagttacgttaacgttacgtacgtacggtacgggtaacgggtaacggtacggtaccggtaacccgtaacccggtaaaccgggacccggtaccggttacccggttacccggttaccccggttacccggtcccgtaaaaaaccccgtccccgtaacccgtaacccgg

SEQ ID NO: 292960 - DNA, 716 bp, Homo sapiens
  misc_feature: GYAE6OF02GQEVX.52.67.G01.1.454.CMB.1.raw
  modified_base (589)..(589): a, c, t, g, unknown or other
  misc_feature (589)..(589): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaacgccgtggggcctcgaggtgaacggtttccgtgcaagggcctgtggatacaccttcagtgactaattacttgctagttggtgaccgccgacggcccccggacgaacgggtctttggttcggagttgggaacgtgggtactacgaacggtctacggactaagtacggtaaacaactaaaatacgttaccaacgtaacgtaacgttacgacggacgtaagacgtaccaccgtaactaccgaaccggtacggaacaacgtaccgtcccggaacgacgaccaccggtaacgaccgtacgacgttacgggtagtacgacggtaccacggtaccgtagaacggtaaatacggaaacgacgacggtaccgtagttaacgttaacttacggttntacgggacgaacgggtaagggaccgttcggacccgtaaccggaacccggtaacggtacccgttaccgttcccgggttaccccgttacccggttaccgacccggtaccccttacccgaccgtaaccgg

SEQ ID NO: 292961 - DNA, 813 bp, Homo sapiens
  misc_feature: GYAE6OF02J15Z0.52.67.G01.1.454.CMB.1.raw
tcagcgcagtacgacacgaccggtgctcgatttagagtatacatattgggtttggggacccaacaaccacatccctcctcagaagcccccagagcacaacgcctcaccatggactggacctggaggatcctctttttggtggcaggcagccacaggtggccactcccaggtccagcttgtgcagtctggggctgaggtagaagaagccgtggggcctcgagtgaaggtttcctgccaagggcctcgtggactacgtaccttcgagttgaactaatactttcgcgtagttgggtcgcgaccgacgggaccccccggagtaacgggtctttacggtttgggacgtaggggtagtacgggtatccgtaaaccggtcgtacggggactaaagtacgggtaaacaaacgtaaaaattacgttacgaacgtaagtaaacgtttccgaagggtacgaaggtacgtaccacgtaactaccgaacgtaaccgggactaacgacgtaccggacgaaccgacgtaaccgacgcccttaaacggagttacggggtaacttacgggaagtaaccggtaccgtaccggttaacggaaaggtaaacgtaacgggtaaaacggaccgtaaccggttaacgttacgtttaaacttaacgtttacccggttaacgggttacggtaaacgggtaaaccggggtaagggttaaccggtcggttaacccggtaacccgtaaacccggacggggtaaccccgttaaacgttcccggtaccccgtttacccccgggcgttaaccccgtaccccggttacccgtacccgtaacccgg

SEQ ID NO: 292962 - DNA, 898 bp, Homo sapiens
  misc_feature: GYAE6OF02JE50Z.52.67.G01.1.454.CMB.1.raw
  modified_base (230)..(230): a, c, t, g, unknown or other
  misc_feature (230)..(230): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacgaggtcggccacctcccaggtccagcttgtgcagtctggggctgaggtgaagagccgtgggctcagtgaaggtttccngcgaaggcctcgtggactaccgtacccttcgaggtacgaactaacttaacgtttcgaccgtaagtttcggggtggtcccggtacccgaccggggtacccccccgggaacgtaaacgggggttcccgttttgggttttacgggggaccggttaacgggggtaattccggggtaagttacccgtaaacggtccggttacgggaacgtaaaccgttaacgggtaaaacctaacgtaaaaacgttaccgttaccaaacgtacggtaaacggtttcccgaaaggggactaaacggtagtaacccgtaacctaacgttaacccgaaacccggtaagggtaacccgaaacgtaaccggtacccgaccggtaaacggtaccgaacccgtacgtaacccgtaacgtaacgttaggggtaacgtttacgggacgtaaccggtaccgaacccgttacgggaaacgttaaaccgaacgggtaaaccggtaaccggacgggttaaccgtaacggttaaagttaccgtttaaacgtcggtaacggtaaccggaacggggtaaaggggtaccgttaccggtacccggtaaccccgaaccggtaccgggtaaccccgtacggttaccggttaccccggtttccccggacccggtaccctaaccccgtaccggtaccgaacccgg

SEQ ID NO: 292963 - DNA, 794 bp, Homo sapiens
  misc_feature: GYAE6OF02IH3JB.52.67.G01.1.454.CMB.1.raw
  modified_base (240)..(240): a, c, t, g, unknown or other
  misc_feature (240)..(240): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtcgtggggctgaggtgaagaagccgtggggcctcgagtgaaggtttcctgcagcctntggactacaccttcagtgaactaattactttgctagttgggtgccgccgacgggaccccccggaagaacggggtctttaggtttcgggaacgttgggggacgttgggacttaccgaacgtccgtagggtactaaacgtaggtaaacaaactaaaagttcgtaacaacgtaagtaacggttccgaaggggacaacggtacgtaccaaccgtaacgtacccgaacccggaacgggaactaaccgtaacgttaccccggacggtaaacgacccgaaaccgtaccggtacccgtaaaccgaggttacggggtaacggtttacggaacggtacccgacggtacccgttaaggaaacggtaaaacgtaacgggaaacgaaccgtaacggggtacctttagggttaaacttacgtttaccgtaggtaccggtaacggaagggtaacggggtaacgtcggtacccgtacccggtaaaccggaacgggtacccctacggttacccggttccccgttccccggtaccggtaccccctaaccccgtcccgttaacccggaaccgg

SEQ ID NO: 292964 - DNA, 680 bp, Homo sapiens
  misc_feature: GYAE6OF02I9SAB.52.67.G01.1.454.CMB.1.raw
  modified_base (237)..(237): a, c, t, g, unknown or other
  misc_feature (237)..(237): n is a, c, g, or t
  modified_base (292)..(292): a, c, t, g, unknown or other
  misc_feature (292)..(292): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctgggctgagtgaagagcctggggcctcaggtgaaggtttcctgcaaggcctntggataccgccttcagtcgacaatacttgctagttggtgcgccacggcccccganacgggtcttggtttcggagtggatggacgtcaacggtcgtgggtactaagttacggtaaacaacgtaaaaagttctaccgaataacggtaacgttaccgaagggtactaaggtacgttacaacgactaccgaccgaacgggtacaacgtacgtaccggacgacgaccaacgacgtaccctagtagtgggagttacgacggtcacggtacctagaaccgtaagtcgaaacgcgtaagtcgtaagtactaacgttccgttaggtacgacggaacgggaaggtaccttcggacccgtacccggaaaccggtacgggtccccttaacggttcccgttaccccggtttaccccgacggtaccccgtaccccgttacccgacccggtaaaccgg

SEQ ID NO: 292965 - DNA, 640 bp, Homo sapiens
  misc_feature: GYAE6OF02I1KDV.52.67.G01.1.454.CMB.1.raw
  modified_base (214)..(214): a, c, t, g, unknown or other
  misc_feature (214)..(214): n is a, c, g, or t
  modified_base (241)..(241): a, c, t, g, unknown or other
  misc_feature (241)..(241): n is a, c, g, or t
  modified_base (251)..(251): a, c, t, g, unknown or other
  misc_feature (251)..(251): n is a, c, g, or t
  modified_base (258)..(258): a, c, t, g, unknown or other
  misc_feature (258)..(258): n is a, c, g, or t
  modified_base (260)..(261): a, c, t, g, unknown or other
  misc_feature (260)..(261): n is a, c, g, or t
  modified_base (295)..(295): a, c, t, g, unknown or other
  misc_feature (295)..(295): n is a, c, g, or t
  modified_base (300)..(300): a, c, t, g, unknown or other
  misc_feature (300)..(300): n is a, c, g, or t
  modified_base (304)..(304): a, c, t, g, unknown or other
  misc_feature (304)..(304): n is a, c, g, or t
  modified_base (316)..(316): a, c, t, g, unknown or other
  misc_feature (316)..(316): n is a, c, g, or t
  modified_base (331)..(331): a, c, t, g, unknown or other
  misc_feature (331)..(331): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagagcctggggcctnagtgagtttcctgcaaggcctgagtanactctgagtnactattntnntgtggcgcgccgaccggccgagacgtcttggtgngtggntganacgacgtgcganagtataacaataatntacagtagtacgcgagagagtacacacacacgacggacgactactcgacgatcgacacgcgtactacgtagtgtagtagcgacgtacgtcgtaaggaaacttaagaacggaaaccgtacggtacggttacgttaagttaaacgtttcgttaaccgttgggacgtaaacgggggaacgggtaacgggtacggtcccgtaccccgtaaacccgggaaccgggttaacccgggtacccgttaccgggttttaccccgttcccccgttaccccgggcctaacccccgttcccgttaaccccggtacgaacccg

SEQ ID NO: 292966 - DNA, 745 bp, Homo sapiens
  misc_feature: GYAE6OF02JO9EO.52.67.G01.1.454.CMB.1.raw
  modified_base (233)..(233): a, c, t, g, unknown or other
  misc_feature (233)..(233): n is a, c, g, or t
  modified_base (254)..(254): a, c, t, g, unknown or other
  misc_feature (254)..(254): n is a, c, g, or t
  modified_base (258)..(258): a, c, t, g, unknown or other
  misc_feature (258)..(258): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctcttttggtggcagcagccacaggtggccactcccgaggtccagcttgtgcagtcgtgggctggaggtagagaacgccgtgggcctcaggtgtaacggttccngacaggcctcgtagactaccncttnagtcaactaattacttgctagttgggtctccgccgacggcccccgagaacggtcgttggttacggagtcgggtatcggactacgaaccgtcgtacggacgtaagttaacggtaaactaacgaaaattacttacgaacgtaaggtaacgttaccgaaggtactaacggaacgtaccaaccgtagtacccgtaaaccggaacgggtaacccaacgtaccgtaccgaacccggacgaaccgacgaacgtacctaacgtagtacgggtaacgttacgacggacaacgtccgaaggaaaccgaaagtcggaacgtaaccgtacgggtacttaagttacgttattaccgggtagtacggaacgggtaagggtaacgggtacttaccggcccggtaaccgtaacccggtaacggtaccccgttacgttaccccgggtcccttaaccccgggtaccggttacccctaacccccggtttacgaacccggtaacccg

SEQ ID NO: 292967 - DNA, 937 bp, Homo sapiens
  misc_feature: GYAE6OF02FIT7O.52.67.G01.1.454.CMB.1.raw
  modified_base (225)..(225): a, c, t, g, unknown or other
  misc_feature (225)..(225): n is a, c, g, or t
tcagcgcagtacgacacgaccggtgctcgatttagagtatacatattgggtttggggacccaacaaccacatccctcctcagaacgcccccagagcacaacgcctcaccatggactggacctgaggatcctcttttggtgcagcagccacaggtgccactcccaggtccagcttgtgcagtcgtgggctgaggtgaagagccgtgggcctcgagtgacggtttcngtacgaacggtccctcgtcggactacctaccttacgaggtacgaactaacttaccgtttggtacgtacggtttggggtcgacccggtccccggaaccggggcccccccgggaacgtaacgggggttccttttacggggttttagggaacgttggggtacgttagggtaacttaccggaaaccggtcgtacgggacctaaacggttaacggtaaaaccctaaacgtaaaaacttacttaaccgaaaccgtaacggtaaacggtttacccggaacggggacgtaacggtacgtacccgaacctaacgttacccgaacccggtaacgggtaaccaaccgtaacgtaccccggacggtaacgacccgaaaccgtccgtaccctaaccggtaacggttaaccggggtaggttacggaaccgggtacccgtaaccggtaccgttaaaggaaacgggtaaacgttaccgggaaacgtaacccggtaaccggttcgtttaaagtttaaccgtttaacgttttacggtacggttaagggtaccgggaaccggggttaaacggggttaacccgtacccgggtaacccccgtaaaccccggtaaccgggaaaccccggggttcccccgttaacgggtttaccccccggtttacccccgtttaaccccccgggttccggtaccccccttacccccccgttaacccggtaccccggtaaacccgg

SEQ ID NO: 292968 - DNA, 795 bp, Homo sapiens
  misc_feature: GYAE6OF02JAICM.52.67.G01.1.454.CMB.1.raw
  modified_base (167)..(167): a, c, t, g, unknown or other
  misc_feature (167)..(167): n is a, c, g, or t
  modified_base (269)..(269): a, c, t, g, unknown or other
  misc_feature (269)..(269): n is a, c, g, or t
tcagcgcagtacgacacgaccggtgctcgatttagagtatacatattgggtttggggacccaacaaccacatccctcctcagaagcccccagagcaacaacgcctcgaccatggactggacctggaggatccctcttttggtggcagcagccacgaggtggccaccncccaggtccagtcttgtgctagtcgtcgggctggtaggtgaagaacgcgtggggcctacgagtgtaaggtttcgtgacgaggcctcgagtactactaccgtnagtacgtaactaagttcttgactagtggtcgtaccgaccggaccggaccccccggtaaggtaacgggttcgtttacgggttacgggtaaggtagggtacgtaggtaccgaacgtacgtcggtacgactaaggtacggtaactaaactaaagttacgttaaccgaacgtaaacggttaacgtaaccggtacgggtacgtaaacggacgtaccgtaaccacgtaacccgaaacgggtaaccgtactacccgtaaccgccgggtaacgaacgtacgaaccgtacggaccctaagacggttagggaaggttccgaggactaccgggttacaaggtaagtacgaaggaacggccgtaacggttactagttaacttacgttaccggtaggtacggtaaggtagggtaacgggtacgttaaccgggccctaaacggtacccgggaaaccgttaccggtacccggtttaccgtacccccggtttacccccggcgggtaccccctttaacccgtaccccggtaaggtaacccccg

SEQ ID NO: 292969 - DNA, 761 bp, Homo sapiens
  misc_feature: GYAE6OF02IOZJF.52.67.G01.1.454.CMB.1.raw
tcagcgcagtacgacacgaccggtgctcgatttagagtatacatattgggtttggggacccaacaaccacatccctcctcagaagcccccagagcacaacgcctcaccatggactggacctggaggatcctcttttggtggcagcagccacaggtggccactcccaggtccagtcttgtgcagtctggggctggaggtgaagaacgcctggggcctcagtgaaggtttcctgcaaggcctctggataccaccttcagtgacaattactttgctagttggggtgtccgaccgacgggaccccccggagaacggggtctttggttttacgggagttggggaacgtggaacgtaccgtaacgtccgtagggtactaagtaacgggttaaacaacgtaaaattacgttaccaacgacggtaaacggtttaccggagggtaccaggtaacgtaccaacctacttaccaaccggacgggtaaccaccgtaacgtccccggacgtacgacaaccgtacgtaccctacgagtacggggtacgtacggacgtccgaacgtccaggaaacgtaagtacggaaacgtaccgtaccggtacgtagtttaattaaccgttagtacggtacggtaacgggaacggtaacggggtaactccgggtacccttaacccggaaccggtaacccggggtacccctaaggttccccgggtttaaccccgttcccccggtaccgggtacccctaccccggtacccggtaaccgtaacccggg

SEQ ID NO: 292970 - DNA, 754 bp, Homo sapiens
  misc_feature: GYAE6OF02JS1BD.52.67.G01.1.454.CMB.1.raw
tcagcgcagtacgacacgaccggtgctcgatttagagtatacatattgggtttggggacccaacaaccacatccctcctcagaagcccccagagcacaacgcctcaccatggactggacctggaggatcctcttttggtggcagcagccacaggtggccactcccaggtccagcttgtcgcagtctggggctgaggtgaagaagccgtggggcctcagtgtaaggttcctgcaaggtcctcgtggataccaccttacagtcgacaattacctttgctagttggtgtccgccgacggcccccggagaacgggtcttcggtttggagttgggtagtggactacgaacgtcgtgactaagtagtaactaactaaaatacgttacaacgtaagtaacgttccgaaggtacagtacgtaccgaacctacgtaccaaccgtacgggaacctaacgtaccgtacccggaaccggacgaccgtaaccgacggtaaccctaacgtaacgtggggtaacgttacggaccgtacgtacggtcccgttaaagggaacgtaaacgtaggaaaacggtaccgaacggtacgtaagtttaacgttaacgttaggttacgtacggtaacgggtaagggtaaacggggtaacgtaccggtacccgtaaccggtaaacccggtaccggtaacccgttaaccggttccccggttacccgtttaccccccggacgtacccccgtaaccccgttacccgtaacccgtaacccggg

SEQ ID NO: 292971 - DNA, 675 bp, Homo sapiens
  misc_feature: GYAE6OF02H6OIR.52.67.G01.1.454.CMB.1.raw
  modified_base (139)..(139): a, c, t, g, unknown or other
  misc_feature (139)..(139): n is a, c, g, or t
  modified_base (230)..(230): a, c, t, g, unknown or other
  misc_feature (230)..(230): n is a, c, g, or t
  modified_base (262)..(262): a, c, t, g, unknown or other
  misc_feature (262)..(262): n is a, c, g, or t
  modified_base (362)..(362): a, c, t, g, unknown or other
  misc_feature (362)..(362): n is a, c, g, or t
  modified_base (367)..(367): a, c, t, g, unknown or other
  misc_feature (367)..(367): n is a, c, g, or t
  modified_base (374)..(374): a, c, t, g, unknown or other
  misc_feature (374)..(374): n is a, c, g, or t
  modified_base (402)..(402): a, c, t, g, unknown or other
  misc_feature (402)..(402): n is a, c, g, or t
  modified_base (430)..(430): a, c, t, g, unknown or other
  misc_feature (430)..(430): n is a, c, g, or t
  modified_base (473)..(473): a, c, t, g, unknown or other
  misc_feature (473)..(473): n is a, c, g, or t
tcagcgcagtacgacacgaccggtgctcgatttagagtatacatattgggtttggggacccaacaaccacatccctcctcagaagccccagagcacaacgcctcaccatggactggacctggaggatcctctttttggnggcagcagccacgaggtggccactcccaggtccagtcttgtgcagtctggggctgaggtgaagagccgtgggcctcagtgtaaggtttccngacgaggcctgtggatacaccgttcagtcaanaattactttgctagttgggtgccgccgacggcccccggtaagaagggtctttggttggacgttagggagtggatcgaacgcgtggacaagtgtaaacaanaaatnttacganagtatcgacggtgagtacgtacacctanaccgaacgcggaacacacgtccgagacnccgacgactacctagacgtggagttagacgtcacgcgtagaanaacgtagaacgacgtacgtcgtagtacgtattacgttcgggacggtaaccggaagggtaaaggggtaccgttaccggtaccccgtaaccgaaacccgggtaaccgggtaacccgttaaccggttaccccggtttccccggttaaccccccggtttccgggaaacccccctttacccttaccccggaaacccggttaaccggg

SEQ ID NO: 292972 - DNA, 802 bp, Homo sapiens
  misc_feature: GYAE6OF02F9DAB.52.67.G01.1.454.CMB.1.raw
  modified_base (216)..(216): a, c, t, g, unknown or other
  misc_feature (216)..(216): n is a, c, g, or t
  modified_base (230)..(230): a, c, t, g, unknown or other
  misc_feature (230)..(230): n is a, c, g, or t
  modified_base (299)..(299): a, c, t, g, unknown or other
  misc_feature (299)..(299): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtcccagcttgtgcagtctggggctgaggtgaagaagcctggggcctnagtgaaggtttccngcaaggcctctggatacaccttcagtgacaattactttgctattgggtgtcgccacggtacccccgganaacgggtcttggtttggagtgggatgggatacgaacgcgtgggtacaagttagggtaaacaacgtaaaaacttattaccaacgaagtaaacggttaccgtaacggggacaaggtaacgtaccgaacctaacgttacccaacccggaaaggggacccaaccgtacgtacccggacggaaccggtccaacgtacggtacccctaaacgtacgtgggtaacgttgggaacgaccgtacggacccgttaagaacgtaaaagtacggaaaacgacccgtaacgggtaccttaggttaaacgtttaacggtttaaaccgtcgggttaggaacggttaaacggggaacgggggtaaacgttccgggtaaccccgttaaccccggaaacccgggtaaaccccgggtaccccgttaacccggggttacccgggtttaccccccgttttaccccccgggtacccgggtaaccccctaccccccggtttaccccgtaacccggtaaaccccggg

SEQ ID NO: 292973 - DNA, 786 bp, Homo sapiens
  misc_feature: GYAE6OF02JYCNV.52.67.G01.1.454.CMB.1.raw
  modified_base (85)..(85): a, c, t, g, unknown or other
  misc_feature (85)..(85): n is a, c, g, or t
  modified_base (565)..(565): a, c, t, g, unknown or other
  misc_feature (565)..(565): n is a, c, g, or t
tcagcgcagtacgacacgaccggtgctcgatttagagtatacatattgggtttggggacccaacaaccacatccctcctcagaancccccagagcacaacgcctcaccatggactggacctggaggatcctcttttggtggcagcagccacaggtggccactcccaggtccagcttgtgcagtcgtcggggctgagggtagaagaagccgtggggctacgagtagtaacggttctcgcaaggtccctcgtggactaccgacctttacagtacaacgaattaccgttttgaccgtaagtttgggggtctccggccccggtaacgggaccccccgggactaaagggggtccttggttttacggggaggttacggggtaacgtgggtaacctacgtaaaccggtccgtaggggaacctaacgtgggttaaaaacacgttaaaagtacttaccgtaacgaaggtaaacggtttacccggagggacgagtagtaccctaccgacgttaccaaccgggtaggaacccactactacccgggtagacggacctaaccggacacccgttaacgngtgggtaaccgtaggtacgaccggacgttaccgacgtaacgtaaacgacgggtaaacaccggtacccgtaggtacgttaaccttaattaaccgtaggtaccgtaaccggtaagggaacggtacggaccggttaaccggcccggaaccgtacggtaaccccggtagtacccggttcccgttcccggaccgtaccccgtaccttacccgtaacggtaacccgg

SEQ ID NO: 292974 - DNA, 800 bp, Homo sapiens
  misc_feature: GYAE6OF02IU3Q0.52.67.G01.1.454.CMB.1.raw
tcagcgcagtacgacacgaccggtgctcgatttagagtatacatattgggtttggggacccaacaaccacatcccctcctcagaagcccccagagcacaacgcctcaccatggactggacctggaggatcctcttttggtggcagcagccacaggtggccactcccaggtccagcttgtgcagtctggggctgaggtgaagaagccgtggggcctcagtgaaggtttcctgcaaggcctctggataccaccttcagtgaacaattacttgcattggggtgcgccacgggccccccggaacgaagggctttggtttggacgttggggatggactcgaaacgtcgtggacaagtaggtaaacaactaaaaattacttacaactaaggaaacgtttaccgacggggacaaggtaacgtaccaacccgaactacccgaaccgaacggggaccaaccgacgtacccggaccgtaacgaccgtaaccgaacgtaccctaaccgaacggttacggtaacggtttacggaacggtaccgaacggtacccgtagggaaaacggtaaaacgttaacgggaaaacgggaacccgtaaccggggtaaccgttaggttaaacttaacgtttaaccgttaggtacggtaacgggtaaggggtaaacgggggtaaacgtacggggtaccccgtaaccggtaaacccggtaaaccggggtaaccccgtaaccggtttacccgggttaacccccgtttcccccggtacccggtacccccgtaacccccgtttacccccggtaaccccgtaaacccgg

SEQ ID NO: 292975 - DNA, 758 bp, Homo sapiens
  misc_feature: GYAE6OF02HVAT5.52.67.G01.1.454.CMB.1.raw
tcagcgcagtacgacacgaccggtgctcgatttagagtatacatattgggtttggggacccaacaaccacatcccctcctcagaagcccccagagcacaacgcctcaccatggactggacctggaggatcctctttttggtggcagcagccacaggtggccactcccaggtccagcttgtgcagtctggggctgaggtgaagaagccgtggggcctcaggttgtaaggtttccgtagacgaacggtcctcgtaggaactacgtaccctttcgagtacgaactaacgttacctttgacgtagtttggggtacggccgcccgaccgggacccccccggaacggaacgggttcgtttaggtttcgggtaggttaggggaacgtggtacttaccgaacggtcgttacggacaagtttacggaaacctaaacgtaaaaacgttacttacgaacgtaagtaacggtttaccgtaaggggacgaacggtacgtaccaccgtaactaccgaaccggacggaaccaaccgtacgtaccggacggacgaaccgtaaccacggtacctaacgtacgtagggtaacgttacgaacggacgtacgccgtaagaagtaaactacggaataccggtaacgacttagtaacttaattcgttacgtacggaggaaggtaagggtaacgtcggacccggtaccgaaccggtaaccggcccgttaacggtccgttaccccgtcccggtaccgaccctaccccgtaccgtaccgaccg

SEQ ID NO: 292976 - DNA, 676 bp, Homo sapiens
  misc_feature: GYAE6OF02H9QRS.52.67.G01.1.454.CMB.1.raw
  modified_base (230)..(230): a, c, t, g, unknown or other
  misc_feature (230)..(230): n is a, c, g, or t
  modified_base (307)..(307): a, c, t, g, unknown or other
  misc_feature (307)..(307): n is a, c, g, or t
  modified_base (557)..(557): a, c, t, g, unknown or other
  misc_feature (557)..(557): n is a, c, g, or t
tcagcgcagtacgacacgaccggtgctcgatttagagtatacatattgggtttgggggacccaacaaccacatccctcctcagaagccccagagcacaacgcctcaccatggactggacctggaggatcctctttttggtggcagcagccacaggtggccactcccaggtccagcttgtgcagtcgtgggctgaggtgaagaagccgtggggcctcagtgaaggtttccngacaacggtcctctggactacaccttcagtgaactaattactttcgactagttgggtgcgaccgacggcccccgganaaggggtctttggttagagtggagtacgggatacgacgtcgtggtactaaagtggtaaacaacgtaaaattacttacgaaacgaagtaaacgttccgaaggggtactaacggaacgtaccacaactaccgaaaccgaggaaccaactacgtccgacgtaccgacgaacgacgaacctacgagtaggtagtacgaacgcgtacgctaagagtaaatagaacgacgtacggtctacgttaattacgttacgnggtaggacggtaagggaagggtaacgtcggtacctaccggaacccgacgggtacccctaagttccccggttacccttccccggacggttacccctaccccgttacccgtacgtaaccgg

SEQ ID NO: 292977 - DNA, 900 bp, Homo sapiens
  misc_feature: GYAE6OF02JWZ0E.52.67.G01.1.454.CMB.1.raw
  modified_base (462)..(462): a, c, t, g, unknown or other
  misc_feature (462)..(462): n is a, c, g, or t
tcagcgcagtacgacacgaccggtgctcgatttagagtatacatattgggtttgggggacccaacaaccacatccctcctcagagcccccagagcacaacgcctcaccatggactggacctggaggatccttcgtttttggtggcagcagccacgaggtggccactcccaggtccagtcttgtgcagtcgtggggctggaggtgaaggacgccgtggggcctcgaggtgtaggtttccgtacggcgaggtccctacgtgggaacttacctaccttacgtagtacgtaacctaactttaccgtttagccgttaagtttcggggtcgtaccggtcccggaacccgggtaccccccgggtaacgtaagggttcccgttttagggtttaccgggtaggttacggggtacggtacggtacggttaacgaaccgacggttacggaccgttaaggtaaccgggttaaanaaaccgttaaaaggttcttaaccggaacgtaacgggttaacggttacccggagggtaacgaacggtaacgtaacgtaaccgacgtaaccgtaacccggggaacgaccgtaagaacccggttcccgaacggtaccggccgtaacgtacccggaccgtaaacgtacgggttacggtacggttacggaaacggtcctaaacgggttaccgaggggtaaaccgaagtaaccggtaacggaaccgttcgggtaagtacggttaacgttacttaaccggttggtaacgggaaccgggtaagggaaccggttacggtaccggtaacccggttaacccggaacccggtaacgggttaccccggttaacgttacccccggggttttacccttacccccgggtaccggttcccccgtaacccccggttacgttaacccggaacccggg

SEQ ID NO: 292978 - DNA, 768 bp, Homo sapiens
  misc_feature: GYAE6OF02F5XZ0.52.67.G01.1.454.CMB.1.raw
  modified_base (214)..(214): a, c, t, g, unknown or other
  misc_feature (214)..(214): n is a, c, g, or t
  modified_base (230)..(230): a, c, t, g, unknown or other
  misc_feature (230)..(230): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagagcctggggcctnagtgaagggttttccngccaaggcctctggatacacctttcagtgacaatactttgcattgggtgcgccaggtcccccggacaacgggtcttcgtttggatgggatgggatcaacgtctggcaagtcggtaacaactaaaagtatttacgaacaacggtaacgtttaccgagggggtactaacggaacggttaccaacccgtattaccgaacccgtaacgggggaacctaaccacgtacccggacggaacggccaaccgacggtaccctaacgacgttagggtaacggttagtacggacgaacggtcccgttaaggaacggtaaaacggtacggtaaaacggaaccggaaccgggtaccgttaagggtttaacgttaacggttttaaccgttaggttaccggtaacggggaacgggtaaacgggggtaacggttcgggtaccccgttaacccgaacccggggtaaccgggtaccccgaacggtttaccccgggttccctttacccccggttaccgggaccccctttaaccccgtcccgttacccgaaacccggg

SEQ ID NO: 292979 - DNA, 690 bp, Homo sapiens
  misc_feature: GYAE6OF02IYR5O.52.67.G01.1.454.CMB.1.raw
  modified_base (185)..(185): a, c, t, g, unknown or other
  misc_feature (185)..(185): n is a, c, g, or t
  modified_base (260)..(260): a, c, t, g, unknown or other
  misc_feature (260)..(260): n is a, c, g, or t
  modified_base (366)..(366): a, c, t, g, unknown or other
  misc_feature (366)..(366): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccatcccaggtccagcttgtgcagtcnggggctgagtgaagtaagccttggggccttcagtgtaaggtttcctgcaaggcctactggactacaccttcagtnacgaatactttgcattgggtgcgccaggcccccggacaagggtcttgtttaggactagggtatggagtcgagcgctagcgaagtggtaacaacgaaaatattacanaacgaagttaccgaacgggtctaaggacgttccgaaccgtaactaaccgtaccgtaacggggactaacgtacgtaccgacggtagactacgacgtacctaacgacgtcggtaagttcgaagacacggacccttaggaacgaaagttacggaaaggaccggtaacggtacctaggttaacgtaacgtttaacgtacggttaacgagggtaaggtaggggaaacgttacgggtccctacccgtaaacggtaaaccgggaacctaccggttacggtttaccgtttaccccccgacggttacccgttacccgtaccccgttaacccgg

SEQ ID NO: 292980 - DNA, 671 bp, Homo sapiens
  misc_feature: GYAE6OF02GQJDZ.52.67.G01.1.454.CMB.1.raw
  modified_base (470)..(470): a, c, t, g, unknown or other
  misc_feature (470)..(470): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtcgtggggctgaggtgaagaagccgtggggcctcgagtgtaaggtttcctgacaaggcctctggatacaccttcagtgaacaattactttgctagttgggtcgcgccgaccgggccccccggagaacgggtctttggtttggagtgggtatgggatcgaacgtcgtggacaagtacggtaaacaaacgtaaaattacttacgaacgaagtaacgttaccgagggtacgagtaagtaccaacacgtcaccgaaggaccacgacgtccgacgacgccacgactacctanagtcggtagtgagcgacgccgtagaactaagtagaacggacgacggtctagtaattacgttagtcgtaggacggtaagggtacggtaagtccggtacccgtaccgaaaccgggtaaccgggtcccctaacggttccccggttacccccgttcccccgggtaccgtacccccgaccccgtttaccccgtaaccgtaacccgg

SEQ ID NO: 292981 - DNA, 670 bp, Homo sapiens
  misc_feature: GYAE6OF02HHVZD.52.67.G01.1.454.CMB.1.raw
  modified_base (388)..(388): a, c, t, g, unknown or other
  misc_feature (388)..(388): n is a, c, g, or t
  modified_base (528)..(528): a, c, t, g, unknown or other
  misc_feature (528)..(528): n is a, c, g, or t
  modified_base (598)..(598): a, c, t, g, unknown or other
  misc_feature (598)..(598): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatccttcttttggtggcagcagccacaggtggccactcccaggtccagcttgtcgcagtcgtggggtctgaggtagaaagaacggtccgtggggacctcgaggtgtaacggtttcctgaccgaaggtcctcgtaggactacctaccttacgaggtcaactaaagttacttttgacgtagttacgggtacgccgacccgtacggacccccggaacgaagggtccgttttaggttcggaggtacggtagtggacttcgaaccgngtgggactaagtacggaaactaacaaaagttacttaccgaaactaaccggtaaaggtttaccaggggtaccagtaacggacctacgaactacgacggtaacgactacgaccgtcgtacgagacgaacgacgacttaaccngtacgtagtcgtagaccgttacgcgtaagaaacgtaagtacgaagacgacgggtctaagtattacgttancgagagaggtacgagtcgtccaacgacgaacgcaacgttcgtcccttccgccgactcccgtcgacctaacgg

SEQ ID NO: 292982 - DNA, 727 bp, Homo sapiens
  misc_feature: GYAE6OF02FS7S5.52.67.G01.1.454.CMB.1.raw
tcagcgcagtacgacacgaccggtgctcgatttagagtatacatattgggtttggggacccaacaaccacatccctcctcagaagcccccagagcacaacgccctcaccatggactggacctggaggatccttcttttttgggtggcagcacgccacaggtggcccactccccaggtccagctttgtgcagtctggggctggaggtgaagaaggccgtggggcctcaggtgaacgggttttcctgacgaaggcccgtctggatactaccttcagtgactaattactttgtctagtttgggtcgcggccgaccgggaccccccgggacgaagggtcctttggtttaggatggatggatcaacgcgtaggacaagttacggtaaacaactaaaattacttacaaccgtagaacgttccgagggcaagacgttaccaaccgaactaccgaaccgacgggaaccaaccgtacgtacccggacgacgaccaccgacgtaccctaacgacgtgggacgttagacgaccacgccgttagaacgtaactacggaacgaccgtaccggtagttacgttaaagtttacgttaccgtgtacggcggtaaggacggggaacgttccggtaccccgtaaccgaacccggtaaccgggccccgttaaccggttccggtttaccccgtttacccccggtaccggtacccccgtaacccccgtacccgttacccgtaaaccgg

SEQ ID NO: 292983 - DNA, 800 bp, Homo sapiens
  misc_feature: GYAE6OF02HVG5P.52.67.G01.1.454.CMB.1.raw
  modified_base (157)..(157): a, c, t, g, unknown or other
  misc_feature (157)..(157): n is a, c, g, or t
  modified_base (235)..(235): a, c, t, g, unknown or other
  misc_feature (235)..(235): n is a, c, g, or t
tcagcgcagtacgacacgaccggtgctcgatttagagtatacatattgggtttggggacccaacaaccacatcccctcctcagaagcccccagagcacaacgcctcaccatggactggacctggaggatcctctttttggtggcagcagccacaggnggccactcccacggtccagcttgtggcagtcgtggggctgagggtgaagaagcctggggcctcagtggaacggtttcngcaggcctcgtaggatacacctcacgtgactaattacttgccagttggggtcgccgacccgacgggaccccccggacgaacggggttcttgggtttggacggtggggtagtggactccgaaccgtcggtaggaccaagtacggttaaacaaacctaaaatacgtttacgaaccgtaaggtaaaccggtttccgagggtaccgtaacggacgttaccgaaccgtaacgtaacccgaaccggacgggtaaaccaccgggtaacgtacccgacgggaacggtaccaaccgacgtaccctacgaacgtacgggtaaggttacggacgtaccggtacggttaccctagggtaaacgtaaaggttacgggaaacgtaaccggtaaaccggcgtttaaacgttacgtttaacgtttaagttcgggtagggtaacgggtaacgggtaacgggggaacgttccggtaccccggtaccgtaaccccggtaacgggtaaccccggttaccgtccccggttaacccgtttccccggaccggtaccccggtaccccctacccgtaccccggtaaacgg

SEQ ID NO: 292984 - DNA, 765 bp, Homo sapiens
  misc_feature: GYAE6OF02GBNVR.52.67.G01.1.454.CMB.1.raw
  modified_base (215)..(215): a, c, t, g, unknown or other
  misc_feature (215)..(215): n is a, c, g, or t
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagccgtgggcctngtgtaacggtttcctgcaaggcctcgtggactacgacctttcgaagtgaacaattacgtttgactattgggtagcgccaggccccccggtaacgaagggtccttggtttaggacgttacgggagttggactccgtaacggcgttaggaccaagttacgggttaaacaacgtaaaaacgtcgttaccaacgtaacggtaacgtttaccgaacggggtactaacggtaacgtacctaacccgaagttcccgaaacccggaacggggtaaccgaaccgtaacggttcccggaaccgaaggtaccaaacgacggtaccctaacgtaacgttcggaaggtttacgaacggtccacggtacctcggtaaacgtaaacgtaacggaagtaaccgacgggtcgtaacggttattaacgttaccgttaggacggttacggaagggtaaggggtaacgtccggtacccgttaaccggaccgtaaacgggtaccccgtagttaccccggttccgtttaccccggtacgacccctaaccccggtacccgtaccgtaaaccgg

SEQ ID NO: 292985 - DNA, 837 bp, Homo sapiens
  misc_feature: GYAE6OF02JAQ2Y.52.67.G01.1.454.CMB.1.raw
tcagcgcagtacgacacgaccggtgctcgatttagagtatacatattgggtttggggacccaacaaccacatccctcctcagaagcccccagagcacaacgcctcaccatggactggacctggaggatccttcttttttggtggcagcagccacagggtggccacctcccacggtccagcttgtgcagtcgtgggctggaggtgaagagcgtgggcctcgagtagtacggttctgacgaggtcctacgtgactacctcctacgagtagactaattacttgacgttagttgggtcgccggcccgtaccggggacccccggaacggaacgggttcgtttggtttagggagttaggggtagtggtacgacgtaaccgcgtaggactaaagttacggtaaaccaaacgtaaaactacgttaccgaaacgtaagtaacgtaccggtacggaacggtaacgtacgtaccaacccgtaatacccggaaccggaacgggtacctaacgaccgtaccggaccgaaggaccctaacgtaaccggacccttaagacggttaacgggtagttacggacgtaccgaacggtcggttaacaaacgggtaaacgtacgggtaaaaccgggacgttaacccgggtagtttaagttaaccttaacgggtttacgttcggtaacgggtaacgggggtaaacgggaagggggttaaccgtacggggaaccccttaacccggggtaacccgtaacccggggtaacccgttaacccggtttaccccgtttaccccccgggttacccccggtacccgttaaccccctacccccggttaccccgtacccggtaaacccgg

SEQ ID NO: 292986 - DNA, 693 bp, Homo sapiens
  misc_feature: GYAE6OF02G17SK.52.67.G01.1.454.CMB.1.raw
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctggaggtgaagaagcctggggcctcagtgaaggtttcctgcaaggcctcgtggactacaccttcagtgactaatactttgctagttgggtgccgccacggcccccggaagtaacgggtcctttaggtttacggagtcggggatgggactcgaacggcgtggtacgaagtcggtaaacaacgtaaaaacttattaccaacgtaacgtaacgtttaccgaagggaacgtagtaccgaactactaccgtaacgacgggtacacacgtacgacgacgacgacacgctaacgtagtacggtagttacgacgaccgacgaccgtagaacgtaagaacgtaacgaccgaacggtaccgttaagtacgtttaacgttaacgttacgtacgggtacggaagggtaacggggaacgttacggtacccgttaaccggaaccggaacggtacccgacgttccgggttacccttcccggtacggcccgtaccccgttacctacccgagtaacccg

SEQ ID NO: 292987 - DNA, 784 bp, Homo sapiens
  misc_feature: GYAE6OF02IDY16.52.67.G01.1.454.CMB.1.raw
  modified_base (139)..(139): a, c, t, g, unknown or other
  misc_feature (139)..(139): n is a, c, g, or t
tcagcgcagtacgacacgaccggtgctcgatttagagtatacatattgggtttggggacccaacaaccacatccctcctcagaagccccagagcacaacgcctcaccatggactggacctggaggatcctctttttggnggcagcagccacaggtggccactcccaggtccagcttgtgcagtcgtggggctgaggtgaagagccgtggggcctgagtggtaaggtttcctggacgaaggtccctgtaggactactacccgtttcgaggttacaactaagttactttggaccgtagtttggggtcgccgaccgtaccgggccccccggaagaacggggttccttttagggttttacgggaacggtttagggggtaagttacgggtacgttaccaacggtcgtacgggtaccaaaaggtacggttaaaaaccaaacgttaaaattacgtacctaaacgacggtaacgttacccgagggtacaggttaagacccaactaactaccgaaccgaacgggacctaacgacgtacccggacggaacgacccgaacgtaccgaaccgtaacgtaacggtaggacggttaggaacgtacgacgacgtagaaagtaagaaggacgtaaccgaggtacgtaacgtagttaacgtttacgtggtacggaacggtagggaacgggacggttaccgtacccgtaccggaaacccggtaccggtaccccgttacggttcccggttaacccgttcccggttacccggtaccccgttaccgtccccgtaacgtaacccgg

SEQ ID NO: 292988 - DNA, 689 bp, Homo sapiens
  misc_feature: GYAE6OF02H13F3.52.67.G01.1.454.CMB.1.raw
  modified_base (265)..(265): a, c, t, g, unknown or other
  misc_feature (265)..(265): n is a, c, g, or t
  modified_base (463)..(463): a, c, t, g, unknown or other
  misc_feature (463)..(463): n is a, c, g, or t
tcagcgcagtacgacacgaccggtgctcgatttagagtatacatattgggtttggggacccaacaaccacatccctcctcagaagccccagagcacaacgcctcaccatggactggacctggaggatcctctttttggtggcagcagccacaggtggccactcccaggtccagcttgtgcagtcgtggggctggaggtgaagagcgtggggcctcgaggtgtaacggtttctgcgaacggtcctcgtaggactacctaccgttanaggtacgaactaattactttgacttaggttgggtcgtaccggcccgtacgggaccccccggaagacgggttactttggttcggagttgggtagtggactcgaacgtcgtcggtacgtaagtacgtaaacgaactaaagttacttacaacgtagtacgtccgaggtacagtacgtaccacataccgaacgacggacacnccgtacgcgacacgaaccgacgtaccgtacgtagtaggtagttacgacgtcgtacgtacgttagaagtaagacgaacgacgacgttactagtaacttacgttacgtaggacgacggtaaggtagggtaacgtccgggtaccgtaaccggtaaccggacggtacccgtacgtttccccgggtaccttaccccggccggttaccccgtacccgttccgaaccgtaacg

SEQ ID NO: 292989 - DNA, 797 bp, Homo sapiens
  misc_feature: GYAE6OF02IA54E.52.67.G01.1.454.CMB.1.raw
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtcgtggggctgaggtgaagaaggccgtggggcctcgaggtgtaaggttttcctggaccgaacgggtcctcgtaggactaacctacccgttcgacgtagaactaattacctttgactagttggggtcgccgtccgaccgggtaccccccggacgtaacggggtcctttggttagggaggttagggagttacgggtaactacggtaacgccgtacggacgtaaagtacggtaaaacaaacgtaaaattacgttaacgaacgtaaggtaacggttaccgaacggggtacgtaacggtacgtaccctaaccgtaactacccgacccggacgggtaaccgaactaccggtaccgacgaacgacccacgaacgtaccgtaacgagttacgggtagtagaccgacgtacgtccgtagaacgtaaagtaggaaacggtaccgtaacggtactagttaacgttaacgttacgtacggtaggtaacgggaagggtacggggtaacgtaccggtacccggtaacccggtaaaccggacccgggttacccgtaccgttaccccggttcccgttacccccgggttccggtaaccccccgtccccgttacccggttacccgaaaccgg

SEQ ID NO: 292990 - DNA, 1038 bp, Homo sapiens
  misc_feature: GYAE6OF02IFFZ5.52.67.G01.1.454.CMB.1.raw
tcagcgcagtacgacacgaccggtgctcgatttagagtatacatattgggtttggggacccaacaaccacatccctcctcagaacgccccagagcacaacgcctcaccatggactggacctggaggatcctctttttggtggcagcagaccacaggtgccactcccaggtccagcttgtgcagtcgtggggctggaggtgaagagccggtgggcctcgaggtaggtaaggtttccctggacgtaacgggtcctacggttacggaattaacccgtaaccctttcgacggtttaacgaaaacttaacgtttaaccgtttttggtaccgttaacggtttaggggggttaccgccggtaccccgggtaacccggggtaacccccccccgggaacggtaacgggggttccgtttttaacggggttttaggggtaacgggtttacggggggaacggttttacggggaaccgttccggtaaaccgttccgggtaacggtaaccgtaaaacggttaaacggttaaaaaccgtaaaaccgtaaaaactttaacgtttaaccggaaaaccgtaggttaaaaccggtttacccggaacggggtacctaaagggtaacccgtttaaccgaacccgtaaacggtccctaaaaccgggtaccgggaacctaaccgtaccgttaacccgggtccggaaacgtcccgaacccgaacgtacgtaaaccgtaccgggtaaggtacgggttacggaaccggtaacctaccggtaaccgtaagggtaaacggttaaaggtaacgggtaaaaccgtaccggtaacgggtttacccgtagtttaaacgtttaaacgttttaccggtacgggttacgaacgggggtttaaacggggaacggggtaaaccggtttaccggttacccgaaaccccgggttaacccgggtaaaaccccgggtccccggttaacgttaccccccgggggttttaccccctacccccggggtttaccccgggaccccttttaaaccccccccggtccgtaacccctaaacccgggg

SEQ ID NO: 292991 - DNA, 796 bp, Homo sapiens
  misc_feature: GYAE6OF02G7BNY.52.67.G01.1.454.CMB.1.raw
tcagcgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtcggccactcccgaggtcctagcttgtgcagtctggggctgaggtagaagaacgccgtggggcctcgagtgtaaggtttccctgacgaacggtccgtcgtagactaccgtaccttacagtacgtactaagttactttcggacctaggttcgggtacgccggtaccgacccgggtacccccggacgaacggggtcgtttcggtttacgggaggtcgggtagtggaacgtccgaaacgtcgtcggaaccaagttacggtaaaccgtaaataaaattctaacgtaacgtaaggttaaccgttacgggaaggcgtaacgtaaccgtacctaaccgtactacgaaccggacggttaccaaccgtaccgtaccgacggaacgtaccgaacgaccgtccttaaaccgagttcgggtaacgtcgtaacgcgacgtactaacggacgtaaacgaggaaacggtaacgaccggtacgttaacgtaacgtttattaacggttacggagtaccggggaaaggtaaccgggggttagtacccggtaccgtacccggaaccgtaaccggggtaaccctacccggtttaccccgttccccggtttaccccgtcccgggttaacccctaccccgttaacccgaacccggtaaccggg

SEQ ID NO: 292992 - DNA, 743 bp, Homo sapiens
  misc_feature: GYAE6OF02HZKEK.52.67.G01.1.454.CMB.1.raw
  modified_base (249)..(249): a, c, t, g, unknown or other
  misc_feature (249)..(249): n is a, c, g, or t
  modified_base (272)..(272): a, c, t, g, unknown or other
  misc_feature (272)..(272): n is a, c, g, or t
  modified_base (278)..(278): a, c, t, g, unknown or other
  misc_feature (278)..(278): n is a, c, g, or t
tcagcgcagtacgacacgaccggtgctcgatttagagtatacatatttggggtttggggacccaacaaccacatcccctcctcagaacgccccagagcacaacgcctcaccatggactggacctggaggattcctctttttggtggcagcagccacgaggtcggccactcccgaggtccagtctttgtagctagtcgtggggctggaggtacgaagaacgccgtgggcctcgaagtgtaaggtttccgngacgagtcctgtgatactacttnaggtanactattacttgactagttggttcgccggaccgaccggtacccccggaacggtaacgggtcgtttacggtttaggtacggtaggtaggttcggaacgtaccgaacggtcgtcggacgtaacgtaaggtaaactaacgtaaaagtcttacgtaactaacgtacggtttccggaaggtacgagtacggtaccaccgaacgtaccgaaccgtacggactaacgaccgtaccgacgacgaccgaaccgcgtactacgtaagtggttacggtagcgacgtacgacgtagtaaacggatacggaagaccgtacggtcgtaaccgttaagtaccgttacgtgtaacgggacggtaaggggtacgtaacggtcgacccggtaacccgtaaccgggtaccggtcccgttaccggtacccgttaccccggttacccggtcccgtaccccgttacccgtacccgtaccgtaacccgg

SEQ ID NO: 292993 - DNA, 780 bp, Homo sapiens
  misc_feature: GYAE6OF02FHE7J.52.67.G01.1.454.CMB.1.raw
  modified_base (193)..(193): a, c, t, g, unknown or other
  misc_feature (193)..(193): n is a, c, g, or t
tcagcgcagtacgacacgaccggtgctcgatttagagtatacatattgggtttggggacccaacaaccacatccctcctcagaagcccccagagcacaacgcctcaccatggactgacctgaggatcctcttttggcgcagcagccacgaggtggccactcccgaggtccagcttgtgcagtcgtgggctggnggtagaacgagccgtagggcctcgagtcgtacggttttcctcgccgaacggtcccttacgtacgggtacttaacctacccgtttacgaacggtacgtaaccgtaaacgttacctttaggtccctaaggtttcggggtcgcccggaccccgggtaaccgggacccccccgggaaacggtaaccgggggttcctttcgggttttacgggacgttgggtaacgtacggtactaccgaaacgtcggtacggactagtacggtaacaacgtaaactcttacgacgtaagtacggttaccgaacggctaacgtacgaccgtacccgtagtacccgtaacggacggtaaccaccgtaccgtacccgacgaacgccctaacgacgtcccctaacgtacggtcggtaacgtacgtacgacacgtaccgtacggtaaagactaggtaaacgccgtacggtatacgttaattacgttacggtcgttacggacgtaacgggaacgggtacacggtacccgtacgaaccggacccgggtacctcggttacccggttccctacccggtcccgaccctacccggttaccgtacccgtaacgg

SEQ ID NO: 292994 - DNA, 210 bp, Homo sapiens
  misc_feature: GYAE6OF01B61D1.35.40.D07.1.454.CMB.1.raw
  modified_base (187)..(210): a, c, t, g, unknown or other
  misc_feature (187)..(210): n is a, c, g, or t
tcagtacagatcgtcacgaccggtgctcgatttagtgatagagcgtaacaacgagagggtgtccttgggtttggggaagaggaagactgacggtccccaggagttcaggtgctggcacagcggcctgggctgcctggtcaaggctacttccacgatctgtactgagcgggctggcaaggcgcatagnnnnnnnnnnnnnnnnnnnnnnnn

SEQ ID NO: 292995 - DNA, 243 bp, Homo sapiens
  misc_feature: GYAE6OF01BFYYZ.35.40.D07.1.454.CMB.1.raw
  modified_base (198)..(210): a, c, t, g, unknown or other
  misc_feature (198)..(210): n is a, c, g, or t
  modified_base (212)..(243): a, c, t, g, unknown or other
  misc_feature (212)..(243): n is a, c, g, or t
tcagtacagatcgtcacgaccggtgctcgatttagtgatagagcggtaaacggaacagtagggtgtccttgggtttgggggaagaggaagactgacggtcccccaggagttcaggtgctgggcacagcggccctgggctgcctggtccaaggactacttccacgatctgtactgagcgggctgggcaaggcgcatagnnnnnnnnnnnnntnnnnnnnnnnnnnnnnnnnnnnnnnnnnnnnn

SEQ ID NO: 292996 - DNA, 192 bp, Homo sapiens
  misc_feature: GYAE6OF01CE3VQ.35.40.D07.1.454.CMB.1.raw
  modified_base (191)..(192): a, c, t, g, unknown or other
  misc_feature (191)..(192): n is a, c, g, or t
tcagtacagatcgtcacgaccggtgctcgatttagtgatagagcgtaacaacagagggtgtccttgggtttgggggaagaggaagactgacggtcccccaggagttcaggtgctgggcacagcggccctgggctgcctggtcaaggactacttccacgatctgtactgagcgggctggcaaggcgcatagnn

SEQ ID NO: 292997 - DNA, 218 bp, Homo sapiens
  misc_feature: GYAE6OF01DCDBE.35.40.D07.1.454.CMB.1.raw
  modified_base (195)..(218): a, c, t, g, unknown or other
  misc_feature (195)..(218): n is a, c, g, or t
tcagtacagatcgtcacgaccggtgctcgatttagtgatagagcgtaacaacaggagggtgtccttgggtttggggggaagaggaagactgacggtccccccaggagttcaaggtgctgggcacagcggccctgggctgcctggtcaaggactacttccacgatctgtactgagcgggctggcaaggcgcatagnnnnnnnnnnnnnnnnnnnnnnnn

SEQ ID NO: 292998 - DNA, 191 bp, Homo sapiens
  misc_feature: GYAE6OF01B071F.35.40.D07.1.454.CMB.1.raw
  modified_base (191)..(191): a, c, t, g, unknown or other
  misc_feature (191)..(191): n is a, c, g, or t
tcagtacagatcgtcacgaccggtgctcgatttagtgatagagcgtaacaacagagggtgtccttgggtttgggggaagaggaagactgacggtcccccaggagttcaggtgctgggcacagcggccctgggctgcctggtcaaggactacttccacgatctgtactgagcgggctggcaaggcgcatagn

SEQ ID NO: 292999 - DNA, 192 bp, Homo sapiens; identical to SEQ ID NO: 292996
  misc_feature: GYAE6OF01D3U72.35.40.D07.1.454.CMB.1.raw
  modified_base (191)..(192): a, c, t, g, unknown or other
  misc_feature (191)..(192): n is a, c, g, or t

SEQ ID NO: 293000 - DNA, 263 bp, Homo sapiens
  misc_feature: GYAE6OF01CCAN7.35.40.D07.1.454.CMB.1.raw
  modified_base (191)..(191): a, c, t, g, unknown or other
  misc_feature (191)..(191): n is a, c, g, or t
  modified_base (198)..(201): a, c, t, g, unknown or other
  misc_feature (198)..(201): n is a, c, g, or t
  modified_base (203)..(263): a, c, t, g, unknown or other
  misc_feature (203)..(263): n is a, c, g, or t
tcagtacagatcgtcacgaccggtgctcgatttagtgatagagcgtaacggaacagagggtgtccttgggtttgggggaagaggaagactcgaccggtcccccaggagttcaggtgctggcacagcggccctgggctgcctgggtcaaggactacttccgacgatctcgtactgagcgggctgcaaggccncgactgnnnngnnnnnnnnnnnnnnnnnnnnnnnnnnnnnnnnnnnnnnnnnnnnnnnnnnnnnnnnnnnnn

SEQ ID NO: 293001 - DNA, 231 bp, Homo sapiens
  misc_feature: GYAE6OF01BTEXZ.35.40.D07.1.454.CMB.1.raw
  modified_base (195)..(200): a, c, t, g, unknown or other
  misc_feature (195)..(200): n is a, c, g, or t
  modified_base (202)..(205): a, c, t, g, unknown or other
  misc_feature (202)..(205): n is a, c, g, or t
  modified_base (207)..(231): a, c, t, g, unknown or other
  misc_feature (207)..(231): n is a, c, g, or t
tcagtacagatcgtcacgaccggtgctcgatttagtgatagagcgtaacaacagagggtgtccttgggttttggggggaagaggaagactgaccggtccccccaggagttcaggtgctgggcacagcggccctgggctgcctggtcaaggactacttccacgatctgtactgagcgggctggcaaggcgcatagnnnnnngnnnngnnnnnnnnnnnnnnnnnnnnnnnnn

SEQ ID NO: 293002 - DNA, 194 bp, Homo sapiens
  misc_feature: GYAE6OF01CT11U.35.40.D07.1.454.CMB.1.raw
  modified_base (192)..(194): a, c, t, g, unknown or other
  misc_feature (192)..(194): n is a, c, g, or t
tcagtacagatcgtcacgaccggtgctcgatttagtgatagagcgtaacaacagagggtgtccttgggtttgggggaagaggaagactgacggtccccccaggagttcaggtgctgggcacagcggccctgggctgcctggtcaaggactacttccacgatctgtactgagcgggctggcaaggcgcatagnnn

SEQ ID NO: 293003 - DNA, 196 bp, Homo sapiens
  misc_feature: GYAE6OF01BWPHQ.35.40.D07.1.454.CMB.1.raw
  modified_base (194)..(196): a, c, t, g, unknown or other
  misc_feature (194)..(196): n is a, c, g, or t
tcagtacagatcgtcacgaccggtgctcgatttagtgatagagcgtaacaacagagggtgtccttgggtttggggggaagaggaagactgaccggtccccccaggagttcaggtgctgggcacagcggccctgggctgcctggtcaaggactacttccacgatctgtactgagcgggctggcaaggcgcatagnnn

SEQ ID NO: 293004 - DNA, 194 bp, Homo sapiens
  misc_feature: GYAE6OF01B4044.35.40.D07.1.454.CMB.1.raw
  modified_base (194)..(194): a, c, t, g, unknown or other
  misc_feature (194)..(194): n is a, c, g, or t
tcagtacagatcgtcacgaccggtgctcgatttagtgatagagcgtaacaacagagggtgtccttgggttttgggggaagaggaagactgaccggtccccccaggagttcaggtgctgggcacagcggccctgggctgcctggtcaaggactacttccacgatctgtactgagcgggctggcaaggcgcatagn

SEQ ID NO: 293005 - DNA, 206 bp, Homo sapiens
  misc_feature: GYAE6OF01D6X8D.35.40.D07.1.454.CMB.1.raw
  modified_base (194)..(206): a, c, t, g, unknown or other
  misc_feature (194)..(206): n is a, c, g, or t
tcagtacagatcgtcacgaccggtgctcgatttagtgatagagcgtaacgaacagagggtgtccttgggtttgggggaagaggaagactgaccggtccccccaggagttcaggtgctgggcacagccggccctgggctcgcctggtcaaggacttacgttccacgctgtactcgagcggctggcaggcgcatgnnnnnnnnnnnnn

SEQ ID NO: 293006 - DNA, 199 bp, Homo sapiens
  misc_feature: GYAE6OF01B18S0.35.40.D07.1.454.CMB.1.raw
  modified_base (195)..(199): a, c, t, g, unknown or other
  misc_feature (195)..(199): n is a, c, g, or t
tcagtacagatcgtcacgaccggtgctcgatttagtgatagagcgtaacaacagagggtgtccttgggttttggggggaagaggaagactgaccggtccccccaggagttcaggtgctgggcacagcggccctgggctgcctggtcaaggactacttccacgatctgtactgagcgggctggcaaggcgcatagnnnnn

SEQ ID NO: 293007 - DNA, 198 bp, Homo sapiens
  misc_feature: GYAE6OF01BR4RN.35.40.D07.1.454.CMB.1.raw
  modified_base (196)..(198): a, c, t, g, unknown or other
  misc_feature (196)..(198): n is a, c, g, or t
tcagtacagatcgtcacgaccggtgctcgatttagtgatagagcgtaacaacagagggtgtccttgggttttggggggaagaggaagactgacggtccccccaggagttcaggtgctgggcacagccggccctgggctgcctggtcaaaggactacttccacgatctgtactgagcgggctggcaaggcgcatagnnn

SEQ ID NO: 293008 - DNA, 210 bp, Homo sapiens
  misc_feature: GYAE6OF01D1C4Z.35.40.D07.1.454.CMB.1.raw
  modified_base (193)..(210): a, c, t, g, unknown or other
  misc_feature (193)..(210): n is a, c, g, or t
tcagtacagatcgtcacgaccggtgctcgatttagtgatagagcgtaacaacagagggtgtccttgggtttgggggaagaggaagactgaccggtccccccaggagttcaggtgctgggcacagcgccctgggctgcctggtcaaggactacttccacgatctgtactggagcgggctggcaaggcgcatagnnnnnnnnnnnnnnnnnn

SEQ ID NO: 293009 - DNA, 191 bp, Homo sapiens; identical to SEQ ID NO: 292998
  misc_feature: GYAE6OF02HVDIB.35.40.D07.1.454.CMB.1.raw
  modified_base (191)..(191): a, c, t, g, unknown or other
  misc_feature (191)..(191): n is a, c, g, or t

SEQ ID NO: 293010 - DNA, 193 bp, Homo sapiens
  misc_feature: GYAE6OF02HS0KB.35.40.D07.1.454.CMB.1.raw
  modified_base (191)..(193): a, c, t, g, unknown or other
  misc_feature (191)..(193): n is a, c, g, or t
tcagtacagatcgtcacgaccggtgctcgatttagtgatagagcgtaacaacagagggtgtccttgggttttggggaagaggaagactgacggtcccccaggagttcaggtgctgggcacagcggccctgggctgcctggtcaaggactacttccacgatctgtactgagcgggctggcaaggcgcatagnnn

SEQ ID NO: 293011 - DNA, 209 bp, Homo sapiens
  misc_feature: GYAE6OF02GNLP1.35.40.D07.1.454.CMB.1.raw
  modified_base (191)..(209): a, c, t, g, unknown or other
  misc_feature (191)..(209): n is a, c, g, or t
tcagtacagatcgtcacgaccggtgctcgatttagtgatagagcgtaacgaacagagggtgtccttgggtttgggggaagaggaagactgacggtcccccaggagttcaggtgctgggcacagcggccctgggctgcctggtcaaggactacttccacgatctgtactgagcggctggcaaggcgcatagnnnnnnnnnnnnnnnnnnn

SEQ ID NO: 293012 - DNA, 194 bp, Homo sapiens
  misc_feature: GYAE6OF02F2WIF.35.40.D07.1.454.CMB.1.raw
  modified_base (191)..(194): a, c, t, g, unknown or other
  misc_feature (191)..(194): n is a, c, g, or t
tcagtacagatcgtcacgaccggtgctcgatttagtgatagagcgtaacaacagagggtgtccttgggtttgggggaagaggaagactgacggtcccccaggagttcaggtgctgggcacagcggccctgggctgcctggtcaaggactacttccacgatctgtactgagcgggctggcaaggcgcatagnnnn

SEQ ID NO: 293013 - DNA, 204 bp, Homo sapiens
  misc_feature: GYAE6OF02GHRST.35.40.D07.1.454.CMB.1.raw
  modified_base (193)..(204): a, c, t, g, unknown or other
  misc_feature (193)..(204): n is a, c, g, or t
tcagtacagatcgtcacgaccggtgctcgatttagtgatagagcgtaacgaacagagggtgtccttgggttttgggggaagaggaagactgacggtcccccaggagttcaggtgctgggcacagcggccctgggctgcctggtcaaggactacttccacgatctgtactgagcgggctggcaaggcgcatagnnnnnnnnnnnn

SEQ ID NO: 293014 - DNA, 199 bp, Homo sapiens
  misc_feature: GYAE6OF02FWSG4.35.40.D07.1.454.CMB.1.raw
  modified_base (192)..(199): a, c, t, g, unknown or other
  misc_feature (192)..(199): n is a, c, g, or t
tcagtacagatcgtcacgaccggtgctcgatttagtgatagagcgtaacgaacagagggtgtccttgggtttgggggaagaggaagactgacggtcccccaggagttcaggtgctgggcacagcggccctgggctgcctggtcaaggactacttccacgatctgtactgagcgggctggcaaggcgcatagnnnnnnnn

SEQ ID NO: 293015 - DNA, 201 bp, Homo sapiens
  misc_feature: GYAE6OF02GNY8F.35.40.D07.1.454.CMB.1.raw
  modified_base (192)..(201): a, c, t, g, unknown or other
  misc_feature (192)..(201): n is a, c, g, or t
tcagtacagatcgtcacgaccggtgctcgatttagtgatagagcgtaacaacagagggtgtccttgggtttgggggaagaggaagactgacggtcccccaggagttcaggtgctgggcacagcggccctgggctgcctggtcaaggactacttccacgatctgtactgagcgggctggcaaggtcgcatagnnnnnnnnnn

SEQ ID NO: 293016 - DNA, 193 bp, Homo sapiens
  misc_feature: GYAE6OF02IIIW3.35.40.D07.1.454.CMB.1.raw
  modified_base (192)..(193): a, c, t, g, unknown or other
  misc_feature (192)..(193): n is a, c, g, or t
tcagtacagatcgtcacgaccggtgctcgatttagtgatagagcgtaacaacagagggtgtccttgggttttgggggaagaggaagactgacggtcccccaggagttcaggtgctgggcacagcggccctgggctgcctggtcaaggactacttccacgatctgtactgagcgggctggcaaggcgcatagnn

SEQ ID NO: 293017 - DNA, 194 bp, Homo sapiens
  misc_feature: GYAE6OF02JD8S9.35.40.D07.1.454.CMB.1.raw
  modified_base (192)..(194): a, c, t, g, unknown or other
  misc_feature (192)..(194): n is a, c, g, or t
tcagtacagatcgtcacgaccggtgctcgatttagtgatagagcgtaacaacagagggtgtccttgggttttgggggaagaggaagactgacggtcccccaggagttcaggtgctgggcacagcggccctgggctgcctggtcaaggactacttccacgatctgtactgagcgggctggcaaggcgcatagnnn

SEQ ID NO: 293018 - DNA, 195 bp, Homo sapiens
  misc_feature: GYAE6OF02IFYY7.35.40.D07.1.454.CMB.1.raw
  modified_base (192)..(195): a, c, t, g, unknown or other
  misc_feature (192)..(195): n is a, c, g, or t
tcagtacagatcgtcacgaccggtgctcgatttagtgatagagcgtaacaacagagggtgtccttgggttttgggggaagaggaagactgacggtcccccaggagttcaggtgctgggcacagcggccctgggctgcctggtcaaggactacttccacgatctgtactgagcgggctggcaaggcgcatagnnnn

SEQ ID NO: 293019 - DNA, 220 bp, Homo sapiens
  misc_feature: GYAE6OF02IA2SB.35.40.D07.1.454.CMB.1.raw
  modified_base (194)..(220): a, c, t, g, unknown or other
  misc_feature (194)..(220): n is a, c, g, or t
tcagtacagatcgtcacgaccggtgctcgatttagtgatagagcgtaacaacgagagggtgtccttgggtttgggggaagaggaagactgacggtcccccaggagttccaggtgctgggcacgagcggccctgggctgcctggtcaaggactacttccacgatctgtactgagcgggctggcaaggcgcatagnnnnnnnnnnnnnnnnnnnnnnnnnnn

SEQ ID NO: 293020 - DNA, 198 bp, Homo sapiens
  misc_feature: GYAE6OF02G0G1T.35.40.D07.1.454.CMB.1.raw
  modified_base (193)..(198): a, c, t, g, unknown or other
  misc_feature (193)..(198): n is a, c, g, or t
tcagtacagatcgtcacgaccggtgctcgatttagtgatagagcgtaacgaacagagggtgtccttgggttttgggggaagaggaagactgacggtcccccaggagttcaggtgctgggcacagcggccctgggctgcctggtcaaggactacttccacgatctgtactgagcgggctggcaaggcgcatagnnnnnn

SEQ ID NO: 293021 - DNA, 210 bp, Homo sapiens
  misc_feature: GYAE6OF02IB2P9.35.40.D07.1.454.CMB.1.raw
  modified_base (192)..(210): a, c, t, g, unknown or other
  misc_feature (192)..(210): n is a, c, g, or t
tcagtacagatcgtcacgaccggtgctcgatttagtgatagagcgtaacaacagagggtgtccttgggttttgggggaagaggaagactgacggtcccccaggagttcaggtgctgggcacagcggccctgggctgcctggtcaaggactacttccacgatctgtactgagcgggctggcaaggcgcatagnnnnnnnnnnnnnnnnnnn

SEQ ID NO: 293022 - DNA, 201 bp, Homo sapiens
  misc_feature: GYAE6OF02FTI8N.35.40.D07.1.454.CMB.1.raw
  modified_base (192)..(201): a, c, t, g, unknown or other
  misc_feature (192)..(201): n is a, c, g, or t
tcagtacagatcgtcacgaccggtgctcgatttagtgatagagcgtaacaacagagggtgtccttgggttttgggggaagaggaagactgacggtcccccaggagttcaggtgctgggcacagcggccctgggctgcctggtcaaggactacttccacgatctgtactgagcgggctggcaaggcgcatagnnnnnnnnnn

SEQ ID NO: 293023 - DNA, 205 bp, Homo sapiens
  misc_feature: GYAE6OF02HVG7U.35.40.D07.1.454.CMB.1.raw
  modified_base (194)..(205): a, c, t, g, unknown or other
  misc_feature (194)..(205): n is a, c, g, or t
tcagtacagatcgtcacgaccggtgctcgatttagtgatagagcgtaacaacagagggtgtccttggggttttggggggaagaggaagactgacggtccccccaggagttcaggtgctgggcacagcggccctgggctgcctggtcaaggactacttccacgatctgtactgagcgggctggcaaggcgcatgnnnnnnnnnnnn

SEQ ID NO: 293024 - DNA, 409 bp, Homo sapiens
  misc_feature: GYAE6OF01A2HKQ.11.26.C04.1.454.CMB.1.raw
  modified_base (403)..(409): a, c, t, g, unknown or other
  misc_feature (403)..(409): n is a, c, g, or t
tcagcgagagataccacgaccggtgctcgatttagtctagcgactttgggtttgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttccccctggcgccctgctccaggagcacctccgagagcacagcggccctgggctgcctggtcaaggctacttccgtatctctcgctgagcgggctggcaaggcgcatagnnnnnnn

SEQ ID NO: 293025 - DNA, 460 bp, Homo sapiens
  misc_feature: GYAE6OF01BWXC9.11.26.C04.1.454.CMB.1.raw
  modified_base (455)..(460): a, c, t, g, unknown or other
  misc_feature (455)..(460): n is a, c, g, or t
tcagcgagagataccacgaccggtgctcgatttagtctagcgactttgggtttgggggaagaggaagactgacggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggccctgggctgcctggtcaaggactacttccgtatctctcgctgagcgggctggcaaggcgcatagnnnnnn

SEQ ID NO: 293026 - DNA, 461 bp, Homo sapiens
  misc_feature: GYAE6OF01E4VRX.11.26.C04.1.454.CMB.1.raw
  modified_base (459)..(461): a, c, t, g, unknown or other
  misc_feature (459)..(461): n is a, c, g, or t
tcagcgagagataccacgaccggtgctcgatttagtctagcgactttgggttgggggagaggaaggactgacggtccgtccaggctccagggaaggggcgtggagtgggtggccaacattaaagccagatggaggtgtaaaacgagtatgtaggactctgtggagggccggttcaccatctccagagacaacgccaagaatgcgatatatctacagatgaacagcctgcgagccgaggacacggctgtgtattactgtggggatccctggctggcacctgtatccgaccgttggagtcagggaactctggtcaccgtctcctcagcctccaccaagggcccatcggtctcccctggcgccctgctccaggagcacctccgagagcacagcggccctgggctgcctggtcaaggactacttccgtatctctcgctgacgcgggctggcaaggcgcatagnnn

SEQ ID NO: 293027 - DNA, 409 bp, Homo sapiens
  misc_feature: GYAE6OF01ETZIF.11.26.C04.1.454.CMB.1.raw
  modified_base (403)..(409): a, c, t, g, unknown or other
  misc_feature (403)..(409): n is a, c, g, or t
tcagcgagagataccacgaccggtgctcgatttagtctagcgactttgggtttgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttccccctggcgccctgctccaggagcacctccgagagcacagcggccctgggctgcctggtcaaggactactccgtatctctcgctgagcgggctggcaaggcgcatagnnnnnnn

SEQ ID NO: 293028 - DNA, 408 bp, Homo sapiens
  misc_feature: GYAE6OF01AZZWH.11.26.C04.1.454.CMB.1.raw
  modified_base (405)..(408): a, c, t, g, unknown or other
  misc_feature (405)..(408): n is a, c, g, or t
tcagcgagagataccacgaccggtgctcgatttagtctagcgactttgggtttgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggactctggtcaccgtctcctcagcctccaccaagggcccatcggtcttccccctggccgccctgctccaggagcacctccgagagcacagcggccctgggctgcctggtcaaggctacttccgtatctctcgctgagcggggctgggcaaggcgcatagnnnn

SEQ ID NO: 293029 - DNA, 466 bp, Homo sapiens
  misc_feature: GYAE6OF01A6N5F.11.26.C04.1.454.CMB.1.raw
  modified_base (457)..(466): a, c, t, g, unknown or other
  misc_feature (457)..(466): n is a, c, g, or t
tcagcgagagataccacgaccggtgctcgatttagtctagcgactttgggtttggggggaagaggaagactgacggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttccccctggccgccctgctccaggagcacctccgagagcacagcggccctgggctgcctggtcaaggctacttccgtatctctcgctgagcgggctggcaaggcgcatagnnnnnnnnnn

SEQ ID NO: 293030 - DNA, 461 bp, Homo sapiens
  misc_feature: GYAE6OF01EZR3A.11.26.C04.1.454.CMB.1.raw
  modified_base (368)..(368): a, c, t, g, unknown or other
  misc_feature (368)..(368): n is a, c, g, or t
  modified_base (456)..(461): a, c, t, g, unknown or other
  misc_feature (456)..(461): n is a, c, g, or t
tcagcgagagataccacgaccggtgctcgatttagtctagcgactttgggtttggggggaagaggaagactgacggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtggggatccctggctggcacctgtatccgaccgttggagtcagggaactctggtcaccgtctcctcagcctccaccaaggcccatcggtcttcccctggcgccctgctccaggngcacctccgagagcacagccggccctgggctgcctggtcaaggactacttccgtatctctcgctgagcgggctggcaaggcgcatagnnnnnn

SEQ ID NO: 293031 - DNA, 472 bp, Homo sapiens
  misc_feature: GYAE6OF01EMIJX.11.26.C04.1.454.CMB.1.raw
  modified_base (143)..(143): a, c, t, g, unknown or other
  misc_feature (143)..(143): n is a, c, g, or t
  modified_base (354)..(354): a, c, t, g, unknown or other
  misc_feature (354)..(354): n is a, c, g, or t
  modified_base (367)..(367): a, c, t, g, unknown or other
  misc_feature (367)..(367): n is a, c, g, or t
  modified_base (466)..(472): a, c, t, g, unknown or other
  misc_feature (466)..(472): n is a, c, g, or t
tcagcgagagataccacgaccggtgctcgatttagtctagcgactttgggtttggggggaagaggaagactgacggtccgccaggctccagggaaggggctggagtgggtggccaacataaagccagatggaggtgtaaaacngtatgtagactctgtggagggccggttcaccatctccagagacaacgccaagaatgcgatatatctacagatgaacagcctgcgagccgaggacacggctgtgtattactgtgggatccctggctggcacctgtatccgaccgttggagtcagggaactctggtcaccgtctcctcagcctccaccaaggcccatcggtcttcccctggcnccctgctccaggncacctcgagagcacagccggccctcgggctcggccctgggtcaacgggacttaacttccgtatcctcctcgctgagcgggctggcaaggcgacagtagnnnnnnn

SEQ ID NO: 293032 - DNA, 468 bp, Homo sapiens
  misc_feature: GYAE6OF01DP8HQ.11.26.C04.1.454.CMB.1.raw
  modified_base (460)..(460): a, c, t, g, unknown or other
  misc_feature (460)..(460): n is a, c, g, or t
  modified_base (465)..(468): a, c, t, g, unknown or other
  misc_feature (465)..(468): n is a, c, g, or t
tcagcgagagataccacgaccggtgctcgatttagtctagcgactttgggtttgggggaagaggaagactgacggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtggggagtccctggctggcacctgtatccgaccgttggagtcagggaactctggtcaccgtctcctcacgcctccaccaacgggcccatccggtcttccccctggcgccctgctccaggagccacctccgagacgcacagccggccctggggctgccctggtcaaaggctacttccgtatcctctcgctgagcgggctggcaaggcncatgnnnn

SEQ ID NO: 293033 - DNA, 525 bp, Homo sapiens
  misc_feature: GYAE6OF01DXTON.11.26.C04.1.454.CMB.1.raw
  modified_base (503)..(525): a, c, t, g, unknown or other
  misc_feature (503)..(525): n is a, c, g, or t
tcagcgagagataccacgaccggtgctcgatttagtctagcgactttgggtttggggggaagaggaagactgacggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggatccctggctggcacctgtatccgaccgttggagtcgaggactcgtggtcaccgtctcctcacgcctccaccgaacggcccagtccggtccttccccctggccgccctgcctccgaggacgccacccgtccgagacgcacgacgccggcccgtgggcctcggccgtgggtacaagggtacccttaacgttcccgtatcctctcgctggacggccgggctgggaccgaagggtccgactagtacgnnnnnnnnnnnnnnnnnnnnnnn

SEQ ID NO: 293034 - DNA, 508 bp, Homo sapiens
  misc_feature: GYAE6OF01BBNSK.11.26.C04.1.454.CMB.1.raw
  modified_base (145)..(145): a, c, t, g, unknown or other
  misc_feature (145)..(145): n is a, c, g, or t
  modified_base (355)..(355): a, c, t, g, unknown or other
  misc_feature (355)..(355): n is a, c, g, or t
  modified_base (484)..(486): a, c, t, g, unknown or other
  misc_feature (484)..(486): n is a, c, g, or t
  modified_base (488)..(508): a, c, t, g, unknown or other
  misc_feature (488)..(508): n is a, c, g, or t
tcagcgagagataccacgaccggtgctcgatttagtctagcgactttgggtttgggggaagaggaagactagacggtcccgccaggctccagggaaggggctggagtgggtggccaacataaaagccagatggaggtgtaaaacngttatgtagactctgtggagggccggttcaccatctccagagacaacgccaagaatgcgatatatctacagatgaacagcctgcgagccgaggacacggctgtgtattactgtgggatccctggctggcacctgtatccgaccggttggagtcgaggggaactctggtcaccgtctcctcagcctccaccacgggcccatcgtcctcccngcgcctgctccaggcgcaccctcgagacgcacgagccggccctggggctgccgtggtacgaaggtaccctacgttcccgtatcctcgtcgtctggacggcgggtctggacgtaagggccgacagtgacnnncnnnnnnnnnnnnnnnnnnnnn

SEQ ID NO: 293035 - DNA, 488 bp, Homo sapiens
  misc_feature: GYAE6OF01B9RLI.11.26.C04.1.454.CMB.1.raw
  modified_base (400)..(400): a, c, t, g, unknown or other
  misc_feature (400)..(400): n is a, c, g, or t
  modified_base (473)..(473): a, c, t, g, unknown or other
  misc_feature (473)..(473): n is a, c, g, or t
  modified_base (480)..(488): a, c, t, g, unknown or other
  misc_feature (480)..(488): n is a, c, g, or t
tcagcgagagataccacgaccggtgctcgatttagtctagcgactttgggtttggggggaagaggaagactgacggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactggtggggatccctggctggcacctgtatccgaccgttggagtcagggactctggtcaccgtctcctcacgcctccaccgaacgggcccagtccggtccttccccctggccgccctcgctcccgaggacgccacctccgagacgcacngccggcccgtgggctggcctggtcaaggtactaccttccgtatctctcgtctggagcggcgtggcgaaggcgntatagcnnnnnnnnn

SEQ ID NO: 293036 - DNA, 648 bp, Homo sapiens
  misc_feature: GYAE6OF01CQ74I.11.26.C04.1.454.CMB.1.raw
  modified_base (140)..(140): a, c, t, g, unknown or other
  misc_feature (140)..(140): n is a, c, g, or t
  modified_base (251)..(251): a, c, t, g, unknown or other
  misc_feature (251)..(251): n is a, c, g, or t
  modified_base (639)..(639): a, c, t, g, unknown or other
  misc_feature (639)..(639): n is a, c, g, or t
  modified_base (642)..(642): a, c, t, g, unknown or other
  misc_feature (642)..(642): n is a, c, g, or t
  modified_base (644)..(644): a, c, t, g, unknown or other
  misc_feature (644)..(644): n is a, c, g, or t
tcagcgagagataccacgaccggtgctcgatttagtctagcgactttgggtttgggggaagaggaagactgacggtccgccaggctccagggaagggctggagtgggtgccaacataaagccagatggaggtgtaaaacngtatgtagactctggtggagggccgttcaccatctccagagacaacgccaagaatgcgatatatctacagatgaacagcctgcgagccgaggacacggctgtgtattacgnggtgggactccctggctggcacctgtatccgaccgttggagtcagggaactctggtcaccgtctcctcagcctccacgaaggcccagtcggtccttcccctggccgccctgcctccgaggacgccaaccgtccgagacgtccgacgaacgccggcccgtgggccttcggcccgtacggggttacaaaacggggtacccttaaccgttttacccggtaacgttccgttacccgttccgggaccgttacgggaaccggtcccgggggtaccgtttacggggacccgaaaaccggggggtcccgaaccgtaaacggtttaacggacggaccgacgtcgtacgacgtcgtcgcgacgacgacgtacgacgtcgacgtacgacgtacgacgancgngngtcg

SEQ ID NO: 293037 - DNA, 562 bp, Homo sapiens
  misc_feature: GYAE6OF01A1530.11.26.C04.1.454.CMB.1.raw
  modified_base (531)..(535): a, c, t, g, unknown or other
  misc_feature (531)..(535): n is a, c, g, or t
  modified_base (537)..(562): a, c, t, g, unknown or other
  misc_feature (537)..(562): n is a, c, g, or t
tcagcgagagataccacgaccggtgctcgatttagtctagcgactttgggtttgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactggtgggagtccctggctggcacctgtatccgaccgttggagtcagggactctggtccaccgtctcctcacgccctaccacccaacggggcccagtccgggttccctttcccccctgggccccgcccctcgcctcccgacgggacgccaccctccggaagacgccaaccgacggcccgggccccgtggggcctcggcccgttggggtaccgaaacgggtaacccttaaccgttttcccggtaactttcccttccgtccggtccgtacgggtacgggtccggggggtccgttacggggacccgtaaagggggccccgtacgtaagttaggcannnnncnnnnnnnnnnnnnnnnnnnnnnnnnn

SEQ ID NO: 293038 - DNA, 549 bp, Homo sapiens
  misc_feature: GYAE6OF01DB6D3.11.26.C04.1.454.CMB.1.raw
  modified_base (221)..(221): a, c, t, g, unknown or other
  misc_feature (221)..(221): n is a, c, g, or t
  modified_base (525)..(528): a, c, t, g, unknown or other
  misc_feature (525)..(528): n is a, c, g, or t
  modified_base (531)..(534): a, c, t, g, unknown or other
  misc_feature (531)..(534): n is a, c, g, or t
  modified_base (536)..(538): a, c, t, g, unknown or other
  misc_feature (536)..(538): n is a, c, g, or t
  modified_base (540)..(549): a, c, t, g, unknown or other
  misc_feature (540)..(549): n is a, c, g, or t
tcagcgagagataccacgaccggtgctcgatttagtctagcgacttttgggtttggggggaagaggaagactgacggtccgccaggctccagggaaggggctggagtgggtggccaacataaagccagatggaggtgtaaaacagtatgtagactctgtggagggccggttcaccatctccagagacaacgccaagaatgcgatatatctacagatgaacngcctgcgagccgaggacacggctgtgtattactggtgggactccgtggctggccactgtactccgacgttggagtcaggactcgtgtcaccgtctctcagcctaccaccaacgggcccagtcccggtccttcccccgtggccgtcccctgacctccgacggacgccacccgtccgacgacgtcaacgtacggccggtcccgtggggcctcgcccgttgggtaccaaacgggtaccttacgttccgtaattcctcgtcgtcgtaggacgccgggtactggacgtaacggcgacgaataggcagcnnnngtnnnncnnncnnnnnnnnnn

SEQ ID NO: 293039 - DNA, 658 bp, Homo sapiens
  misc_feature: GYAE6OF01D9QXV.11.26.C04.1.454.CMB.1.raw
  modified_base (149)..(149): a, c, t, g, unknown or other
  misc_feature (149)..(149): n is a, c, g, or t
  modified_base (225)..(225): a, c, t, g, unknown or other
  misc_feature (225)..(225): n is a, c, g, or t
  modified_base (627)..(627): a, c, t, g, unknown or other
  misc_feature (627)..(627): n is a, c, g, or t
  modified_base (632)..(632): a, c, t, g, unknown or other
  misc_feature (632)..(632): n is a, c, g, or t
  modified_base (636)..(658): a, c, t, g, unknown or other
  misc_feature (636)..(658): n is a, c, g, or t
tcagcgagagataccacgaccggtgctcgatttagtctagcgacttttggggtttgggggggaagaggaagactgacggtccgccaggctccaggggaaggggctgggagtgggtggccaaacataaagccagatggaggtgtaaaacngtatgtagactctgtggagggccgttcaccatctccagagacaacgccaagaatgcgatatatctacagatgaacncgcctgcgagccgaaggacacggtctgtgttattacgtggtgggactcccgtggctcggctaccgtgtacctccggtacggttggtagtacggagggtacctcgtcggtaccgtaccgttcctccctcgtaccgtccctacccgaaccgaaccgggcccctacggttcccggttccccgtttcccccgtggccccgtccccgtcggtcccgtacccggaacgggcctaccccgtacccggtacccggaacgggaccgtaccgaaccggtaccgggccccggggtcccgtcggggtcctccgggtaccggttacgggaaccgtaacggttaccctttacccggttcgtaccttccgttacgtccgtaggttcgacgggtccggcgtcggaccgtaggccgtanagtgnacgnnnnnnnnnnnnnnnnnnnnnnn

SEQ ID NO: 293040 - DNA, 374 bp, Homo sapiens
  misc_feature: GYAE6OF01DQKFG.11.26.C04.1.454.CMB.1.raw
  modified_base (368)..(374): a, c, t, g, unknown or other
  misc_feature (368)..(374): n is a, c, g, or t
tcagcgagagataccacgaccggtgctcgatttagtctagcgactttgggtttgggtgccgaagttgctggagggccggttcaccatctccagagacaacgccaagaatgcgatatatctacagatgaacagcctgcgagccgaggacacggctgtgtattactgtgggagtccctggctggcacctgtatccgaccgttggagtcagggactctggtcaccgtctcctcagcctccaccaagggcccatcggtccttcccctggcgccctgctccaggagcacctccgagagcacacgccggcctggactgcctggcaaggactacttccgtatctctcgctgagcgggctggacaaggcgcatagnnnnnnn

SEQ ID NO: 293041 - DNA, 601 bp, Homo sapiens
  misc_feature: GYAE6OF01EWN8V.11.26.C04.1.454.CMB.1.raw
  modified_base (322)..(322): a, c, t, g, unknown or other
  misc_feature (322)..(322): n is a, c, g, or t
  modified_base (576)..(576): a, c, t, g, unknown or other
  misc_feature (576)..(576): n is a, c, g, or t
  modified_base (578)..(578): a, c, t, g, unknown or other
  misc_feature (578)..(578): n is a, c, g, or t
  modified_base (580)..(601): a, c, t, g, unknown or other
  misc_feature (580)..(601): n is a, c, g, or t
tcagcgagagataccacgaccggtgctcgatttagtctagcgactttgggtttggggggaagaggaagactgacggtccgccaggctccagggaaggggctggagtgggtggccaacataaaagccagatggaggtgtaaaacagtatgtagactctgtggagggccggttcaccatctccagagacaacgccaaagaatgcgatatatctacagatgaacagcctgcgagccgaggacacggctgtgtattacgtggtgggagtcccctggctggcacctgtactccgaccgtttggagtcgagggtaactcgtggtaccnccggttctcctcacgccctcccaccgaacggccctacgttccggtccctttccccccgtcggccgtcccctggcccttcccgaagggaccgccgtacccgtcccggaggacgcccgaacgacggccgggtccccgtgggccgtcggtcccgtcggtaccgaaacggggtacccttacgttccgttacgttcccttcgtccgaccgttcgacggcgggtccgttcggaccgaacggcgtaccgtagtacggacgngngnnnnnnnnnnnnnnnnnnnnnn

SEQ ID NO: 293042 - DNA, 509 bp, Homo sapiens
  misc_feature: GYAE6OF01CQAM6.11.26.C04.1.454.CMB.1.raw
  modified_base (222)..(222): a, c, t, g, unknown or other
  misc_feature (222)..(222): n is a, c, g, or t
  modified_base (256)..(256): a, c, t, g, unknown or other
  misc_feature (256)..(256): n is a, c, g, or t
  modified_base (370)..(370): a, c, t, g, unknown or other
  misc_feature (370)..(370): n is a, c, g, or t
  modified_base (382)..(382): a, c, t, g, unknown or other
  misc_feature (382)..(382): n is a, c, g, or t
  modified_base (483)..(483): a, c, t, g, unknown or other
  misc_feature (483)..(483): n is a, c, g, or t
  modified_base (488)..(501): a, c, t, g, unknown or other
  misc_feature (488)..(501): n is a, c, g, or t
  modified_base (503)..(505): a, c, t, g, unknown or other
  misc_feature (503)..(505): n is a, c, g, or t
  modified_base (507)..(509): a, c, t, g, unknown or other
  misc_feature (507)..(509): n is a, c, g, or t
tcagcgagagataccacgaccggtgctcgatttagtctagcgactttgggtttggggggaagaggaagactgacggtccgccaggctccagggaaggggctggagtgggtggccaacataaagccagatggaggtgtaaaacagtatgtagactctgtgggacgggccggttcaccatctccagagacaacgccaaagatgcgatatatctacagatgaacngcctgcgagccgaggacacggctgtgtaattacnggtggggatccctggctggcacctgtatccgaccgttggagtcagggaactctggtcaacgtctcctcagcctccaccaaggcccatcgtacttcccctgccgcctgctcagancgacctccgagncacgagcggcctgggctcgcctgtcaaaggacttaccgtcgtaacgtctctacgtctgtaaggcggggaccttggaccgaaaggccgtaccgaatagagcntacgnnnnnnnnnnnnnncnnncnnn

SEQ ID NO: 293043 - DNA, 582 bp, Homo sapiens
  misc_feature: GYAE6OF01BJBZZ.11.26.C04.1.454.CMB.1.raw
  modified_base (190)..(190): a, c, t, g, unknown or other
  misc_feature (190)..(190): n is a, c, g, or t
  modified_base (266)..(266): a, c, t, g, unknown or other
  misc_feature (266)..(266): n is a, c, g, or t
  modified_base (390)..(390): a, c, t, g, unknown or other
  misc_feature (390)..(390): n is a, c, g, or t
  modified_base (557)..(557): a, c, t, g, unknown or other
  misc_feature (557)..(557): n is a, c, g, or t
  modified_base (559)..(559): a, c, t, g, unknown or other
  misc_feature (559)..(559): n is a, c, g, or t
  modified_base (562)..(562): a, c, t, g, unknown or other
  misc_feature (562)..(562): n is a, c, g, or t
  modified_base (565)..(582): a, c, t, g, unknown or other
  misc_feature (565)..(582): n is a, c, g, or t
tcagcgagagataccacgaccggtgctcgatttagtctagcgactttggggtttgggggggaagaggaagactgacggtccgccaggctccaggggaaggggctggagtggggtggccaacataaagccagatggaggtagtaaaaacagtatgtagactctgtgggagggccggttcaccatctcaganacaacgccaagaatgcgatatatctaacagatgaacagcctgcgacgccgaaggaccaggtctgtagttattacgnggtagggctcccgtggctggccacctgtacgtccgacggtttggagtcgagggactcgtcggtctaccgtcctcctcacgtccctacccaaccgaacggcccctagtccgtccctttcccccgnggtccccgcccgtgccctacggacggtacgcccaccgtccggagccgaccgaacgcggtccggcccgtgggcctcgtccgtggtaaccgaagttacctccgttaccgtacttcgtccgtcgtcgtcgacggccgggtacgtacggacgaacggcgttacaggtactncnagncgnnnnnnnnnnnnnnnnnn

SEQ ID NO: 293044 - DNA, 636 bp, Homo sapiens
  misc_feature: GYAE6OF01CIPIR.11.26.C04.1.454.CMB.1.raw
  modified_base (149)..(149): a, c, t, g, unknown or other
  misc_feature (149)..(149): n is a, c, g, or t
  modified_base (223)..(223): a, c, t, g, unknown or other
  misc_feature (223)..(223): n is a, c, g, or t
  modified_base (606)..(606): a, c, t, g, unknown or other
  misc_feature (606)..(606): n is a, c, g, or t
  modified_base (610)..(610): a, c, t, g, unknown or other
  misc_feature (610)..(610): n is a, c, g, or t
  modified_base (612)..(612): a, c, t, g, unknown or other
  misc_feature (612)..(612): n is a, c, g, or t
  modified_base (614)..(616): a, c, t, g, unknown or other
  misc_feature (614)..(616): n is a, c, g, or t
  modified_base (618)..(620): a, c, t, g, unknown or other
  misc_feature (618)..(620): n is a, c, g, or t
  modified_base (624)..(636): a, c, t, g, unknown or other
  misc_feature (624)..(636): n is a, c, g, or t
tcagcgagagataccacgaccggtgctcgatttagtctagcgacttttggggtttggggggaagaggaagactgacggtccgccaggctccgagggaaggggctgggagtggggtggccaacataaagccagatggaggtagtaaaacngtatgtagctctgtggagggccgttcaccatctcagagacaacgacaagatgcgatatatctacagtatgaacngtcctgacgagcgaaggacacggtctgtagtattacgtggtggggactccgtggctggctacgtgtacgtccgacggttggagtcgagggtactcgtggtccaccgtctccgtacaccgtccctaccaacggacggcccctacgttcccgtcccgttcccccgtgggtccctcccgtcgtccgtacccggaaggtaccgccgacccgtacggaacgaccgaccgaccggacgggcccgggtccccggtgggtacccttcggtacccgttcggtaacgtaaacgggtaccctttacgtttacccggtaactccgttaccggtccgtcgggtaggaccgggtcgggtaccgtacgggaccgggttaaggccgtaacgacgtagcnctancncnnncnnngcgnnnnnnnnnnnnn

SEQ ID NO: 293045 - DNA, 425 bp, Homo sapiens
  misc_feature: GYAE6OF01DSKK8.11.26.C04.1.454.CMB.1.raw
  modified_base (214)..(214): a, c, t, g, unknown or other
  misc_feature (214)..(214): n is a, c, g, or t
  modified_base (307)..(307): a, c, t, g, unknown or other
  misc_feature (307)..(307): n is a, c, g, or t
  modified_base (357)..(357): a, c, t, g, unknown or other
  misc_feature (357)..(357): n is a, c, g, or t
  modified_base (387)..(387): a, c, t, g, unknown or other
  misc_feature (387)..(387): n is a, c, g, or t
  modified_base (392)..(392): a, c, t, g, unknown or other
  misc_feature (392)..(392): n is a, c, g, or t
  modified_base (395)..(425): a, c, t, g, unknown or other
  misc_feature (395)..(425): n is a, c, g, or t
tcagcgagagataccacgaccggtgctcgatttagtctagcgactttgggtttgggtgccgaagttgctggagggccggttcaccatctccagagacaacgccaagaatgcgatatatctacagatgaacagcctgcgagccgaggacacggctgtgtattactgtgggagtccctggctggcacctgtactccgacgttggagtcagggactntggtccaccgtctcctcacgcctccaccgaacggccactccggtccttccccgtgccgcccctgctccgaggacgccacctccgagacgccanacgccggcctgggcctgcctggacaaggactaccttcgtatcctcgtcgntcgacggcgggtcgtcggacgaaggccganaatgnacnnnnnnnnnnnnnnnnnnnnnnnnnnnnnnn

SEQ ID NO: 293046 - DNA, 769 bp, Homo sapiens
  misc_feature: GYAE6OF01DZD3W.11.26.C04.1.454.CMB.1.raw
  modified_base (116)..(116): a, c, t, g, unknown or other
  misc_feature (116)..(116): n is a, c, g, or t
  modified_base (142)..(142): a, c, t, g, unknown or other
  misc_feature (142)..(142): n is a, c, g, or t
  modified_base (272)..(272): a, c, t, g, unknown or other
  misc_feature (272)..(272): n is a, c, g, or t
  modified_base (535)..(535): a, c, t, g, unknown or other
  misc_feature (535)..(535): n is a, c, g, or t
  modified_base (721)..(721): a, c, t, g, unknown or other
  misc_feature (721)..(721): n is a, c, g, or t
  modified_base (728)..(728): a, c, t, g, unknown or other
  misc_feature (728)..(728): n is a, c, g, or t
  modified_base (730)..(730): a, c, t, g, unknown or other
  misc_feature (730)..(730): n is a, c, g, or t
  modified_base (733)..(733): a, c, t, g, unknown or other
  misc_feature (733)..(733): n is a, c, g, or t
  modified_base (761)..(761): a, c, t, g, unknown or other
  misc_feature (761)..(761): n is a, c, g, or t
  modified_base (763)..(763): a, c, t, g, unknown or other
  misc_feature (763)..(763): n is a, c, g, or t
tcagcgagagataccacgaccggtgctcgatttagtctagcgactttgggtttggggggaagaggaagactgacggtccgccaggctccgagggaagggctggagtgggtgccaanataaagccagatggaggtgtaaaacngtatgtagactctggtggagggccgttcaccatctccagagacaacgcaaagatgacgaatatatctaacagtatagaacagcctaggcgacggccggaaggacacggtcttagttagttaacttacggngggtacggggtaccgttcccgtgggaccgttacgggacccttaaccggttacggttaaccgttaccccggttaacggggtttaggaggttaaccggaacggggtaacctttcccgggttacggttacccgtacccggtcccttacccgtacggacccgtaccctacccgaaccgggtaaccgggtcccctaacgggtttcccccggttaccccgttcccccgggtggtccccgtcccgttcgacccgtacgggaacggtaccncccgtaaacccggtccggaacggaccgtaccgaaccggtaccggccccgggtccgtagggtcccgtaccggttaccggtaccgggtaaccgtaaccggtttacccgttaccgtacgttcctacgtcgttacggtcggaccggtcgggacgtacggacggtacgggactacgtaagtcgcgatacgngtcgagngncgntagcgcgatcgtgcgcgcgtactagagngngagtcg

SEQ ID NO: 293047 - DNA, 770 bp, Homo sapiens
  misc_feature: GYAE6OF01CS7W4.11.26.C04.1.454.CMB.1.raw
  modified_base (138)..(138): a, c, t, g, unknown or other
  misc_feature (138)..(138): n is a, c, g, or t
  modified_base (214)..(214): a, c, t, g, unknown or other
  misc_feature (214)..(214): n is a, c, g, or t
  modified_base (729)..(729): a, c, t, g, unknown or other
  misc_feature (729)..(729): n is a, c, g, or t
  modified_base (733)..(733): a, c, t, g, unknown or other
  misc_feature (733)..(733): n is a, c, g, or t
  modified_base (736)..(736): a, c, t, g, unknown or other
  misc_feature (736)..(736): n is a, c, g, or t
  modified_base (740)..(740): a, c, t, g, unknown or other
  misc_feature (740)..(740): n is a, c, g, or t
  modified_base (743)..(743): a, c, t, g, unknown or other
  misc_feature (743)..(743): n is a, c, g, or t
  modified_base (750)..(750): a, c, t, g, unknown or other
  misc_feature (750)..(750): n is a, c, g, or t
  modified_base (757)..(757): a, c, t, g, unknown or other
  misc_feature (757)..(757): n is a, c, g, or t
  modified_base (761)..(761): a, c, t, g, unknown or other
  misc_feature (761)..(761): n is a, c, g, or t
  modified_base (764)..(764): a, c, t, g, unknown or other
  misc_feature (764)..(764): n is a, c, g, or t
  modified_base (766)..(766): a, c, t, g, unknown or other
  misc_feature (766)..(766): n is a, c, g, or t
  modified_base (768)..(768): a, c, t, g, unknown or other
  misc_feature (768)..(768): n is a, c, g, or t
tcagcgagagataccacgaccggtgctcgatttagtctagcgactttgggtttgggggaagaggaagactgacggtccgccaggctccgagggagggctggagtggtgcaacataaagccagatggagtagtaaaacngtatgtaagctctgtggacgggtccgttcaccatctccagacgacaacgtcaagactgcgtatatctctacagtanggaactcggcctggacggacgccgaggtaaccgcggtctagttattagttacgtggacgggtcgttccgtgggtcctacggccgtaccgtttcggtaccgttaccccgggtaacggtttcggggacggttaacccggtaggggttaaaccttccggttaggtacccgttcccggtcccttacccgttcccgaaccggttcccctaacccgtaaccgggtaaaacccgggtccccgtaaaccgttccccggtttcccccgtttaccccccgggcgggtcccctaccccggttgacccgttacccgggaaaccgggccgaccccggtaacccttacggaacggaccgaccgtaccgggacccggcccgggtccggtcggggtcccttccggtacccggttccggaaacgtacgggtaaccccttaccggtttctacccttccggtccgtcccgtaggtcccgggaacggttcggggaccgtcggccggaaaccgtcggaaccgttagaggcacgttnacgntgngtcncgngcgcgcncgtgctncgtncgncngngc

SEQ ID NO: 293048 - DNA, 407 bp, Homo sapiens
  misc_feature: GYAE6OF02IOLR1.11.26.C04.1.454.CMB.1.raw
  modified_base (403)..(407): a, c, t, g, unknown or other
  misc_feature (403)..(407): n is a, c, g, or t
tcagcgagagataccacgaccggtgctcgatttagtctagcgactttgggtttgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttccccctggcgccctgctccaggagcacctccgagagcacagcggcctgggctgcctggtcaaggactacttccgtatctctcgctgagcgggctggcaaggcgcatagnnnnn

SEQ ID NO: 293049 - DNA, 372 bp, Homo sapiens
  misc_feature: GYAE6OF02FLKI2.11.26.C04.1.454.CMB.1.raw
  modified_base (366)..(372): a, c, t, g, unknown or other
  misc_feature (366)..(372): n is a, c, g, or t
tcagcgagagataccacgaccggtgctcgatttagtctagcgactttgggtttgggtgccgaagttgctggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggtcctgggctgcctggtcaaggactacttccgtattctcgctgagcgggctggcaaggcgcatagnnnnnnn

SEQ ID NO: 293050 - DNA, 477 bp, Homo sapiens
  misc_feature: GYAE6OF02FL4YH.11.26.C04.1.454.CMB.1.raw
  modified_base (439)..(477): a, c, t, g, unknown or other
  misc_feature (439)..(477): n is a, c, g, or t
tcagcgagagataccacgaccggtgctcgattttagtctagcgactttgggtttgggtggccaacaggtaaagccagatggaggtgtaaaacagtagtgtagactctgtgggagggccgggttcaccatctccagagacaacgccaaagaatggcgatagtatcgtaccagatgaaccagccctgcgagccgaggacacggctgtgtattactggtgggagtccctggctggcaccttgtatccgaccgttgggagtcagggaactctggtcaccgttctcctcagcctccaccaacgggccccaatccggtccttcccccctaccggaccgcccctgcctccaggagcacctccgagacgccacaggcgccctgggctgcctggtcaaggactacttccgtatctctcgctgacgccgggctggcaagggcgcatagnnnnnnnnnnnnnnnnnnnnnnnnnnnnnnnnnnnnnnn

SEQ ID NO: 293051 - DNA, 372 bp, Homo sapiens
  misc_feature: GYAE6OF02IFNCP.11.26.C04.1.454.CMB.1.raw
  modified_base (367)..(372): a, c, t, g, unknown or other
  misc_feature (367)..(372): n is a, c, g, or t
tcagcgagagataccacgaccggtgctcgatttagtctagcgactttgggtttgggtgccgaagttgctggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggccctgggctgcctggtcaaggactacttccgtatctctcgctgagcgggctggcaaggcgcatagnnnnnn

SEQ ID NO: 293052 - DNA, 416 bp, Homo sapiens
  misc_feature: GYAE6OF02GK2M4.11.26.C04.1.454.CMB.1.raw
  modified_base (407)..(416): a, c, t, g, unknown or other
  misc_feature (407)..(416): n is a, c, g, or t
tcagcgagagataccacgaccggtgctcgatttagtctagcgactttgggtttgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccagggcccatcggtctccccctggcgccctgctccaggagcacctccgagacgcacacgccggccctgggcctgcctggtcaaggactacttccgtatctctcgctgacgcgggctggcaggcgcagtagnnnnnnnnnn

SEQ ID NO: 293053 - DNA, 408 bp, Homo sapiens
  misc_feature: GYAE6OF02FO7IQ.11.26.C04.1.454.CMB.1.raw
  modified_base (401)..(408): a, c, t, g, unknown or other
  misc_feature (401)..(408): n is a, c, g, or t
tcagcgagagataccacgaccggtgctcgatttagtctagcgactttgggtttgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggcctgggctgcctggtcaaggctacttccgtatctctcgctgagcgggctggcaaggcgcatagnnnnnnnn

SEQ ID NO: 293054 - DNA, 378 bp, Homo sapiens
  misc_feature: GYAE6OF02I5W66.11.26.C04.1.454.CMB.1.raw
  modified_base (263)..(263): a, c, t, g, unknown or other
  misc_feature (263)..(263): n is a, c, g, or t
  modified_base (370)..(378): a, c, t, g, unknown or other
  misc_feature (370)..(378): n is a, c, g, or t
tcagcgagagataccacgaccggtgctcgatttagtctagcgactttgggtttgggtgccgaagttgctggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttccccnggcgccctgcctccaggagcacctccgagagcacagcggccctgggcctgcctggtcaaggactacttccgtatctctcgctgagcgggctggcaaggcgcgatagnnnnnnnnn

SEQ ID NO: 293055 - DNA, 420 bp, Homo sapiens
  misc_feature: GYAE6OF02GVOSS.11.26.C04.1.454.CMB.1.raw
  modified_base (410)..(410): a, c, t, g, unknown or other
  misc_feature (410)..(410): n is a, c, g, or t
  modified_base (415)..(420): a, c, t, g, unknown or other
  misc_feature (415)..(420): n is a, c, g, or t
tcagcgagagataccacgaccggtgctcgatttagtctagcgactttgggtttgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggactctggtcaccgtctcctcagcctccaccaagggcccatccggtcttcccccgtggccgcccctgcctccacggacgccacctccggagacgcacacgccggccctgggctgcctggtcaaggctacttccgtatctctcgctgagcgggctggcgaaggcgnatagnnnnnn

SEQ ID NO: 293056 - DNA, 376 bp, Homo sapiens
  misc_feature: GYAE6OF02H04PI.11.26.C04.1.454.CMB.1.raw
  modified_base (371)..(376): a, c, t, g, unknown or other
  misc_feature (371)..(376): n is a, c, g, or t
tcagcgagagataccacgaccggtgctcgatttagtctagcgactttgggtttgggtgccgaagttgctggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggccccatccggtcttcccctggccgccctgctccaggagcacctcccgagagcacagcggcccctgggctgcctggtcaaggctacttccgtatctctcgctgagcgggctggcaaggcgcatagnnnnnn

SEQ ID NO: 293057 - DNA, 377 bp, Homo sapiens
  misc_feature: GYAE6OF02H73ZI.11.26.C04.1.454.CMB.1.raw
  modified_base (362)..(362): a, c, t, g, unknown or other
  misc_feature (362)..(362): n is a, c, g, or t
  modified_base (368)..(377): a, c, t, g, unknown or other
  misc_feature (368)..(377): n is a, c, g, or t
tcagcgagagataccacgaccggtgctcgatttagtctagcgactttgggtttgggtgccgaagttgctggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcctcctggccgccctgctccaggagcacctccgagagcacagcggccctgggctgcctggtcaaggctacttccgtatctctcgctgagcgggctggcaaggcncatagnnnnnnnnnn

SEQ ID NO: 293058 - DNA, 462 bp, Homo sapiens
  misc_feature: GYAE6OF02FI97Y.11.26.C04.1.454.CMB.1.raw
  modified_base (456)..(462): a, c, t, g, unknown or other
  misc_feature (456)..(462): n is a, c, g, or t
tcagcgagagataccacgaccggtgctcgatttagtctagcgactttgggtttggggggaagaggaagactgacggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggaccacggctgtgtattactgtgggatccctggctggcacctgtatccgaccgttggagtcagggaactctggtcaccgtctcctcagcctccaccaagggcccatcggtcttccccctggcgccctgctccaggagcacctccgagagcacagcggccctgggctgcctggtcaaggactattccgtatctctcgctgagcgggctggcaaggcgcatagnnnnnnn

SEQ ID NO: 293059 - DNA, 485 bp, Homo sapiens
  misc_feature: GYAE6OF02FR5C3.11.26.C04.1.454.CMB.1.raw
  modified_base (453)..(453): a, c, t, g, unknown or other
  misc_feature (453)..(453): n is a, c, g, or t
  modified_base (473)..(485): a, c, t, g, unknown or other
  misc_feature (473)..(485): n is a, c, g, or t
tcagcgagagataccacgaccggtgctcgatttagtctagcgactttgggtttggggggaagaggaagactgacggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggatccctggctggcacctgtatccgaccgttggagtcagggaactctggtcaccgtctcctcagcctccaccaagggcccatccggtcttccccctggccgccctgctcccaggacgcaccctccgagacgcacacgccgggccctggggcctggcctggtcaaggactacttccgtatcctctcgctgagcgggntcggcgaacggcgcagtagnnnnnnnnnnnnn

SEQ ID NO: 293060 - DNA, 633 bp, Homo sapiens
  misc_feature: GYAE6OF02H7JGV.11.26.C04.1.454.CMB.1.raw
  modified_base (590)..(590): a, c, t, g, unknown or other
  misc_feature (590)..(590): n is a, c, g, or t
  modified_base (594)..(595): a, c, t, g, unknown or other
  misc_feature (594)..(595): n is a, c, g, or t
  modified_base (597)..(597): a, c, t, g, unknown or other
  misc_feature (597)..(597): n is a, c, g, or t
  modified_base (601)..(601): a, c, t, g, unknown or other
  misc_feature (601)..(601): n is a, c, g, or t
  modified_base (605)..(605): a, c, t, g, unknown or other
  misc_feature (605)..(605): n is a, c, g, or t
  modified_base (609)..(609): a, c, t, g, unknown or other
  misc_feature (609)..(609): n is a, c, g, or t
  modified_base (614)..(614): a, c, t, g, unknown or other
  misc_feature (614)..(614): n is a, c, g, or t
  modified_base (619)..(620): a, c, t, g, unknown or other
  misc_feature (619)..(620): n is a, c, g, or t
  modified_base (622)..(622): a, c, t, g, unknown or other
  misc_feature (622)..(622): n is a, c, g, or t
  modified_base (625)..(625): a, c, t, g, unknown or other
  misc_feature (625)..(625): n is a, c, g, or t
  modified_base (630)..(630): a, c, t, g, unknown or other
  misc_feature (630)..(630): n is a, c, g, or t
  modified_base (633)..(633): a, c, t, g, unknown or other
  misc_feature (633)..(633): n is a, c, g, or t
tcagcgagagataccacgaccggtgctcgatttagtctagcgacttttgggtttgggggaagaggaagactgacggtccgccaggctccagggaagggctggagtgggtggccaacataaaagccagatggaggtgtaaaacagtatgtagactctgtggagggccggttcaccatctccagagacaacgccaagaatgcgatatatctacagatgaacagcctgcgagccgaggacacggctgtgtattacgtgtgggacgtcccgtggctggctaccgtgtactccgacggttggagtcgagggtaactcgtcgtccaccgtcctcctcacgtccctccgaacccgaacgggccccacgttcccgggttccctttcccccgtcgggtcccgtcccctcgtcctcccgaggaccgccctaacccgtccggacggaacgaccgaaccgacggccgggtccccgtggggtccgtccggtcccgttcggtaaccgaaacggtacccgtttacgttccccgttaattccgttacgttccgtcgttacggacgggtccggtcgtacggaccgtaacggtccgacgtacgtagcngtcnngnacgngtcntcgncgtancgtcnncngcntcgtncgn

SEQ ID NO: 293061 - DNA, 545 bp, Homo sapiens
  misc_feature: GYAE6OF02FLI7U.11.26.C04.1.454.CMB.1.raw
  modified_base (522)..(522): a, c, t, g, unknown or other
  misc_feature (522)..(522): n is a, c, g, or t
  modified_base (524)..(545): a, c, t, g, unknown or other
  misc_feature (524)..(545): n is a, c, g, or t
tcagcgagagataccacgaccggtgctcgatttagtctagcgactttgggtttggggggaagaggaagactgacggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactggtgggagtccctggctggcacctgtactccgaccgttggagtcgagggaactcgtggtcaccgtctcctcacgcctccaccaagggcccagtccggtccttcccctggccgccctgcctccgaggacgccaccgtccgagacgcacgaggccggcccgtgggcctcgccgtgggtacaaacgggtaccttaccgtttccggtacttcccgtcgttccggctacggacggccggggtcttcgggaccgtaacgggccgacgagtagctncnnnnnnnnnnnnnnnnnnnnnn

SEQ ID NO: 293062 - DNA, 487 bp, Homo sapiens
  misc_feature: GYAE6OF02HXFUB.11.26.C04.1.454.CMB.1.raw
  modified_base (329)..(329): a, c, t, g, unknown or other
  misc_feature (329)..(329): n is a, c, g, or t
  modified_base (427)..(427): a, c, t, g, unknown or other
  misc_feature (427)..(427): n is a, c, g, or t
  modified_base (458)..(458): a, c, t, g, unknown or other
  misc_feature (458)..(458): n is a, c, g, or t
  modified_base (460)..(487): a, c, t, g, unknown or other
  misc_feature (460)..(487): n is a, c, g, or t
tcagcgagagataccacgaccggtgctcgatttagtctagcgactttgggtttgggtggccaacataaaagccagatggaggtgtaaaacagtatgtagactctgtggagggccggttcaccatctccagagacaacgccaagaatgcgatatatctacagatgaacagcctgcgagccgaggacacggctgtgtattactggtgggacgtccctggctggcacctgtatccgacgttggagtcgagggactcgtggtcaccgtctcctcagccctcaccaagggcccactcggttccttcccccgtggccgcccctgcctccaggacnccaccctccgagacgctacaggccggccgtggctcggccctgggtaccaagggaccttacgttccgtaactccgttctcggcgtggacggtccgggtntacgggacgaacgggtccgactagtaacggngnnnnnnnnnnnnnnnnnnnnnnnnnnnn

SEQ ID NO: 293063 - DNA, 425 bp, Homo sapiens
  misc_feature: GYAE6OF02FW4SJ.11.26.C04.1.454.CMB.1.raw
  modified_base (291)..(291): a, c, t, g, unknown or other
  misc_feature (291)..(291): n is a, c, g, or t
  modified_base (391)..(394): a, c, t, g, unknown or other
  misc_feature (391)..(394): n is a, c, g, or t
  modified_base (396)..(425): a, c, t, g, unknown or other
  misc_feature (396)..(425): n is a, c, g, or t
tcagcgagagataccacgaccggtgctcgatttagtctagcgactttgggtttggggtgccgaagttgctggagggccggttcaccatctccagagacaacgccaagaatgcgatatatctacagatgaacagcctgcgagccgaggacacggctgtgtattactgtggagtccctggctggcacctgtatccgaccgttggagtcagggaactcgtggtccaccgtctcctcagcctccaccaagggcccagtccggtccttcccctggccgcccctgcctccgaggacnccacctccgagagccacaggccggccctgggctcgccgtggtcaaggacttacttccgtatcctctcgctgacggcgggctggacaaggtcgacagtagnnnncnnnnnnnnnnnnnnnnnnnnnnnnnnnnnn

SEQ ID NO: 293064 - DNA, 532 bp, Homo sapiens
  misc_feature: GYAE6OF02I71VD.11.26.C04.1.454.CMB.1.raw
  modified_base (477)..(477): a, c, t, g, unknown or other
  misc_feature (477)..(477): n is a, c, g, or t
  modified_base (480)..(482): a, c, t, g, unknown or other
  misc_feature (480)..(482): n is a, c, g, or t
  modified_base (485)..(487): a, c, t, g, unknown or other
  misc_feature (485)..(487): n is a, c, g, or t
  modified_base (489)..(532): a, c, t, g, unknown or other
  misc_feature (489)..(532): n is a, c, g, or t
tcagcgagagataccacgaccggtgctcgatttagtctagcgactttgggtttgggtgccgaagttgctgggagggccggttcaccatctccagagacaacgccaagaatgcgatatatctacagatgaacagcctgcgagccgagggacacgggctgtgtgttactggtgggagtccctggctgggcacctgtactccgacgttggagtcagggactcgtggtcaccgtctcctcacgccctccaccgaagggcccagtcgggtccttcccccgtggccgcccctgccctaccgacgggacgtccaacccgttccggaacgacggaccaccgacggccgggccccggttggggcccttaggcccgttggggtaccaaacggggtacccttaaccgttccggttaactccgttctccggcttcggaacgggtcccgggtacgttcgggaccgaaacgggccggtactaggtagcgancgnnncgnnngnnnnnnnnnnnnnnnnnnnnnnnnnnnnnnnnnnnnnnnnnnnn

SEQ ID NO: 293065 - DNA, 681 bp, Homo sapiens
  misc_feature: GYAE6OF02F6HS8.11.26.C04.1.454.CMB.1.raw
  modified_base (649)..(649): a, c, t, g, unknown or other
  misc_feature (649)..(649): n is a, c, g, or t
  modified_base (654)..(654): a, c, t, g, unknown or other
  misc_feature (654)..(654): n is a, c, g, or t
  modified_base (656)..(656): a, c, t, g, unknown or other
  misc_feature (656)..(656): n is a, c, g, or t
  modified_base (658)..(661): a, c, t, g, unknown or other
  misc_feature (658)..(661): n is a, c, g, or t
  modified_base (663)..(663): a, c, t, g, unknown or other
  misc_feature (663)..(663): n is a, c, g, or t
  modified_base (665)..(671): a, c, t, g, unknown or other
  misc_feature (665)..(671): n is a, c, g, or t
  modified_base (674)..(677): a, c, t, g, unknown or other
  misc_feature (674)..(677): n is a, c, g, or t
  modified_base (679)..(681): a, c, t, g, unknown or other
  misc_feature (679)..(681): n is a, c, g, or t
tcagcgagagataccacgaccggtgctcgatttagtctagcgactttgggtttggggggaagaggaagactgacggtccgccaggctccagggaaggggctggagtgggtggccaacataaagccagatggaggtgtaaaacagtatgtagactctgtggagggccggttcaccatctccagagacaacgccaagaatgcgatatatctacagatagaacagcctgcgagccgaggaccacggctgtagttattacgtggtgggactcccgtggctcggcacctgtactcccgtaccgttggagtcgacggactcgtggtccgaccgtcctcctccacgccctaccgaccgaacgggcccacgtccggttcccttcccccgtcgggcccgtcccctcggccctaccgacgggaccgtaccccgacccgtccggaaccgtaccggacccgaaccgaccgggtccccgggtccccggtacgggggtcccttccgggtaccccggtttaccggggtaaccgtaaaccggggttaacccctttacccgttttaccccggttaacgtttccccgttcccgttccgggtccgttagggaccgggcccggggtaccgtcggggaaccggtaacccggggccgtaccgtaacgttgngacgngngnnnncncnnnnnnngcnnnncnnn

SEQ ID NO: 293066 - DNA, 503 bp, Homo sapiens
  misc_feature: GYAE6OF02GFOOL.11.26.C04.1.454.CMB.1.raw
  modified_base (373)..(373): a, c, t, g, unknown or other
  misc_feature (373)..(373): n is a, c, g, or t
  modified_base (376)..(376): a, c, t, g, unknown or other
  misc_feature (376)..(376): n is a, c, g, or t
  modified_base (380)..(380): a, c, t, g, unknown or other
  misc_feature (380)..(380): n is a, c, g, or t
  modified_base (385)..(385): a, c, t, g, unknown or other
  misc_feature (385)..(385): n is a, c, g, or t
  modified_base (387)..(387): a, c, t, g, unknown or other
  misc_feature (387)..(387): n is a, c, g, or t
  modified_base (414)..(414): a, c, t, g, unknown or other
  misc_feature (414)..(414): n is a, c, g, or t
  modified_base (418)..(418): a, c, t, g, unknown or other
  misc_feature (418)..(418): n is a, c, g, or t
  modified_base (420)..(420): a, c, t, g, unknown or other
  misc_feature (420)..(420): n is a, c, g, or t
  modified_base (426)..(426): a, c, t, g, unknown or other
  misc_feature (426)..(426): n is a, c, g, or t
  modified_base (428)..(428): a, c, t, g, unknown or other
  misc_feature (428)..(428): n is a, c, g, or t
  modified_base (463)..(463): a, c, t, g, unknown or other
  misc_feature (463)..(463): n is a, c, g, or t
tcagcgagagataccacgaccggtgctcgatttagtctagcgactttgggtttgggtgccgaagttgctggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggcctgggctgcctggtcaaggactacttcgtatctctcgctgagcggggctggacaaggtcgacaagtaagcngancganagtananagacgtgcagcagacgcagtcaagtanagananacacananacacgcgacgacgacgtacgtacgtactagacganacagacgtacgtacacacacacactacactagactacacg

SEQ ID NO: 293067 - DNA, 618 bp, Homo sapiens
  misc_feature: GYAE6OF02GWRPG.11.26.C04.1.454.CMB.1.raw
  modified_base (142)..(142): a, c, t, g, unknown or other
  misc_feature (142)..(142): n is a, c, g, or t
  modified_base (330)..(330): a, c, t, g, unknown or other
  misc_feature (330)..(330): n is a, c, g, or t
  modified_base (381)..(381): a, c, t, g, unknown or other
  misc_feature (381)..(381): n is a, c, g, or t
  modified_base (555)..(555): a, c, t, g, unknown or other
  misc_feature (555)..(555): n is a, c, g, or t
  modified_base (564)..(564): a, c, t, g, unknown or other
  misc_feature (564)..(564): n is a, c, g, or t
  modified_base (569)..(569): a, c, t, g, unknown or other
  misc_feature (569)..(569): n is a, c, g, or t
  modified_base (578)..(578): a, c, t, g, unknown or other
  misc_feature (578)..(578): n is a, c, g, or t
  modified_base (582)..(582): a, c, t, g, unknown or other
  misc_feature (582)..(582): n is a, c, g, or t
  modified_base (607)..(607): a, c, t, g, unknown or other
  misc_feature (607)..(607): n is a, c, g, or t
tcagcgagagataccacgaccggtgctcgatttagtctagcgactttgggtttgggggaagaggaagactgacggtccgccaggctccagggaaggggctggagtgggtggccaacataaagccagatggaggtgtaaaacngtatgtagactctgtggagggccggttcaccatctccagagacaacgccaagaatgcgatatatctacagtatgaacagcctgcgagccgagacacggctgtgtacttctgtggactccgtggctggcacctgtacgtccgaccgttggagtcgaggacttcgtggtaccaccgtctcctcacgtccnccaccgaagggtccccagtccggttcccttccccgtacggccgtacccgtntaccgtccgacggtacgccaccctaccggagacgaccgtacgacggccggcccgtagggcccgtcgtccggttacggtacaacggtaaccttaccgttccgtactcccgtcgtccgtccgtaggtcggtccgggtcctaggggtaccaaccggggtcaccgggtaatccggtancgaactcgngtacncgacgagcngcgngcgacgtacgtacgtacgcgtacgngtcgcgtgtcg

SEQ ID NO: 293068 - DNA, 521 bp, Homo sapiens
  misc_feature: GYAE6OF02GWS9Q.11.26.C04.1.454.CMB.1.raw
  modified_base (253)..(253): a, c, t, g, unknown or other
  misc_feature (253)..(253): n is a, c, g, or t
  modified_base (322)..(322): a, c, t, g, unknown or other
  misc_feature (322)..(322): n is a, c, g, or t
  modified_base (359)..(359): a, c, t, g, unknown or other
  misc_feature (359)..(359): n is a, c, g, or t
  modified_base (496)..(498): a, c, t, g, unknown or other
  misc_feature (496)..(498): n is a, c, g, or t
  modified_base (500)..(500): a, c, t, g, unknown or other
  misc_feature (500)..(500): n is a, c, g, or t
  modified_base (502)..(502): a, c, t, g, unknown or other
  misc_feature (502)..(502): n is a, c, g, or t
  modified_base (504)..(521): a, c, t, g, unknown or other
  misc_feature (504)..(521): n is a, c, g, or t
tcagcgagagataccacgaccggtgctcgatttagtctagcgactttgggtttggggggaagaggaagactgacggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattacnggtgggatccctggctggcacctgtactccgaccgttggagtcagggaactctggtcaccgtctcctcngcctccaccacggcccagtccgtcttccccctggccnccctgcctccaggacgccacctccggagacgcacgacgccggcccgtggggcctgccctagggtaccaagggtaccttaaccgttccgtactcctccgtccgcgtgaggccggcgtgggccaagggccgcagtagcnnnancngnnnnnnnnnnnnnnnnnn

SEQ ID NO: 293069 - DNA, 469 bp, Homo sapiens
  misc_feature: GYAE6OF02HN9SJ.11.26.C04.1.454.CMB.1.raw
  modified_base (232)..(232): a, c, t, g, unknown or other
  misc_feature (232)..(232): n is a, c, g, or t
  modified_base (289)..(289): a, c, t, g, unknown or other
  misc_feature (289)..(289): n is a, c, g, or t
  modified_base (430)..(469): a, c, t, g, unknown or other
  misc_feature (430)..(469): n is a, c, g, or t
tcagcgagagataccacgaccggtgctcgatttagtctagcgactttgggtttgggtgccgaagttgctggagggccggttcaccatctccagagacaacgccaagaatgcgatatatctacagatgaacagcctgcgagccgaggacacggctgtgtattactgtggggagtccctggctggcacctgtatccgaccgttggatcagggaactctggtcaccgtctcctcngcctccaccaacgggcccattccggtccttccccctggccgccctgcctccgaggcncaccctccgagacgcacgacggtcccggcccgtcggggacctcggcccgttggtaccggaaacggtaccttaacccgttcgtaactccttacgtccgtcgtggacggccggggtagtcgggacgaacggcgtcgaagtagnnnnnnnnnnnnnnnnnnnnnnnnnnnnnnnnnnnnnnnn

SEQ ID NO: 293070 - DNA, 585 bp, Homo sapiens
  misc_feature: GYAE6OF02H0FS5.11.26.C04.1.454.CMB.1.raw
  modified_base (334)..(334): a, c, t, g, unknown or other
  misc_feature (334)..(334): n is a, c, g, or t
  modified_base (372)..(372): a, c, t, g, unknown or other
  misc_feature (372)..(372): n is a, c, g, or t
  modified_base (566)..(570): a, c, t, g, unknown or other
  misc_feature (566)..(570): n is a, c, g, or t
  modified_base (572)..(585): a, c, t, g, unknown or other
  misc_feature (572)..(585): n is a, c, g, or t
tcagcgagagataccacgaccggtgctcgatttagtctagcgactttggggtttgggggggaagaggaagactgacggtccgccaggctccaggggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactggtgggactcccgtggctggcacctgtactccggacgttggagtcgagggaactcgtggtccaccgttctcctcgacnccctccaccgaacggcccattccggtcctttcccccgnggccgcccctcgccctccgacggacgcctacccgtccggacgacgccaaccgacggcccgggtccccggttggggaccttccggcccgttgggtaaccaacgggtaccttaccgtttcccgtattcccgtacctccgcgttcggacggcgggtcgtcgggacgtagggcccacgtaagtcggatgactcgatgnnnnngnnnnnnnnnnnnnn

SEQ ID NO: 293071 - DNA, 660 bp, Homo sapiens
  misc_feature: GYAE6OF02G3BF4.11.26.C04.1.454.CMB.1.raw
  modified_base (206)..(206): a, c, t, g, unknown or other
  misc_feature (206)..(206): n is a, c, g, or t
  modified_base (253)..(253): a, c, t, g, unknown or other
  misc_feature (253)..(253): n is a, c, g, or t
  modified_base (319)..(319): a, c, t, g, unknown or other
  misc_feature (319)..(319): n is a, c, g, or t
  modified_base (587)..(587): a, c, t, g, unknown or other
  misc_feature (587)..(587): n is a, c, g, or t
tcagcgagagataccacgaccggtgctcgatttagtctagcgactttgggtttggggggaagaggaagactgacggtccgccaggctccagggaaggggctggagtgggtggccaacataaagccagatggaggtgtaaaacagtatgtagactctgtggagggccggttcaccatctccagacgacaacgccaagaatgcgatanatctacagatgaacagcctgcgagccgagacacggctgtgtattacnggtgggatccctggctggcacctgtactccggaccgttggagtcaggtactcgtggtcaccgtccncctcgacgccctccacccgaacggccctagtccggttacccttccccgtcggccgtcccgtcgcctaccgacggtcgcctaacccgtccgaacgtacgacctaaccgcggacccggcccgttcgggaccttcggccccgttaggtaccgaaaacggtccttaaccggtttaccctacgtacccgtccttacgtccgtacgggtacggcccggggtacttccggggaccgtaacggggtcccgtaccggttaagtaacggtcgtaccgngtacgtacgacgccgtacgacgcgtacgacgcgtacgacgtcgtacgtactcgacgtcgtacgtacgtcgtcg

SEQ ID NO: 293072 - DNA, 552 bp, Homo sapiens
  misc_feature: GYAE6OF01ECE64.39.40.D07.1.454.CMB.1.raw
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaaagagtccaccctctcctgcagggccagtcagagtgttagcagcaacttagcctggtaccagcagaaacctggccaggcctccgaggcctcctcatctatgatcgccctccaccgagggcccacttggtactcccgagccaggttcaggtggcaagtgggtctggggacaggtacgttcacttctactattatcagcagcctgctagtcagaatattagtctagttttatactgtacagactagtataagtgactggaccttacggtccggaccgtaaagggaccctaaagggtacgtaaaactacgaaaacgacgttgacggtactacgacctaaccgtgtcgttacg

SEQ ID NO: 293073 - DNA, 800 bp, Homo sapiens
  misc_feature: GYAE6OF01BW1F4.39.40.D07.1.454.CMB.1.raw
tcagtcgcactagtcacgaccggtgctcgatttagtgatagagcgtaacaacaggagggggaggaactgctcagttaggacccagacggaaccatggaacgccccagcgcagcttctcttcctcctgctactctggcctcccgagtacttccacgtggaagtaaacgtgtgagtgaccgctagtcctaccgacgccctaccgtgtcttgtcgtcctacgggaagggaactcgtccctaccctcgtccgtgcggtacggcctagtcgaggtagttgtacgacgtacgtacttaacgttcgccgtacggaaccacgacgtaaaccgaaccgtcggacccgtacggccccgtaccccggacggttcccttacccgtataccgttacttacgtcgtaccttacccggacccctaccggaaacccgggtacgggtacccttacgggttaccgtacccgaccccggtaaggtccgttacgggttacgtacggtacggtacgtacgggttcgggtacggaacggtacgtacggttaccctcgtaacttcgttaactaacgtttcgaccacgtccgacgtccctagtacgtagttacgtaaggtaacttttagtacttttaacgttacttttaacgtcgtacgttagaaccgttagttaacgttagtaccgtttacggtacccggtttaacgtaccggtaaccggttaccggaaaccggttaaacggggaacgtaaaggtaacgtaaacgtaaccggtaacgttgtacggtactcccggttataaccgtaaccgttcgtttacgtccg

SEQ ID NO: 293074 - DNA, 788 bp, Homo sapiens
  misc_feature: GYAE6OF01D8WGC.39.40.D07.1.454.CMB.1.raw
  modified_base (212)..(212): a, c, t, g, unknown or other
  misc_feature (212)..(212): n is a, c, g, or t
tcagtcgcactagtcacgaccggtgctcgatttagtgatagagcgtaacaacagagggggaggaactgctcagttaggacccagacggaaccatggaacgccccagcgcagcttctcttcctcctgctactctggctcccagattccactggagaaatagtgatgacgcagtctccagcccacctgtctgtgtccgtaccgaaggggtaaancgtccctacccgtcctccgtgcgacgggtccagtacgagtagtcgttagcagactaacgttacgccgttacgtaccgagaccgtaacgtaaaccgtcggaccgacggccgtccccgaacggtccctccgtactacttccttagtacggtctccggtaccctacccgaccggaccgggtacccgtacgttaccggtaccgtaccccgacggtacccgttacggttaccgtaggtacgtaacgtaacgggtttcgggtaccggtgggtacgtaacggttacggtccctaacgttccgttacttacggttacctaccgacgtaccgtacggtcctcggtacgtacggttaccgtaagggtaacgtttaacgttcgttaacgttttacgttaacgttttacctaggtacgacgtacttaagttaacgtagttacgaccggttcccggtacgttaaccggtaccgggtaaaccgtaacggggtaaaccggttaaacgggtaaacggtaaaccggttaaaccgttaaaccggtaagttacggtcggtaacccgtacgaaccctacgttacgttccgttaccg

SEQ ID NO: 293075 - DNA, 758 bp, Homo sapiens
  misc_feature: GYAE6OF01AMW1C.39.40.D07.1.454.CMB.1.raw
  modified_base (208)..(208): a, c, t, g, unknown or other
  misc_feature (208)..(208): n is a, c, g, or t
tcagtcgcactagtcacgaccggtgctcgatttagtgatagagcgtaacaacagagggggaggaactgctcagttaggacccagacggaaccatggaagccccagcgcagcttctcttcctcctgctactctggctccagattccactggagaaatagtgatgacgcagtctccagccaccctgtctgtgtcctccgaaggggaaacngtccaccctctcctgcgagggccagtcagtagttgttagcagctaacgttagcctaggtacccagcaagaacccgtggaccaggcctcccgaggtcctccgtcattcgtatcgacttcgcccctaccgaaccgacgggtaccctacggttcgggtaacctccccgaaggtcccgtaaggtttccgacggtcggtaacctaaacggttggggtaccttaagggggaaccctagggttaaccgtttccaaccgtttcttaaccgtatttactacgacggaccgtaccgtcccgttaggaccgtacggttaccgtaagggtaaaccgtttagtttaaccgtacgttttaacggtttttaacttacgttacgttaccgtaacgtaacgttaacggttaacttaacggtccgttaccgttacgggttaccccgttaacgggttaccgggaaccggtaaaccgggtaacggtaaacgggttaaccgaaacgttaacggtaaaaccggtacgtttacggacggtaccctacgaaccctaccgttcgtcggttacccg

SEQ ID NO: 293076 - DNA, 749 bp, Homo sapiens
  misc_feature: GYAE6OF01EPSHM.39.40.D07.1.454.CMB.1.raw
  modified_base (131)..(131): a, c, t, g, unknown or other
  misc_feature (131)..(131): n is a, c, g, or t
  modified_base (210)..(210): a, c, t, g, unknown or other
  misc_feature (210)..(210): n is a, c, g, or t
tcagtcgcactagtcacgaccggtgctcgatttagtgatagagcgtaacaacagagggggaggaactgctcagttaggacccagacggaaccatggaagccccatcgcagcttctcttcctcctgctactntggctcccagattccacgtggaagaaatagtgatgacgcagtctccagcccacctgtctgtcgtctccgaaggggaaangtaccacccgtctcctgctagggcctagtcagtacgtgttaagcaagactaaaccgtttgccgttaggtaacccagtccaaacgaaacccgtcggaccacggtccctacccgtaaggtcccttcccgtctaacttacctagtcgtaacgtccgccccttacggaacccggacgggtacccctaaggttaccgggtaacctcccgaaggccctaaggtttaccaagggtcggaccgtaaaggttcggggttacgacggggtaacacgggttacgttaccaccgttactttacgtaacgttactaccgacgtaacctcgggtacctacggtactgttaaccgtaaggtaacgtttagttacgttagtttaacgtttaacgttactacgtaacgtagtaacgtaagttaactaggttaccgtacgtcggttaccgtaccggttacgaaccggtaaacggacgttaaagggtaacgtaaacctaacggtaaaaaccgttcgtcgtaacggtacctacgaaccgtaccctgttacccgttaccg

SEQ ID NO: 293077 - DNA, 489 bp, Homo sapiens
  misc_feature: GYAE6OF02H4XIY.39.40.D07.1.454.CMB.1.raw
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccaggggaaagagtcaccctctcctgcagggccagtcagagtgttagcagcaacttagcctggtaccagcagaaacctggccaggctccaggctcctcatctatgatgcctccaccagggccactggtatcccagccaggttcagtggcaatgggtctgggacagagttcactctcattatcagcagcctgcagtctgaagtatttagctagtttattactgtcagcagtataatgactggctacgtcgacaggacaaggtgaatcgaaacgactgtaggctagcactatctacg

SEQ ID NO: 293078 - DNA, 579 bp, Homo sapiens
  misc_feature: GYAE6OF02H7FF8.39.40.D07.1.454.CMB.1.raw
  modified_base (303)..(303): a, c, t, g, unknown or other
  misc_feature (303)..(303): n is a, c, g, or t
  modified_base (404)..(404): a, c, t, g, unknown or other
  misc_feature (404)..(404): n is a, c, g, or t
  modified_base (456)..(456): a, c, t, g, unknown or other
  misc_feature (456)..(456): n is a, c, g, or t
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaaagagtccaccctctcctgcgagggccagtcagagtgttagcagcaacttagcctggtaccagacaagaaccgtggcccgaggcctcccaggtcctcccncatctatcgatcggccctccgaccgagggccacgtggtactcccagcctaggttacaggtcggctaagtcggggtctaggggacagtagttaccacgtctntacttagtacagcacgcctgcagtctagagtattagcttagtttatactgtnagtactagtactaagtgtacgttcggtccgttaacgttccggaccggtacgggaccgtaagggtacgtaaacgtaccgaaaccgtacgttaggtcgacgttacgacctaccgtagtcttacgg

SEQ ID NO: 293079 - DNA, 581 bp, Homo sapiens
  misc_feature: GYAE6OF02FNWWN.39.40.D07.1.454.CMB.1.raw
  modified_base (205)..(205): a, c, t, g, unknown or other
  misc_feature (205)..(205): n is a, c, g, or t
  modified_base (215)..(215): a, c, t, g, unknown or other
  misc_feature (215)..(215): n is a, c, g, or t
  modified_base (237)..(237): a, c, t, g, unknown or other
  misc_feature (237)..(237): n is a, c, g, or t
  modified_base (408)..(408): a, c, t, g, unknown or other
  misc_feature (408)..(408): n is a, c, g, or t
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccaggggaaanagtcaccctntcctgcagggccagtcagagtnttagcagcaacttagcctggtaccagcagaaacctggccaggctcccaggctcctcatctatgatcgccctccaaccgagggcccacgtcggtaactccccgagcccgtaggttccgaaggttggacgtaagtcggggtacgtcggggactaaggtacgttccaacccctntaacgtttatacgagtccacgtcctgcacgtcagagtatttacgcttagtttacttactgtcagcagttataagtgtacgtcggtaccttacggtcggaccgtaagggaccgaaggtacgtaaacgtaccgaaacgtaacgtcgtaggctacggaccaccgtactcgtgtacc

SEQ ID NO: 293080 - DNA, 721 bp, Homo sapiens
  misc_feature: GYAE6OF02GBNX0.39.40.D07.1.454.CMB.1.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (233)..(233): a, c, t, g, unknown or other
  misc_feature (233)..(233): n is a, c, g, or t
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctcgaggggaanagtcaccctntcctgcagggccagtcagngtgtagcagcaacttgcctggtaccagcaagaacctggccaggcctcccaggcctcctcatctatgactcgccctaccaccgagggcccacgttcggtactccccgaaggtccctaagggttcaggtcggacctaaggttcgggtctaggggaactacggtactttccgaaccgtttctacgtaatttaccgtcgaacggtccagtcccgtacggtaccgtaggttaccgtaggtaaacgttacgttttaacgggacctttaaggtttttaaaccgtttaccgttacgggttaccgtaagtacccgttaaaggtttaacgttaaagtccggtaacgttcccgggttacccgtttaaccgggtcccggttaaccggaaaccggggttaaccgtaacggggttaacggtaaaacctacccggtaaaacggtaccggtttaggtaccgggttaccttaaccggacccttaaccgttacgttccgtttaccg

SEQ ID NO: 293081 - DNA, 684 bp, Homo sapiens
  misc_feature: GYAE6OF02FPMP9.39.40.D07.1.454.CMB.1.raw
  modified_base (168)..(168): a, c, t, g, unknown or other
  misc_feature (168)..(168): n is a, c, g, or t
  modified_base (190)..(190): a, c, t, g, unknown or other
  misc_feature (190)..(190): n is a, c, g, or t
  modified_base (203)..(203): a, c, t, g, unknown or other
  misc_feature (203)..(203): n is a, c, g, or t
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgnagtctcagccaccctgtctgtntctcgaggggaanacgtcaccctctcctgcgagggccagtcagagttgtagcagctaacttacgcctaggaccagaccaacgaaccgtggaccgacgcctccccgaggcctacccgatactctagtcgatcgcctaccaccgacgggcctacgtcggtacctcccgagtccgtaaggtcacggtcggtacaaggtcggttacgacgggaacgtacggtcgtttacccgactttacctcgtaatactacgacgtacgaccgtcgaccgtcgtaacggtccgtaagtaccgttattacggtatttacgtttacgttactcggactaagtaccgttaagttaacgttaacgttggtaaccgtcgggtttaacccgtaccgggttacgggaacccggaagggaaccgttaagggggaaccgtaaaacctaacggtaaaacccggtacgtttcgggtaacgggtcctaaccggtacctaccggtatttccggttaaccg

SEQ ID NO: 293082 - DNA, 123 bp, Homo sapiens
  misc_feature: GYAE6OF01CPCCC.43.66.F11.1.454.CMB.1.raw
  modified_base (123)..(123): a, c, t, g, unknown or other
  misc_feature (123)..(123): n is a, c, g, or t
tcagtgtgagtagtcacgaccggtgctcgatttagtcacgcgagaagggaagggctggccctgacgttttctgttcccgccctcctcactactcacactgagcgggctggcaaggcgcatagn

SEQ ID NO: 293083 - DNA, 590 bp, Homo sapiens
  misc_feature: GYAE6OF01DQ4JN.43.66.F11.1.454.CMB.1.raw
  modified_base (312)..(312): a, c, t, g, unknown or other
  misc_feature (312)..(312): n is a, c, g, or t
tcagtgtgagtagtcacgaccggtgctcgatttagtcacgcgagaagggggatctcatgtgcaaagaaaatgaagcacctgtggttcttcctcctgctggtggcggctcccagatgggtcctgtcccagctgcagctgcaggagtcgggcccaggactggtgaagccttcggagaccctgtccctcacctgcactgtctcgtggtgctccatcagcagcagtacttacttcgtggggctggatccgccacgcccccgaggggaaggggctgggaggtggtagttgggagttatttaaccgacgaggtggganccaacctactaccaacccgtccctacgaaaagtcgaaggccaactatactccgtagaacacgtaccaaagaacctaattcctaccctagaaacgctagacgtctcgtcgtacggacccgccgcgaacgacgacgtcttgtacttagttaccgtgtcgacgaccggcccgagcgcgtagtggtcttttgactgtcctttgagtagtggacgggaccaaagggacacgtcggactccggtcttcgtcacgtccctcgaaccgacggtcccagttccccgg

SEQ ID NO: 293084 - DNA, 593 bp, Homo sapiens
  misc_feature: GYAE6OF01CR5IE.43.66.F11.1.454.CMB.1.raw
  modified_base (304)..(304): a, c, t, g, unknown or other
  misc_feature (304)..(304): n is a, c, g, or t
  modified_base (443)..(443): a, c, t, g, unknown or other
  misc_feature (443)..(443): n is a, c, g, or t
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagcagtacttacttcgtggggctggactccgccacgccccgaggggaaggggctggagtggagttgggagtattaccacgaggtgggancaacctactaaccaacccgtcctacaaaagtcgaacggcaaccatactccgtagaccacgtaccaaagaacctaattcctaccctagaacgctagacgtctctgtacgaccgccgacacgacacggctgtactattacngtcgcgacggccccgagccgacgaggttggtcttttgattcgtcctttgattagtggtcggggaccaaagggtacaagttcgggtacctaccggttcttccttaccgacgtccctacccgaaccggtaacgggcccctaagttccccggg

SEQ ID NO: 293085 - DNA, 668 bp, Homo sapiens
  misc_feature: GYAE6OF01D2V6S.43.66.F11.1.454.CMB.1.raw
  modified_base (351)..(351): a, c, t, g, unknown or other
  misc_feature (351)..(351): n is a, c, g, or t
  modified_base (357)..(357): a, c, t, g, unknown or other
  misc_feature (357)..(357): n is a, c, g, or t
tcagtgtgagtagtcacgaccggtgctcgatttagtcacgcgagaagggggatctcatgtgcaaagaaaatgaagcacctgtggttcttcctcctgctggtggcggctcccagatgggtcctgtcccagctgcagctgcaggagtcgggcccaggactggtgaagccttcggacgaccctgtccctcacctgcactgtctcgtggtcgctcatcagcagcagtacttactcgtgggctggactccgccacgccccgaggggaacgggctggagtggagtgggtagtactttacgacgaggtggacgcaacctactaccaacccgtcctaacaaaagtcgaggacacatacnccgtanacacgtaccaaacgaaccaacttcctacctagaaacgcgtagacgctcgtaggtacgacccgaccgacgaacgaaccgtacggtcttacggtaccttaagttaacgttcggtacggaccggtacccgggacccgaacggtcccgtacgtaacgggtttcgggtttacctttttaggacgttcgttaccgttttagtaattaggtcgggtaggggaacccgaaaggggtaacctaaggttccggtacctaccggttccttccttaccgaccgtacccgtacccgaaacggaccggtccctaggttcccccgg

SEQ ID NO: 293086 - DNA, 570 bp, Homo sapiens
  misc_feature: GYAE6OF01CX7LO.43.66.F11.1.454.CMB.1.raw
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttctggggctggatccgccagcccccagggaaggggctggagtggattggggagtatttaccacagtgggagcacctactacaacccgtcctcaaaagtcgaggcaccatatccgagacacgtccaaagaaccaattctccctgaacgctgagctctgcgaccgccgacagaccacggtctgtctattctgtgcgaggccccgagccgcaggtcggtctttttggattcgtcctttgattagttggtcggggaccgaaagggtacaacgttcgggtctacccggtcttaccgtttccacgtccccgtacccaccgtaaacgggcccctaacggtttcccccggg

SEQ ID NO: 293087 - DNA, 525 bp, Homo sapiens
  misc_feature: GYAE6OF01A3BF8.43.66.F11.1.454.CMB.1.raw
  modified_base (185)..(185): a, c, t, g, unknown or other
  misc_feature (185)..(185): n is a, c, g, or t
  modified_base (381)..(381): a, c, t, g, unknown or other
  misc_feature (381)..(381): n is a, c, g, or t
  modified_base (444)..(444): a, c, t, g, unknown or other
  misc_feature (444)..(444): n is a, c, g, or t
  modified_base (450)..(450): a, c, t, g, unknown or other
  misc_feature (450)..(450): n is a, c, g, or t
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctnacctgcactgtctctggtgctccatcagcagcagtacttacttctggggctggactccgccacgcccccgagggaacgggctggagtggagttgggagttatttaccacgaggtgggagcacctactacaacccgtcctacaaagtcgaggcaccatactccgtagacacgtaccaagaaccattctccctagacnctgagctcgtgtcgaccgccgcagacgacgctgtctattacgtgtgcgacggcccgagcgcgngtcgtnttttgattcgtcttgatgtggtgggacaggactagtcggtcacgtctctcacgtccaccacgacggcctgtcccg

SEQ ID NO: 293088 - DNA, 573 bp, Homo sapiens
  misc_feature: GYAE6OF01DDOI9.43.66.F11.1.454.CMB.1.raw
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttactctggggctggatccgccacgcccccgaggggaaggggctgggagtggagttgggagtatttaccacgagtgggagcacctacaccaacccgtccacaaaagtcgaggcaccgatactccgtagacacgtaccaagaaccaattcctccctagaagtcctagagctctgtcgacccgcccgacagacacggcttgtactagttactgtcgaccgtacggccccgagcgcaggtgtcttttgattcgtcctttgattgtggtgggtaccaagggtacaaagtcgggtactcccgtcgttaccttcaccgtccctacccgaaccgtaacgggcccccttagttccccgg

SEQ ID NO: 293089 - DNA, 642 bp, Homo sapiens
  misc_feature: GYAE6OF01APP05.43.66.F11.1.454.CMB.1.raw
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttctggggctggatccgccacgccccgagggacgggctggagtggagttgggagtatttaccacgaggtggagcacctactaccaacccgtccctacaaacgtcgaggcaccatactccgtagaccacgtaccaaagtaacctacttcctacctagaacgtcgtagacgtctcgtcgtcgacccgccgcgaacgaccgaccggtcttacggttacttaacgttacgtcggtcggccggtaccgggccccggaggccgaccgtaggttcgggttctttttacggacgttcgttcctttagacgttagtcgggtacggggtaccgaaagggtaactaggttccggtacctaccggttccttccgttaccaccgttcccctacccgaaacccggtaccgggtcccctaggttcccccgg

SEQ ID NO: 293090 - DNA, 651 bp, Homo sapiens
  misc_feature: GYAE6OF01DSOAE.43.66.F11.1.454.CMB.1.raw
  modified_base (305)..(305): a, c, t, g, unknown or other
  misc_feature (305)..(305): n is a, c, g, or t
  modified_base (347)..(347): a, c, t, g, unknown or other
  misc_feature (347)..(347): n is a, c, g, or t
  modified_base (352)..(352): a, c, t, g, unknown or other
  misc_feature (352)..(352): n is a, c, g, or t
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcaggagtcgggcccaggactggtagaagccttcggacgaccctgtcccctcacctgcactgtctcgtggtcgctccatcagcagcagtacttactcgtgggctggactccgccacgccccgagggaacgggctggagtggagttgggatacttaccacgaggtgggancacctacctaccacccgtcctacaaacgtcgagccacatacncgtanacacgtacaaacgaaccaattcctcctagacgtctagagtctacgtgtacgaccgccgacacgaccacggtctacgttaccttattacgtggtcgccggaccggccccgagccggtcgtaggttcggttctttttaggacttcgttaccgttttagagttagtcgggttccggggtaaccgaaaggggtaccgtaacggttcgggttacccgttacccggttccttacccgttacccgaacgttccccccgtaaccgtaaccccggaaaccgggtcccctaaccggtttaccccccggg

SEQ ID NO: 293091 - DNA, 688 bp, Homo sapiens
  misc_feature: GYAE6OF01DBIM8.43.66.F11.1.454.CMB.1.raw
  modified_base (234)..(234): a, c, t, g, unknown or other
  misc_feature (234)..(234): n is a, c, g, or t
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcaggagtcgggcccaggactggtgaagccttcggacgaccctgtccctcacctgcactgtctcgtggtgctccatcagcagcagtacttacgttcgngggctggactccgccacgccccgaggggagggctggagtggagttgggagtatttaccgacgaggtggagaccacctacctaaccgaaccccgtccctaacgaaaacgtcggaaggaccaaccgattaactaccggttaacgaaccgtaaccggttacccaaaacggtaaaccctaaacgtttccctacccgttaaggaaacgtcctaggacgtaccttacgttacggtaccgacccggaccgaccgaacggaccgtaccggtcttacggttacctttaagttaccgtggtacggaccggaccggccccgaagccgacgtaggttcgttacgtttttgacgtttcgtaccgttttgacgttagtcgggtacgggacgtaaagggactaaggtcggtacctaccgttcttaccgtacaccgtccctacccgaaccgacggtccctagttccccgg

SEQ ID NO: 293092 - DNA, 701 bp, Homo sapiens
  misc_feature: GYAE6OF01CPOGX.43.66.F11.1.454.CMB.1.raw
  modified_base (308)..(308): a, c, t, g, unknown or other
  misc_feature (308)..(308): n is a, c, g, or t
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcaggagtcgggcccaggactggtgaagccttcggacgaccctgtccctcacctgcactgtctctggtcgctccatcagcagcagtacttacttcgtgggctggactccgccacgccccgaggggagggctggagtggagttgggagttatttaccgacgtaggtcgggacnccgaaccctacctaaccgaaccccgtacctaacgaaaaacggtccgaacggaccaacctaatactccggtaacgaaccgtaaccgtaccaaaacgaaaccctaaatttccctacccgtaggaaacgtcgtacggaacgtccttcgtcggttaccgaccccggaccgacgaacggacctaacgggtccttggttacctttacgttacgtggtacgccggaaccggtcccccgaggccgtaccgtaggttcgttcgtttttagacgttcgtaccttttagaagttacgtgggtaccggggaccaaaggggtactaaggttccgggtacctaaccggttccttacgttcgaccgtcccctaccgaacccgtaaaccgggccctacggttcccccgg

SEQ ID NO: 293093 - DNA, 793 bp, Homo sapiens
  misc_feature: GYAE6OF01C189Q.43.66.F11.1.454.CMB.1.raw
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcaggagtccgggcccagggactgggtagaagcctttcgggacgaccctgtcccctcacctgcactgtctctggtgctccatcagcagcagtactttacttcgtggggctggactccgccacggcccccgaggggaacgggctgggagtggtagttgggtaagttactttaccgacgaggttgggacgaccgtaacctaacctaacccgtaaccccggttaccctaacgtaaaaacggttccggaacggccaaccgtactaacgtacccggtaagaaaccgaaccgttacccaaaacgtaaaccctaaacgtttccctacccgtaaggaacgtaccgtacggaacgttccgttacgttcggtacccggtaaccccgacccgaccgaaacggaacccgtaccggtcctttacggttaccttaacgtttacgtggttaccggccggacccgggccccgaggtcccgtaccgtagggtttccgttttcgttttttaggactttcggttccgttttaggaacgtttaggttacgggtaccggggtaaccgtaaaggggtaccgtaaggttcgggtcccgttacccgttccgttacgtttacccgacccgttccccgtaaccccgaacccggtaaccgggtcccccttaaaggttcccccgg

SEQ ID NO: 293094 - DNA, 694 bp, Homo sapiens
  misc_feature: GYAE6OF01D9EAT.43.66.F11.1.454.CMB.1.raw
  modified_base (307)..(307): a, c, t, g, unknown or other
  misc_feature (307)..(307): n is a, c, g, or t
  modified_base (566)..(566): a, c, t, g, unknown or other
  misc_feature (566)..(566): n is a, c, g, or t
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcaggagtcgggcccaggactggtgaagccttcggacgaccctgtccctcacctgcactgtctctggtgctcatcagcagctagttacttactcgtgggctggactccgcacggccccgagggacggcgtggagtggagttgggaagttacgttaccacgtaggtgggacncctaacctactaaccgaaccccgttaccctaacgtaaaagtccgaacggacctaaccataacgtccgtaacgactaaccggtaccaaacgtaaccgtaactttcctaccgtaggaaacgtcgtacgaacgtctacgtagtaccggtacccgccgtacacggaaccgtaccggtacttacgttacttaagtttaccgttcggttacggacccggaccggtaccccggaggtccgacgtggtttccgtttcgtttttacgnttaccgttccgttttagagttacggttcgggtacgggaccgtaaaggtaccgtaagttcggtaccaccggtttcctcgttaccgaccgttcccgacccgtaaccggaacgtcccgtacgtttccccgg

SEQ ID NO: 293095 - DNA, 582 bp, Homo sapiens
  misc_feature: GYAE6OF01A0FSI.43.66.F11.1.454.CMB.1.raw
  modified_base (433)..(433): a, c, t, g, unknown or other
  misc_feature (433)..(433): n is a, c, g, or t
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgactccatcagcagcagtacttacttcgtggggctggactccgccacgcccccgagggagggctggagtggagttgggagtatttaccacaggtgggagcacctacacaacccgtcctacaaaagtcgaggcaccatactccgtagaccacgtaccaaagaaccaattctccctagaacgctagagctcgtcgtacgacccgccgacacgacacggctgtctattactgngcgacggcccgagccgctagtcggtctttttgacttcgtcctttagacgttagtcggtcgggggaccgtaaagggaacaagttcggtcctacccgttctactttccgacgtccctacccgaaccgaaccgggtccctacggttccccgg

SEQ ID NO: 293096 - DNA, 759 bp, Homo sapiens
  misc_feature: GYAE6OF01AP4F2.43.66.F11.1.454.CMB.1.raw
tcagtgtgagtagtcacgaccggtgctcgatttagtcacgcgagaagggggagtctcatgtgcaacgaaaatgaagcacctgtggttcttcctcctgctggtggcggctcccagatgggtcctgtcccagctgcagctgcaggagtccgggcccaggactgggtgaagtccttcggagtaccctgtcccctcacctgccactgtctcgtggtcgcctcgatcgagcagctaggttaccttacgttcgtgggtctcggactcccgccgaccgcccccgaaggggaacgggtcgtggagttggtagttgggtagttactttaccacgtaggtggacgccaaccttacgtacccgtaacccgtaccctaacaaaggtccggaggaccacgtaatacgtccgtaagacctaccgtacgaaacgtaacctaacttcctacctagaacgctacggactctccgtgtaccgacccgaccgacgaacggtaccgtacccggtactacgttaccttaacgttaccgtcggttacggacccggtaacccggacccccggagtcccgtaccggttaacggtttcgggtttactttttacggacgtttaccggtttaccgtttaacgtggttaaccggttacgggtaccgggggtaaccgtaacggggtaaacctaagggttcccggttacccgttaccggttcccttacgttccgaacccgtaccccgttacccgaacccgggtacgtcccccgtcggtttaccccccgg

SEQ ID NO: 293097 - DNA, 789 bp, Homo sapiens
  misc_feature: GYAE6OF01D0SUL.43.66.F11.1.454.CMB.1.raw
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcaggagtcgggcccaggactggtagaacgccgttcggacgacccctgtcccctcacctgcctactcgtctcgtggtacgcctccatcagcagactagtaccttacgtcggtggggctaggactcccgaccgaccggaccccggaaggggaacgggcgtagggaggtggtagttcggggtaacgttacttaaccgacgtaggtagggacgtaccgtaacccttaaccgtaacccgtaaaccccgttacccgtaaacgtaaaaacggtccggaaaccggaccaaaacctaacgttaaccgtaacccggtaaacgaacccgtaaaccggtaacccgaaaacgtaaaaccctaacttacccgtacccgtaaggaaacgtccgtacggacgtactcgtacggtaccggacccgccgacgaacgaaccgaccggtacttacgttaccttaacgtttacggtcggtccggaccggtaccggccccggaggaccgtacgttacggtggttttaccttttagacgtttcgttaccgtttaggtaacgttggttacgggacggtaaccggtaacgggaatacggttacggtaccgttaccgttccgttcgtaccgcccgtaccctacccggaacccggtacggtacccctggttacccccgg

SEQ ID NO: 293098 - DNA, 1017 bp, Homo sapiens
  misc_feature: GYAE6OF01DPZY1.43.66.F11.1.454.CMB.1.raw
  modified_base (245)..(245): a, c, t, g, unknown or other
  misc_feature (245)..(245): n is a, c, g, or t
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcaggagtccgggcccaggacgtggtagaacgtccgttcggacgaccctcgtccctcacctgcactgtctcgtggtcgacctcatcagcagctagttacttacttcggngggtctggactcccgaccgaccggacccccggaaggggaacgggcgtagggtaggtgggtaagttgggtaacgttaacgtttaaccgaacgtagggtcgggaacgtacctaaacccgtaaccgtaaacccgtaacccccgttacccgtaaaacggtaaaaaccggttccggaaacggtacccctaaaccgtaaacgtttaaccggtaacccggttaaacgaaacccgtaacccggttaaaaccccgaaaaaccggaaaacccctttaaaccgtttccccgttaaccccggtaagggtaaaccgtacccggtttaacggtaaccggttccgtttacccgggtttacggtaaccccgggtaccccccggaacccggttaaccgaaacccggggtaaaccccgtaacccgggttaccgtttaacgggtttaaccctttaacgtttaccgggtacgggtttacgggaccccgggtacccgggaaccccggtacggtccggtaaccggttacgggtttccgggttttaccgtttttaggaccgtttccggtttaaccgttttaggtaacgttacggggttacggggtaacggggtaaacccggtaaacgggaaaccgtttaaccgggtttccgggtaacccccgttaccccggttttaaccgtttaccccggttaaccccgtaacccgggtaaccccccccgtttacccgggtaaaaacccccgggtaaccccgggggttaccccccgtttaaacccgggtttttcccccccccggg

SEQ ID NO: 293099 - DNA, 663 bp, Homo sapiens
  misc_feature: GYAE6OF01AC0YM.43.66.F11.1.454.CMB.1.raw
  modified_base (185)..(185): a, c, t, g, unknown or other
  misc_feature (185)..(185): n is a, c, g, or t
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcaggagtcgggcccaggactggtgaagccttcggataccctgtccctnacctgcactgtctcgtggtcgctcatcagcagcagtacttacttcgtgggctggactccgccacgccccgagggacgggctaggagtggagttgggagttacttaccgacgtaggtagggacgtccgtaaccttaccgtaaccgtaaccccgttccctaacgaaaacgtccgaacgggtaccaaccgaacttacgttaccggtaacgaaccgtaaccgtacccaaacggaaacctaacgttccctaccctaacgaaacgtcctagacgtcttccgttagtaccgaccccgtcgaccgacgaccgacgtctctacttactacgtgtcgcgtacccgaccggacgcgtacggtagtcgtttacttagtaccgttcgttcgttagtacgtacgtgggtacgggacgtaaagtacgtaggtcgtaccgttacgtccgtacgtacgacctcccgaccgaaccggcgtaccgttccggttcccg

SEQ ID NO: 293100 - DNA, 527 bp, Homo sapiens
  misc_feature: GYAE6OF01BJ80E.43.66.F11.1.454.CMB.1.raw
  modified_base (185)..(185): a, c, t, g, unknown or other
  misc_feature (185)..(185): n is a, c, g, or t
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctnacctgcactgtctctggtgctccatcagcagcagtacttacttcgtgggctggatccgccagcccccgagggaacgggctggagtggattgggagtatttaccacagtggagcacctactacaaccgtccctacaaagtcgagcaccatagtccgtagacacgtacaacgaaccaattcctacctgaacgctgagctctgtcgaccgccgcacgacacgctgtactacttactgtgcgacggcccgagcgcgagttgtcttttgatgtcctttgatatggtagggccgaaggacaagtgtcacgttctcttcacgtccctaccgaccacggccctagtcccg

SEQ ID NO: 293101 - DNA, 636 bp, Homo sapiens
  misc_feature: GYAE6OF01CBZJ3.43.66.F11.1.454.CMB.1.raw
  modified_base (302)..(302): a, c, t, g, unknown or other
  misc_feature (302)..(302): n is a, c, g, or t
  modified_base (347)..(347): a, c, t, g, unknown or other
  misc_feature (347)..(347): n is a, c, g, or t
  modified_base (366)..(366): a, c, t, g, unknown or other
  misc_feature (366)..(366): n is a, c, g, or t
  modified_base (374)..(374): a, c, t, g, unknown or other
  misc_feature (374)..(374): n is a, c, g, or t
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtcccctcacctgcactgtctctggtggctccatcagcagcagtacttacttcgtggggctggactccgccacgccccgagggagggcgtggagtggagttgggagtattaccagaggtggganccacctactacacccgtcctacaaagtcgagcacatactccgtanacacgtacaacgacatccncctagacnctagactctctgtcgaccgccgcacgaccgacggctgttacttattaccgtgtcgacggaccggccccgagccgacgtaggtcggtttcgttttacgagttcgttccgttttagaatttacgggttcgggtcgggggtaacccgaaacggggtaactaacggttcgggttacccgtaacccggtttccgttcccgttaccgacccggttaccccctaaccccgaaaccccggtaacggggtccccctacggtttcccccggg

SEQ ID NO: 293102 - DNA, 768 bp, Homo sapiens
  misc_feature: GYAE6OF01CHFPT.43.66.F11.1.454.CMB.1.raw
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcgagggacggtccgggcccgagggacgtgggtagaacggtccgttacgggacgtacccctcgtcccctcaccgtgcctacgttcgtctcgtgggtcggacctccatcaagcagactacgttacctttacgttcggtggggctggacctccgccgaccggccccggaaggggaacgggcgtgggtagtggtagttgggtattacttaccgacgtgggtcgggacgacctaaccgtaaccgtacccgtaaccccgttaccgtaacgtaaaacggtccggaacggaccaaccgtaattaaccgtaccggtaacgtaacccaaccgtaaccgaaaacgtaaccctaacttcccgtaccgtacgaacggtcgtaggacgtcttacgtcggaccggacccgcgacgtaccgacgtcggtacttcgttacgttacgtaccgtggtaccgaccggacccggtcccgaggccgtagtacgggttgtttactttaggcgttcggttctttagacgttaggtcggggtaaccggtacggaaaggtacgttaacgggttcccggccttaaccggtctttacccgacgtacccgtacccctacccgaaacccggtaccgggtccccgttaacggttccccccgg

SEQ ID NO: 293103 - DNA, 728 bp, Homo sapiens
  misc_feature: GYAE6OF01DW8ED.43.66.F11.1.454.CMB.1.raw
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcaggagtccgggcccaggacgtggtgaagccttcggacaccctgtccctcacctgctactgtctcgtggtgctccatcagcagcattacttcttcggtgggctggactccgaccaccgaccccggaggggacgggcgtggaggtggtagttagggtattacgttaccgagtaggtcgggactccgtaacctactaacccgaccccgtacctaacgaaaacgtcgaacgacacctactaactaccggaacgtacctaaccgtaaccgaaacgtaaaccctactttccgtacctacggatccgtaggactctcgtcgtacggacccgccacgacgacccgtacgtcgttacgtacttaacgttccggtgaccggtccgggtaccggaccccgtaggccggtaccggttagggtttcggtttccgtttttaggaccgtttcggttaccgtttaggtagttgggtacggggtacggtaaaccgggtaaaggccgttaaagggttccggtaccttcccggttccgtttacgttaacccgaccgttaccccggaccccggaaaccgtaccggggtccccctacgggtttacccccgg

SEQ ID NO: 293104 - DNA, 702 bp, Homo sapiens
  misc_feature: GYAE6OF01E35X3.43.66.F11.1.454.CMB.1.raw
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcaggagtcgggcccaggactgggtgaagccttcggagacccctgtccctcacctgcactgtctctggtggctccatcagcagcagtacttacttcgtggggctggactccgccacgcccccgaggggaacggggctgggagtgggagttgggagttactttaccgacgtaggtgggagccacctaactaccgaaccccgttccctacaaaacgtcgacggaccaaccactaactccgtaagaccaccgtaccaaacgtaaccaacttcctaccctagaacgctaggacgtctctcggtcgacccgcgccacgaccgacggtcttcgttaccttaagttaccgtaggtcggaccggtaccggccccggaggccgtccgaggtttcggttcgtttttcggacttcggttacccgttttaggtaacgttacggttcgggtacgggggacccgtaaaaggggtacctaaggttccgggtaacccgtaccccggtttcttacccgttaccacccggtcccctacccggaaaccccggtaaccggggtccccctacccgggttttccccgg

SEQ ID NO: 293105 - DNA, 618 bp, Homo sapiens
  misc_feature: GYAE6OF01DXR3G.43.66.F11.1.454.CMB.1.raw
  modified_base (323)..(323): a, c, t, g, unknown or other
  misc_feature (323)..(323): n is a, c, g, or t
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctcgtggtggctccatcagcagcagtacttacttcgtgggctggactccgccacgccccgaggggaagggctggagtggattgggatattaccacgaggtggagcacctactaaccacccgtcctanaaaagtcgaggcaacatactccgtagacacgtacaaacgtaacctaacttcctcctagaacgtctaggacgtctacgtgtacgacccgcgacgagacacggtctgtactattacgtgtcggccgaccggaccccgaggccgtcgtacggttcggtttccgtttttagacgtttcgttcctttaggtattacggtgggttccggggaaccgtaaagggtaacctaagttcgggtacctaccggttctaccgttcaccgtccctacccgaaccgaacgggtccctacggttccccgg

SEQ ID NO: 293106 - DNA, 810 bp, Homo sapiens
  misc_feature: GYAE6OF01B2XH0.43.66.F11.1.454.CMB.1.raw
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcgaggacgtccgggcccagggactgggtagaacgtccgttcggacgtacccctcgtccctcacctgcctactgtctcgtggtcgcctccatcagcagactagttaccttacgttcgtggggctggactccgccgaccggaccccgaggggaacgggctgggagtggtagttggggaagttacgttaaccgagtaggtcggggacgacctaaccgtaactaacccgaacccgttaccctaacaaaaacggtcgacggtaccaaccgtacgtacgtaccgtaagaacctaaccgtaaccaaacgtaaaccctaacttacccgtacccgtaacggtaacgaccgtaggtaacgtccgttccgttacggtaccgggaccccggtacccgacggtaaaccggtacccgaaacccggtcgttaacgttaacccgtttaaacgttacccggttaggtaccggaacccgggtaacccggggacccccggaaggtcccggtacgtaacgggtttccggttttaaccgtttttcgacgtttccggttaccgttttaggaaaccgtttaggtcgggtaccggggaacgtaaacgggtacgtaaacggttcggtaccgtaccggttacctccgttaccgaccgttccccgaccgtaacccgaacgggtcccctacggttccccgg

SEQ ID NO: 293107 - DNA, 686 bp, Homo sapiens
  misc_feature: GYAE6OF01AMY5B.43.66.F11.1.454.CMB.1.raw
tcagtgtgagtagtcacgaccggtgctcgatttagtcacgcgagaagggggatctcatgtgcaaagaaaatgaagcacctgtggttcttcctcctgctggtggcggctcccagatgggtcctgtcccagctgcagctgcaggagtccgggcccaggactggtgaagccttcggacgaccctgtccctcacctgcactgtctcgtggtgcctccatcagcagctagttacttacgttcgtggggctggactcccgaccacgccccggaggggacgggcgtgggaggtggtagttggggagttacttaccgacgtaggtgggacacctacctactacccgaacccgtaccctaacgaaacggtcgacggaccaccatacgtaccgtaacacctaccttaccaaacgtaacctaacttcctaccgtagaacgtccgtagacgtccgtacgtcggtaccgacccgccgacgtaacggaccgtaccggtcttacgttacttacttacgtcgtcggacccggtaccggcccgaggtccgccgttaggttcggtttacgttttgacgttccgttcgtttagtacgttaggtcgggtacgggaccgtaaggtacgtaaggtccggtacctccgttccgtccgttaccgacccgtaccctacccgaaccggaccggtcccctcggttacccccgg

SEQ ID NO: 293108 - DNA, 805 bp, Homo sapiens
  misc_feature: GYAE6OF01AH1XG.43.66.F11.1.454.CMB.1.raw
  modified_base (245)..(245): a, c, t, g, unknown or other
  misc_feature (245)..(245): n is a, c, g, or t
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcaggagtcgggcccaggactggtagaacgtccttcggacgaccctcgtcccctcacctgctacgtgtctgtggtcgcctccatcagcagctacgtacttacgttcggngggtctggactcccgccgtaccgacccccggtaaggggacgggtcgtgggtacggtggtagttagggtagttaacttaccgagtaggtacgggacgacccaaccgtaacctaacccgtaaccccgtacctaacgaaacggtccgaacggtaccaaccgtataaccgtccgtaacgaccgaaccgtaaccaaacgtaaccgtacttaccgtaccgtagtaccgtcgtacggactcgtacgtagtacccgacccggtaccgacgtaacggaccgtacggttaccgttacggttaacctttaacgtttacccgttaggtaccggggaccccggtacccgggtacccccggaggtacccggtacgttacgggtttcggttttacctttacggtaccgttcggttaccgttttacggtaacgtttacgggttcggggaaaccgggtacggtaaaggggtaaccgtacggttccgttaacccggttaccgtaccttaccttaaccccggaccgtacccccgttaaccgaaaccccggtccggtccccgttaccgttaccccccggg

SEQ ID NO: 293109 - DNA, 740 bp, Homo sapiens
  misc_feature: GYAE6OF01B9Z47.43.66.F11.1.454.CMB.1.raw
tcagtgtgagtagtcacgaccggtgctcgatttagtcacgcgagaagggggatctcatgtgcaagaaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtcgctccatcagcagctagtacttacgttcgtggggctggactccgccacgccccgaggggagggctggagtggagttgggagttacgtttaccgacgtaggtgggacgcctacctaacctaccgaaccccgtccctaacgaaagtcgacggaccaccatactaccgtagacacgtaccaaacgaacctaacttcctaccgtagaacgtctagacgtcctcgtgtccgaccgccgacacggaccgaccggtcgttacgttacttaagttaccgttggtacggccggtacccgggccccgacggtccggtacgtacggtttcgggttaccgttttttacggacgtttaccggttaccttttaggtaacgtttacgggttaggggtaccggggtaccggtaaaacgggtaacgtaacggttccgggttacccgttaacccggtttccgttacccggtttacccgtaacccggttacccccgttaacccccggtaaacccgggtaccccgggttaccccgttaccgggtttccccccggg

SEQ ID NO: 293110 - DNA, 672 bp, Homo sapiens
  misc_feature: GYAE6OF01AIR3T.43.66.F11.1.454.CMB.1.raw
  modified_base (231)..(231): a, c, t, g, unknown or other
  misc_feature (231)..(231): n is a, c, g, or t
  modified_base (304)..(304): a, c, t, g, unknown or other
  misc_feature (304)..(304): n is a, c, g, or t
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctcatcagcagctagtacttacttcgngggctggactccgccacgccccgagggagggcgtggagtggtagttgggattacttaccacgaggtgggaacncacctaactacctaacccgtcctacgaaacgtcgagaccacctatacgtccgtacgaccaccgtaccaaacgaacctaactttccgtacctaggaactccgtaggacgtccgttacgtcggtacggaccccgtcgacgacgaccgacggtccttacgtccttaagttacgttcggtcggacccggcgggtacccccgaggaccgtcgtacgggttcggtttaccgtttttggaacgttcggttacctttaggtacgtttacggtcggggtacgggaccggtaaacgggacgtaacggttcggtaccgtaccgtcttccgtacgaccggtccctacgaacccggtacggtcccgtaccgtttccccggg

SEQ ID NO: 293111 - DNA, 696 bp, Homo sapiens
  misc_feature: GYAE6OF01BDPN0.43.66.F11.1.454.CMB.1.raw
  modified_base (652)..(652): a, c, t, g, unknown or other
  misc_feature (652)..(652): n is a, c, g, or t
  modified_base (666)..(666): a, c, t, g, unknown or other
  misc_feature (666)..(666): n is a, c, g, or t
tcagtgtgagtagtcacgaccggtgctcgatttagtcacgcgagaagggggatctcatgtgcaagaaaatgaagcacctgtggttcttcctcctgctggtggcggctcccagagtgggtcctgtccagctgcagctgcgaggacgtcgggacccaggacgtggtagaacgccgttcggacgaccctgtccctcacctgctactcgtctgtggtcgctcatcgagcagactacgttacttacgttcgtgggctggactccgaccaccggacccggaaggggacgggcgtagggtaggtcggtaggttagggtacgtttaacgttaaccgacggtagggtacgggactaccgtaaccttaaccgtacccgtaaccccgtaccctaaacgaaaaccggtccggaacggacctaaccgttaacgtaaccgtaccggtaaacgaaccgtaaccgtaacccgaaacgtaacctaacttcctaccgtagaacgtcgtagactcgtcgtacgtaccgaccgcgacgacgaccgacgtcgtacgttacgttacgtcgtcggtacgccggtaccgcccgagcgtacgttaggttcgttacgtttagccgttcgttcgttagtacgtggtacggacggacgtaagggacttaacggtcgtacnccgttctacgttcncgtcccgtacaaccggcgccgtcggtcccg

SEQ ID NO: 293112 - DNA, 857 bp, Homo sapiens
  misc_feature: GYAE6OF01EF5F2.43.66.F11.1.454.CMB.1.raw
  modified_base (192)..(192): a, c, t, g, unknown or other
  misc_feature (192)..(192): n is a, c, g, or t
tcagtgtgagtagtcacgaccggtgctcgatttagtcacgcgagaagggggatctcatgtgcaagaaaatgaagcacctgtggttcttcctcctgctggtggcggctccagatgggtcctgtcccagctgcagctgcaggacgtccggaccaggactgggtagaacgtccgttcggacgtccctgtcccctnacctgacctactgtcctacgtggtcgactccgatccgaagtcagtctacgtaccttgttcggtgggacttggactccgaccgaccggtacccgtaaggggacggcgtaggtaggtaggtagttaagggtacttaccggttaccgaggttaggtacgggactacctacccgttaaccgtaacccgtaaccccgttcctaaacggtaaaaccggtcggtaaccggacctaaccttaaagttacccgttaccggtaacgtaacccgtaacggaaccaaaacgtacccgtaaacgttcccgtaacccggttacgaaacgttacccgtaggtccgtaacccgtttacggtccggttaacccggcccgttaacccggcgtaaaccggtacccgttaaacccgggttcttaccggttaaaccctagttaccggtacgttaaccggaccgttaaccggcccgtaaacgttcggtattacggggtctttttcggtactcggtaactttacgttaggtaaccccgtagggtttaccgggtaacccggggtaagtaaacggaaaccgtttcgggtcccgggttaaaccctttccggttacccgttaccgttacccggtaaacgtacccccgttaccgaaaccggttcggttaacccccgttgttaacccccccggg

SEQ ID NO: 293113 - DNA, 776 bp, Homo sapiens
  misc_feature: GYAE6OF01BTQC7.43.66.F11.1.454.CMB.1.raw
tcagtgtgagtagtcacgaccggtgctcgatttagtcacgcgagaagggggatctcatgtgcaaagaaaatgaagcacctgtggttcttcctctgctggtggcggctcccagatgggtcctgtcccagctgcagctgcaggacgtccgggcccaggactggtagaagtccgttcggacgaccctcgtcccctcacctgcctactgtctcgtggtcgctccatcagcagctacgttaccttacgtcgtgggctggactccgccgaccgccccggaggggaacgggcgtagggagtggtagttagggtagttacttaccgacgtaggtacgggacgacctaacctaccgtaacccgtaaccccgttaccctaacgaaaacggtcggaacggccaaccgtactacgtaccgtaacgaccaaccgtaccgaaaccgtaacctaacttcctacccgtaagacgtctacggtacgtcgttcgtacggtaccgacccggtccgaacgtaacggaccgtacggtcttacgttaccttaacgtttacgtcgggtacgacccgggacccgggccccgacggtccggtacgttacgggtttcggtttaccgttttagacgtttcgtttacgtttagtacgttagggtacgggtacggggtaaccgtaaacggggtaccttacgggttccggttacccgtaccggtttccgttacccgttacgaccccgtacccgttaaccccggtaaccgggtaaacccggtccccgttaaccggtttccccccggg

SEQ ID NO: 293114 - DNA, 745 bp, Homo sapiens
  misc_feature: GYAE6OF01DWPG6.43.66.F11.1.454.CMB.1.raw
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcaggagtccgggcccaggactggtagaacgccgttcggacgaccctgtcccctcacctgcactgtctcgtggtcggctccatcagcagctagttaccttactcgtgggctggactccgccacgccccgagggacgggcgtggaggtggtagttagggtagttacgtttaaccgacgtaggtcgggacgacccgtaacccgtaacctaacccgtaacccccgttacccgtaacgaaaaacggttccggaacggaccaaccgtactaacgtaccgtaacgaaccgaaccgtaacccgaaaacgtaaaccctaactttcccgtacccgtaaggaacgtacgtaggactaccgttcgtcggtaccggacccgaccgacaacggaccgtaccggtcttcgtacttactttcgtcgtcgaccggccggcccgagccgcgtaggttcggttcttttgcgttcgttcctttaggtacgttaggtgggtccggggaaccggtaaacgggtacgtaaggtttccggttacccgtacccgttccgtttaccgttaccgacccgttccccgaaccccggtaacccggaacccgggtcccccgttaaccggttcccccggg

SEQ ID NO: 293115 - DNA, 795 bp, Homo sapiens
  misc_feature: GYAE6OF01BDNKJ.43.66.F11.1.454.CMB.1.raw
  modified_base (223)..(223): a, c, t, g, unknown or other
  misc_feature (223)..(223): n is a, c, g, or t
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcaggagtccgggcccaggactggtgaagcccgttcggacgaccctgtccctcacctgcactcgtctcgtggtcgctccatcagcancgacgttacttacgtcgtgggtctggacctccgccgacgaccccgagggacggcgtggtagtaggtacgttaggtacgttacgttaccgacgtaggtcgggacacctaaccgttaaccgtaacccgtaacccccgttaccgtaaaccgaaaaacggtccggaacgtacctaaccgtaacgttaaccggtaacccggtaaagtaccccgtaaaccggtaacccgtaaaacgtaacctaacgtttccccaacccgttacggaacgtcgtacggtacgtccttacgttcggtaaccgcccgtaccggacgtaacgtacccgtaccgacgtttacgtacgttaacgttccgttacgtcggaccggtaccggtccccggaaggtaccggtacggtacggtttcggtttaccgttttagtaccgtttacgttcccggtttagtacggttacggtagggtaccgggtaacccggtaaggtaacggtacggttcggttacccgtaccggttccgttacttacccggaccgttaccctaccccgtaacccggtaaccgtccccgtacggtttaccccccgg

SEQ ID NO: 293116 - DNA, 776 bp, Homo sapiens
  misc_feature: GYAE6OF01DG6NA.43.66.F11.1.454.CMB.1.raw
  modified_base (218)..(218): a, c, t, g, unknown or other
  misc_feature (218)..(218): n is a, c, g, or t
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgccactgtctcgtggtcgctcatcagcancagtacttacttcgtgggactggactccgcccacggacccccggaggggaacgggccgtgggaggtcggtagttaggagttacttaccacgtaggtggtacgccgtaacctaacctaacccgaaccccgttcccgtaactaaaaacggtccggaaggacccaaacctacttaacgttaccggaacgaaccgtaaaccgtaacccgtaaaacgtaacccttaacttccgtacccctaaggaacgtcgtagacgtcctacgtcgtccgtaacccgcccggtagaaccgaccgtaccgtcgtacgttacttacgttacgtcgtcggaccggaccggtaccccgagtacccgtagtcggttacggtttccgttttttaggacgttggttacccgtttagttaacgttacgggttagggtaccggggtaacccgggtaaagggtaaccgttaacgggtccgggttacccgttaaccggtttcccttacccgtttaccgtaccccgtacccttaacccccggaaccggacccggggttaccccctaccgggttttacccccggg

SEQ ID NO: 293117 - DNA, 745 bp, Homo sapiens
  misc_feature: GYAE6OF01EYV4V.43.66.F11.1.454.CMB.1.raw
  modified_base (251)..(251): a, c, t, g, unknown or other
  misc_feature (251)..(251): n is a, c, g, or t
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcaggacgtccgggcccaggactgggtgaacgccttcgggacgtaccctcgtcccctcacctgcctactcgtcctcgtggtcggcctccatcacgcagctacgtacttacttcgngggctgactccgccacggccccgaggggacgggtctagggtagtggtacgttggggacgttaactttaccgacgtaggtcggggacgcctaaccttacctaacccgtaacccgttaccctaacgtaaaacggtccggacgggtacctaaccgtaagttacgtaccggtacgaaccgtaaccgtaaccgaaacgtaaccctaactttcccgacgtaacgaacgtacgttaggaacgtcttacgttcggtaccgtaaccccgtccgtacgaacgaccggaccggtcttcgttacgtttaacgttcgtcggtcggaccggtaccgggcccccggtagccgtactagggttcgtttacgttttagacttggttacccgtttagtacgtttacggtcgggtacgggtaccgtaaacgggtaactacggtcgtaccggttccgttaccttccgtacgacccgtaccgtacccacggttaaccggtcccctcggttccccg

SEQ ID NO: 293118 - DNA, 820 bp, Homo sapiens
  misc_feature: GYAE6OF01B2VKN.43.66.F11.1.454.CMB.1.raw
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcgaggagtccgggcccaggactggtgaagtccgttcggacgaccctgtcccctcacctgccacttgtctcgtgggtcgctccatcagcagctagtaccttacgttcgtgggctggactcccgccgacgacccccgaggggaacgggcgtgggaggtggtagttaggggtagttacgtttaccgacgtaggtggggacgtaccgacccgttaaccgtacccgtaaccccgtacccgtaacgaaaaacggtccggaacggaccgtaacctaacgttacgtaccgtaacgaaccgtaaccgtacccgaaacgtaaaccctaacttccctaccgtagaacgtcgtacgacgtccttcgtacggtacgacccggccgacgaacgaccgaccggtcttcgttaccttacgttacgtacggtccgaccggtacccgggccccgaacggtccggacgtacgggttcggtttacgtttttagggcgtttccggtttacctttaggtaacgtttacggttcggggttaccggggtaacccggtaaaacggggtaaccgtaacgggtttaccgggttaccccgttaaccccgggtttcccttacccggtttaccgtaaccccggttcccccgtttaaccccgggaaaccccggtaacccggggttacccccgtaacccgggttttccccccggg

SEQ ID NO: 293119 - DNA, 802 bp, Homo sapiens
  misc_feature: GYAE6OF01DDOEX.43.66.F11.1.454.CMB.1.raw
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcaggagtcgggcccaggactggtagaacgccttcggacgacccttgtccctacaccttgccacttgtcttcgtggtcggtcctccatccgacgcagtcctaacgttaccttttacgttcggtcggggtcttcggaccgtcccggccgaacccggacccccgggaaggggggaaacggggtcgttagggggtaaggtcggggttaaggttaggggtaacgttaccttttacccgaacggttagggtacggggacgtaccgtaaccttaaccctaacccgaaccccgttacctaacgaaaacgtcggaacgtaccaaccgtagtaaccgttaaccgtaacgaaccgaccgttaaaccgaaaacgtaacccgttaacttcccgtacccgtaggaaccgtctacggtacgtcctaacggtcgtaccgacccgtccgacgacggtacgaccggttctagttacctaacttccgtaggtccgaccgggacccgcccggtacgtccggcgtacgggtacgttttcgtttacgtaggtttcgttaccgtttgtaaggttcgtgggtaccgggtacgaaacgggtactacgggttccgtaccctccgtttcttaccgttacaccggttccccgaccgtaaccccgggaacggtccccgttcggttaccccccgg

SEQ ID NO: 293120 - DNA, 852 bp, Homo sapiens
  misc_feature: GYAE6OF01B1BLG.43.66.F11.1.454.CMB.1.raw
tcagtgtgagtagtcacgaccggtgctcgatttagtcacgcgagaagggggatctcatgtgcaagaaaatgaagcacctgtggttcttcctcctgctggtggcggctccagatgggtcctgtcccagctgcagctgcaggagtcgggcccaggactggtgaacgccttcggacgaccctcgtccctcgacctgcactgtctcgtggtgctccatcagcagcagtacttacttcgtggggctggactccgaccgaccggacccccgaagggggaacggggtcgtagggacgtgggtagttaggggagtttacgtttaaccgacgtaggttggggaacgtaccgtaacccttaacctaacccgtaaaccccggttacccctaacgtaaaaacggttaccggaacgggaccaacctaacttaacgttaccgtaaaccggaaccgtaaaccggttaaccccgaaaaacggtaaacccctaaactttccccgttaaccccgttaaggtaaaacgtccgtttaacggaaccgggttccttaccgttacggggtacccgtaaccccgggccccggtaccggtaaaccggacccggacccggggttaccctttacggtttaacccgttttaagtttaacccgtacgggttaccgggaccggaccccgggacccccggtaagcccggtaccggtaaggtttcggtttacgttttcgacgtttcggttacccgttttagtaacgttacggttcgggtacggggtaaccggtaaagggtaaccttacgttacgggtcccttaccggttctacccgttcaccgtacccacccgtaacccggaacggtccccgtcgttaccccgg

SEQ ID NO: 293121 - DNA, 957 bp, Homo sapiens
  misc_feature: GYAE6OF01ATTMJ.43.66.F11.1.454.CMB.1.raw
tcagtgtgagtagtcacgaccggtgctcgatttagtcacgcgagaagggggatctcatgtgcaagaaaatgaagcacctgtggttcttcctctgctggtggcggctcccagatgggtcctcgtcccagctgcagctgcgaggagtccgggcccaggacgtggtagaacgtccgttcggacgaccctcgtcccctcacctgctacttgtctcgtggtcgactccatcgacgcgagactacgttacttacgttcgtggggtctcggacctcccgacccgaccggacccccggaagggggacgggtcggtgggtaggtcgggtaggttaggggtacgtttaacgttaacccgaacggtaggggtacgggtaaccgtacccgtaaccctaccgtaaccccgtaacccccggttaccctaaacggtaaaaccggtcggaacggacccgtaacctacgttaccgtaccggtaaccgtaaccgtaacccgaaccgtaaaccgaaccttaaccttacccgtaacccgtaggtaaccgtcgttaacggtacgtaccgttccggttacggtacccgggaccccgtacccgacgaacggtaccccgtaccgggttactttacggtttaacccgtttaacgtttaccgggttccgggtacgggtaaccccgggtacccggggaccccccggtagggtcccggtaccggttttacgggtttccgttttaccggtttttcggtaccgtttacccggttttaccgttttaacgggtacgtttcggggtttaaccgggggaaacccggggttaacccggtaaacggggttaaaccggttaccggggttccggttaccccgggtttaaaccggttttcccctaacggtttaccccgtacccggttaaccccccgtaacccgggaaaccccggtaacccccgggttccccgttaaccccggggtttcccccccgg

SEQ ID NO: 293122 - DNA, 867 bp, Homo sapiens
  misc_feature: GYAE6OF01AUQYP.43.66.F11.1.454.CMB.1.raw
  modified_base (268)..(268): a, c, t, g, unknown or other
  misc_feature (268)..(268): n is a, c, g, or t
  modified_base (845)..(845): a, c, t, g, unknown or other
  misc_feature (845)..(845): n is a, c, g, or t
tcagtgtgagtagtcacgaccggtgctcgatttagtcacgcgagaagggggatctcatgtgcaagaaatgaagcacctgtggttcttcctcctgctgggtcggcggcctcccagagtcgggtcctcgtcccagctgcagctgacgagggacggtaccgggcccaggacgtgggtagaacgtcccgttacggacgtacccttcgtccctacaccgtcgctactcgtcgtcgtaggcgactcatcagcaggtctagttccttacgtcggnggctggtacctccgtaccgaccggaccccggagggggacggtcgtaggtagtgggtacggttgggtacgttacgttaaccgagggtacggtacgggtacctaccgtaacccgttaaccgtaaccccgtaacccggtaacccgtaacggttaaaacggtacccggaacgggtacccgtaaccgtaagttaacccggttaaccggtaaacgtacccgtaaaccgtaaccgtaaaacccggtaaacctacccgtttaccctaaccggtacggtaaaccgtcgttaacggtaccgttaccggttaccgtacgggtaccgaaccccggtacggtaccgaaaccggcggtaccggttacctttaaggcctttaacggttacgtaccgggttacccgggaccgtaccccgggcccgtacggtccggtacttccgggttagtttaccgttttagccgggttactttaccggttaggtaagttccgggtaacgggttaccgggaacgtttaaacgggccgttacggggtccgttaacccgcgggtttcccttacggacccgtacccgttccacccgggttaaccgnggttacccctcggttaccccgg

SEQ ID NO: 293123 - DNA, 515 bp, Homo sapiens
  misc_feature: GYAE6OF02GH33A.43.66.F11.1.454.CMB.1.raw
  modified_base (455)..(455): a, c, t, g, unknown or other
  misc_feature (455)..(455): n is a, c, g, or t
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagccccccagggaaggggctgggagtggattgggagtatttaccacagtgggagcacctactacaaccgtccctcaaaagtcgaggcaccatatccgtagacacgtccaagaaccaattctccctgaagctgagctctgtgaccgccgcagacacggctgtctattactgtgcgagccccgagcgcagtggcttttgatgcctttgatntgtgggccagggacaagtggtcaccgtctcttcagtcctccaccgaagggcccatcccgg

SEQ ID NO: 293124 - DNA, 534 bp, Homo sapiens
  misc_feature: GYAE6OF02F0L86.43.66.F11.1.454.CMB.1.raw
  modified_base (370)..(370): a, c, t, g, unknown or other
  misc_feature (370)..(370): n is a, c, g, or t
  modified_base (470)..(470): a, c, t, g, unknown or other
  misc_feature (470)..(470): n is a, c, g, or t
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggagttgggagtatttaccacagtgggagcacctactaccaacccgtccctacaaaagtcggggacaccatatccgtagacacgtccaagaaccaattcncctgaacgctgacgctctgtgacccgccgcagacacggctgtctattacgtgtcgcgacggccccgagccgcagtcggtcttttgattcgtctttgattntggtgggccagggacagtggtcaccgtctcttcacgcctccgaccgaggccctagtccggtccc

SEQ ID NO: 293125 - DNA, 540 bp, Homo sapiens
  misc_feature: GYAE6OF02IDE8E.43.66.F11.1.454.CMB.1.raw
  modified_base (348)..(348): a, c, t, g, unknown or other
  misc_feature (348)..(348): n is a, c, g, or t
  modified_base (468)..(468): a, c, t, g, unknown or other
  misc_feature (468)..(468): n is a, c, g, or t
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttcgtggggctggatccgccacgccccaggggaagggctggagtggagttgggagttatttaccactaggtgggacgcacctactacaacccgtcctacaaagtcgaggcacatatccgtanacacgtcaagaccaattcctacctgaacgtctagagcttctgtcgaccgccgcagaccacggctgtcttattactgtcgacgacggcccgagcgcaggtcgtcttttgatgtctttgatntgtgggacagggactaagtcggtactaccgttctactcgacgccctccgaaccgacgggccctagttcccgg

SEQ ID NO: 293126 - DNA, 567 bp, Homo sapiens
  misc_feature: GYAE6OF02G1H2N.43.66.F11.1.454.CMB.1.raw
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttcgtggggctggatccgccacgcccccgaggggaaggggctgggagtggagttgggagtatttaccacgaggtgggagcacctactaccaacccgtcctacaaaagtcgaggcaccatactccgtagacacgtaccaaagaacctaattcctaccctagaacgctagacgctctgtcgaccgccgcagacacggctgtctattactgtgcgacgcccgagcgcagtggtcttttgagttgtcctttgattagtggtcgggaccaaggggtactaaggtcggtacctaccggttcttccgttcacgtccctccgaaccgtaacgggcccctagttccccgg

SEQ ID NO: 293127 - DNA, 565 bp, Homo sapiens
  misc_feature: GYAE6OF02IXAMY.43.66.F11.1.454.CMB.1.raw
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtggggagcacctactacaacccgtccctcaaaagtcgagcaccatatccgtagacacgtccaaagaaccaattctaccctgaacgctgagctctgtcgaccgccgcagacacggctgtctattactgtgcgacggcccgagccgcagtcggtctttttgattcgtccttttgattagtggttcggggaccgaaggggacctaagttcgggtacctaccggttcttccgtttccgacgtccctacccgaaccgaacgggcccctagttccccgg

SEQ ID NO: 293128 - DNA, 571 bp, Homo sapiens
  misc_feature: GYAE6OF02I3XOE.43.66.F11.1.454.CMB.1.raw
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttcgtggggctggatccgccacgcccccaggggaacggggctgggagtggagttgggagttatttaccgacgaggtggggagcacctactaccaacccgtcctacaaaacgtcgacggcaccatactccgtaagacacgtaccaaacgaacctaattcctaccctagaacgctgagctctgtcgaccgcgcacgacacggctgtctatacgtgtcgcgacggcccgagcgcagtcggtcttttgacttcgtcctttgagttagtgggtcggggaccaagggactaagttcggtacctaccgtcttcgttcacgtccctccgaccgacgggtcccacgttcccgg

SEQ ID NO: 293129 - DNA, 601 bp, Homo sapiens
  misc_feature: GYAE6OF02H5WRL.43.66.F11.1.454.CMB.1.raw
  modified_base (428)..(428): a, c, t, g, unknown or other
  misc_feature (428)..(428): n is a, c, g, or t
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagcagttaccttacttcgtggggctggactccgccacgcccccgagggaaggggctgggagtggagttggggagttactttaccacgaggtgggagccgaacctactaccaacccgtccctacaaaacgtcgagcaaccatactccgtagacacgtaccaaacgaacctaattcaccctagaacgctgagctcgtgtcgacccgcgcaagacncggctgtactattctgtcgcgacggcccgagccgacgaggttcggttcttttgagttcgtccgttttagattacgttgggtcggggtaccaaggggtactaaggttcgggtacctaccggttccttccttcgacgtcccctaccgaacccgaacgggtcccctagttccccgg

SEQ ID NO: 293130 - DNA, 687 bp, Homo sapiens
  misc_feature: GYAE6OF02FG9DZ.43.66.F11.1.454.CMB.1.raw
  modified_base (234)..(234): a, c, t, g, unknown or other
  misc_feature (234)..(234): n is a, c, g, or t
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcaggagtcgggcccaggactggtgaacgccttcggacgaccctgtccctcacctgcactgtctctggtgcctccatcagcagcagtacttacttcgnggggctggactccgccacgccccgagggacgggctggagtggtattgggattacttaccacgtagtggacactacctactaccacccgtcctacgaaaacgtcgacggcaaccatactaccgtacacacgtaccaaagtaacctacttcctcccgtagaacgtctagacgtctcgtcgtacgacccgccgacacgaccgacgctacgtactactacgtcgtcgccgaccggccccgtagcggtacgtacgttcggttactttttacgacgtttcgttaccttttaggaactttacgggttcgggttaccgggggtaaccgtaaacggggacctaacggttacccgggtacccgtaccccggtttaccttacccgttacccgtaacccggtcccccgttaaaccccggaaccccgggtaccggggttacccccctaacgggttttccccccggg

SEQ ID NO: 293131 - DNA, 621 bp, Homo sapiens
  misc_feature: GYAE6OF02G9ZHS.43.66.F11.1.454.CMB.1.raw
  modified_base (171)..(171): a, c, t, g, unknown or other
  misc_feature (171)..(171): n is a, c, g, or t
  modified_base (229)..(229): a, c, t, g, unknown or other
  misc_feature (229)..(229): n is a, c, g, or t
  modified_base (234)..(234): a, c, t, g, unknown or other
  misc_feature (234)..(234): n is a, c, g, or t
  modified_base (351)..(351): a, c, t, g, unknown or other
  misc_feature (351)..(351): n is a, c, g, or t
  modified_base (359)..(359): a, c, t, g, unknown or other
  misc_feature (359)..(359): n is a, c, g, or t
  modified_base (388)..(388): a, c, t, g, unknown or other
  misc_feature (388)..(388): n is a, c, g, or t
  modified_base (402)..(402): a, c, t, g, unknown or other
  misc_feature (402)..(402): n is a, c, g, or t
  modified_base (416)..(416): a, c, t, g, unknown or other
  misc_feature (416)..(416): n is a, c, g, or t
  modified_base (485)..(485): a, c, t, g, unknown or other
  misc_feature (485)..(485): n is a, c, g, or t
tcagtgtgagtagtcacgaccggtgctcgatttagtcacgcgagaagggggagtctcatgtgcaagaaaatgaagcacctgtggttcttcctcctgctggtggcggctccagatcgggtcctgtccagctgcagctgcaggagtcgggccaggactggtgaagcttcgganaccctgtcctcacctgcactgtctctggtcgctacatcagcagcagttacttcttcgngggcnggtatccgccgacgccccgagggagggcgtggacggtggagttgggagttacttaaccgacgtaggtggacgcaacctactaccaaccgtccaacgaaaacgtcgacgacacctaanactacganacgtactacaaacgaaccaacttctaccncgaatcctaggacnctactgacgaaccnccggacgtacgaacgaccgactcgttactaattacgtgttacgccggtacgcccgagcgcacggtcgtntttacgtacgttgtactttggtactagttacgggcgggtaccgtaacggtaggtaacgtacgggttcacccggtttaacgtcttacgtaccgtccctaaccgtaacccgggtaacgtccccgtaagttaccccggg

SEQ ID NO: 293132 - DNA, 623 bp, Homo sapiens
  misc_feature: GYAE6OF02IMJHV.43.66.F11.1.454.CMB.1.raw
  modified_base (158)..(158): a, c, t, g, unknown or other
  misc_feature (158)..(158): n is a, c, g, or t
  modified_base (227)..(227): a, c, t, g, unknown or other
  misc_feature (227)..(227): n is a, c, g, or t
  modified_base (301)..(301): a, c, t, g, unknown or other
  misc_feature (301)..(301): n is a, c, g, or t
  modified_base (434)..(434): a, c, t, g, unknown or other
  misc_feature (434)..(434): n is a, c, g, or t
tcagtgtgagtagtcacgaccggtgctcgatttagtcacgcgagaaggggagttcgtcatgtgcaagaaatgaagcacctgtggttcttcctcctgctggtggcggctccagatgggtcctgtcccagctgcagctgcaggagtcgggccaggctggngaacgccttcggagccctgtccctcacctgcactgtctctggtcgctccatcagcagcagttactcttntgggctggatccgcacgccccgagggaagggctggagtggagttgggaagttactttacccgagtaggtgggancctaacctaactaccgtaacccgtcctacaaaacgcgaacggcaacctataacttccggaagaccaccgtaccaaagaacccaatttccctacctcgaaacgtcctagacgtctcgttagcgaacccgccganacggaaccttcggctacgtctaactagttcgcgacgacgcccgagcgcgtagtccggttcttttgacttcgtcctttagcgttagtcggttacgggacgtaaacgggctaaacggtcggtaccttaaccggtccttcgtaaccgtcgtcccttacccggaacggaacccgggtcctaacggttccccgg

SEQ ID NO: 293133 - DNA, 614 bp, Homo sapiens
  misc_feature: GYAE6OF02JHP2I.43.66.F11.1.454.CMB.1.raw
  modified_base (204)..(204): a, c, t, g, unknown or other
  misc_feature (204)..(204): n is a, c, g, or t
  modified_base (479)..(479): a, c, t, g, unknown or other
  misc_feature (479)..(479): n is a, c, g, or t
  modified_base (485)..(485): a, c, t, g, unknown or other
  misc_feature (485)..(485): n is a, c, g, or t
tcagtgtgagtagtcacgaccggtgctcgatttagtcacgcgagaagggggatctcatgtgcaagaaaatagaagcacctgtggttcttcctcctgctggtggcggctcccagatgggtcctgtcccagctgcagctgcaggagtcgggcccaggactggtgaagccttcggagaccctgtccctcacctgcactgtctctggngctccatcagcagcagtacttacttctggggcctggactcccgccacgcccccagggacggggcctggacgtggagttggggagttagtttaccgaacgtaggtcgggagcgaccgtaactaccaaccccgtccctacaaaacgtcgaaggtaccaccgatactaccgtacgaccacgtaccaacgaaacctaattacctccgtagaacgctacgacgctactgtacgaccgccgcacgacacggctgtacctattactgtagcgacggccccgngcgacngtacggtctttttacgagttcgtccgtttagattaggtcggtgggtaccgaagggacgtacgtggtacgtacccggtcgttaccttgaccgttccctaccgaacccggtaacggccctagttaccccgg

SEQ ID NO: 293134 - DNA, 709 bp, Homo sapiens
  misc_feature: GYAE6OF02J0OWK.43.66.F11.1.454.CMB.1.raw
  modified_base (303)..(303): a, c, t, g, unknown or other
  misc_feature (303)..(303): n is a, c, g, or t
tcagtgtgagtagtcacgaccggtgctcgatttagtcacgcgagaagggggagtctcatgtgcaagaaaatagaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttactcgtgggctggactccgccacgccccgaggggaagggctggagtggagttgggagtacttaccacgaggtggganccaacctacgtaaccaaccccgtcctaacgaaacgtcgacggacaaccatacgtaccgtaagaccacgtaccaaacgtaaccgaacttacctacccgtagaaacgtctagacgtacctgttcggacgacccgacccgtacgaaccgacgtaccggtcgtacgttaccttaacgttaccgttggtacgtaccggtaccgggacccccgagtaccgaccgttaagggttcgtttcgttttaggaactttccggtaccttttaggtaacgttaggttcgggtacggggtaacccgaagggttaaccgtaaccggtcgggttacctaaccggttccgttaccgtttaccggtaccgtccccgtaaacccgtaaccggaaacccgggttacccgaccgttttaccccgggg

SEQ ID NO: 293135 - DNA, 701 bp, Homo sapiens
  misc_feature: GYAE6OF02HUNSY.43.66.F11.1.454.CMB.1.raw
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctcgtggtggctccatcagcagcagtacttacttcgtggggctggactccgccacgccccgaggggaacggggctagggaggtggagttgggagttactttaccgactaggtgggacgacaccgtaacctaaccgtaaccccgtaccctaacgaaaacgtcggaacggaccaacctataactaccgtaacgaccgaaccgtaccaaacgaaacctaacttacctacccgtagaacgcgttacgacgtctcgtcgtacgacccgaccgacgacgacgacggtacgtacgtaccttaacgttacgtagtcggaccggaccggccccggacggaccgacgtaggttcggttacgtttttacgtagttcgttcgtttagtagttacgtgggttacggggaaccggtacgggtaaaaaaaacgtacggtacgggttacccgtaccggttccttaccgttccgtaccgtaccctacccgaacccgaaccgggtacccgtaccgttacccgg

SEQ ID NO: 293136 - DNA, 627 bp, Homo sapiens
  misc_feature: GYAE6OF02J2FG3.43.66.F11.1.454.CMB.1.raw
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcaggagtcgggcccaggactggtgaacgccttcggagaccctgtccctcacctgcactgtctcgtggtcgctccatcagcagcagtacttacgttcgtggggctggactcccgccacgcccccgaggggaagggctgggagtggagttgggagtatttaccactaggtggagcacctactaccaacccgtccacaaagtcgacggcacatactccgtagacacgtacaaacgaaccaattcctacctagaacgtctagacgcttcgtcgtcgacccgccgtacaacgaccgcggctcgtcttaactactgtcgcggtaacggccccgagtccgcgtacgtcggttcttttagacgttcgttccgtttagacttcgtacggggttcgggaaccgtaacggggtaactaacgggttcggtaccctaccgttccgttaccgttcgaaccggtccctaccgaacccgtaccggggtcccaccgtttacccccgg

SEQ ID NO: 293137 - DNA, 773 bp, Homo sapiens
  misc_feature: GYAE6OF02JLXL9.43.66.F11.1.454.CMB.1.raw
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttcgtggggctggactcccgccacgcccccgagggaacggggctggagtggtagttggggagtatttaccgacgtaggtgggacgccgaaccgttaacctaccgaaccccgtcccgtaacgtaaaaacggtccggaaggacctaaccgtaacgtacgtacccgttaacgaaccgtaaccggttaaccaaacggtaaacctaaacgtttacccgtccccgttaaaggtaaaccgtcgttacggaacggtacccgtacgttcggtacggaaccccggtccgaccgaacggaccgacggtctacggttacttaaacgtttcgttcggtcgtaccgggaccgggtaccccgacggtccgaccgtaacgggtttccggttactttttcggaacgtttcggtaccctttttggaacgtttaggttcgggtacgggggtaacccgtaggggtaaccgtaaggtttcccgggttaccgtaccggttaccttccgtttaacggaccggttaccccttaccggacccggtaaccgggtccctaccggtttccccggg

SEQ ID NO: 293138 - DNA, 833 bp, Homo sapiens
  misc_feature: GYAE6OF02IZQI7.43.66.F11.1.454.CMB.1.raw
tcagtgtgagtagtcacgaccggtgctcgatttagtcacgcgagaagggggatctcatgtgcaaagaaaatgaagcacctgtggttcttcctcctgctggtggcggctcccagatgggtcctgtcccagctgcagctgcaggagtcgggcccaggactggtgaagccttcggagaccctgtccctcacctgcactgtctcgtggtggctccatcagcagcagttacttacttcgtgggctggactcccgccaccggcccccgaaggggagggcgtggaggtggagttggggaagttactttaaccgagtaggtgggacgtaccgtaacctaaccgtaacccgaaccccgttaccctaacgtaaaacggtccgaacggaccaaccctaattaacgtaccggttaacgaacccgtaaccgtaacccgaaaacgtaaaccctaactttaccctacccgtagaaacgtctacggacgtcctcgtgtaccgacccgcccgacgaacgaccgaccgggtcttacggttcttaacgtttacgttcggttacggaccggtaacccgggacccccggtaacgacccggtaccggttaacggggtttcgggtttaccgtttttttagggaacgttttccgggtttacccgttttttaagggtaacttttaacgggttcgggggttaaccgggggtaccccggttaaaacgggggtaaccgttaaacgggtttcccgggttacccgttaaccccggtttccgtttacccgtttaccgtacccgtaccccgttaaccccgaaaccccgggtaaacccgggtccccgttaaccggtttcccccggg

SEQ ID NO: 293139 - DNA, 680 bp, Homo sapiens
  misc_feature: GYAE6OF02J0J3O.43.66.F11.1.454.CMB.1.raw
  modified_base (240)..(240): a, c, t, g, unknown or other
  misc_feature (240)..(240): n is a, c, g, or t
tcagtgtgagtagtcacgaccggtgctcgatttagtcacgcgagaaggggagtctcatgtgcaagaaaatgaagcacctgtggttcttcctcctgctggtggcggctcccagatcgggtcctgtcccagctgcagctgcagggagtccgggcccaggactggtgaagcctttcggagacccctgtcccctcacctgccactgtctctggtgcctccatcagcagcagttacttacttcgnggggctggactccgccacgcccccgagggaacggggcgtgggacgtgggtacgttggggagttactttaaccgacaggtgggactcgacctacgtaccaaccccgtcctaccgaaacgtccgacggcaccgataacgtccgaagtcccaacgtaccaacgaaaccaactttcctaccctacgtaacgcctacggagtcctcgtcgtacggacccgccgacctaacggacccgaaccggtcctcggttaccttaacgttaccgtaggttacgtccgaacgggcccccggaagccggtccgtaaggtcggttcttttacggtagttcgtacttttgtaacgtgttcgggtgggttaaccggacggtacgtagtacggtcgtaccgttcgttaccgttcgacgtccctaacccgtaccggtaccggacccgttataccccggg

SEQ ID NO: 293140 - DNA, 716 bp, Homo sapiens
  misc_feature: GYAE6OF02G51O0.43.66.F11.1.454.CMB.1.raw
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcaggagtcgggcccaggactggtgaagccttcggacgaccctgtccctcacctgcactgtctcgtggtcgctccatcagcagcagtacttactcgtgggctggactccgccacgccccgagggacgggcgtggagtggagttgggtagttacttaccgacgtaggtgggacgaccgtaacctaacctaacccgaaccccgttaccctaacgtaaaacggtccggaacggaccctaacctaacttaaccgtacccggtaacgaacccgtaaccgtaaccgaaaacgtaaaaccctaactttaccctacccgttaaggaaacgtcgtaacggacgtccttcgtacgtaccgacccgccgacgacgaccgacggtctacgtacttacgttacgtgtcgcggaccggcccgagcgacgtacggttcggttctttttaggactttcggttacgtttagtacgttagttcggggtacggaccggtaacggtacgtaacggttcgggttacctaccggttcctttaccgttacgtaccgtccccgtaacccgacccgggtaaccggtacccgtacggttcccccgg

SEQ ID NO: 293141 - DNA, 610 bp, Homo sapiens
  misc_feature: GYAE6OF02GFQBO.43.66.F11.1.454.CMB.1.raw
  modified_base (471)..(471): a, c, t, g, unknown or other
  misc_feature (471)..(471): n is a, c, g, or t
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttcgtggggctggactccgccacgcccccgagggaaggggctgggagtggattgggagtatttaccacaggtgggagcacctactacaacccgtccctacaaagtcgaggcaaccatactccgtagaccacgtaccaaagaaccaattcctaccctgaacgctaggagtcctctcggtacgacccgccgacgacgaaccgacggcttgtcttaacttactgttcgacgacggccccgagccgacnggttgtcgtttttgattcgtccttttagattagtggtacggggccgtaaggggactaaggtcggtacctaacccggttccttcttaccgacggtacccttaccccgaacccggtaacgggtcccctacggtttccccgg

SEQ ID NO: 293142 - DNA, 617 bp, Homo sapiens
  misc_feature: GYAE6OF02F798X.43.66.F11.1.454.CMB.1.raw
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcaggagtcgggcccaggactggtgaagcctttcggagaccctgtccctcacctgcactgtctctggtgctcatcagcagcagtacttactcgtggggctggactcccgccacgcccccgagggaacggggctgggagtcggattggggagttatttaccacaggtgggagcacctactacaacccgtcctacgaaagtcgaggcaccatactccgtagacacgtaccaagaaccaattctacctgaacgctagagtctcgtgtacgacccgcgacagacgcgctgtacgtattacgtgtcgacgacggccccgagccgcgtagtcggttcgttttgacttcgttcccgtttagacttggttacgggtcgggggtaccgaaggggtacctaaggttccgggtacccaccgggttaccttccgttaccgtacgtaccccgtaccgtaacccgtaaccgggtaccccgtagtttccccccggg

SEQ ID NO: 293143 - DNA, 773 bp, Homo sapiens
  misc_feature: GYAE6OF02FLF5K.43.66.F11.1.454.CMB.1.raw
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcaggagtccgggcccaggactggtgaagccttcggagaccctgtccctcacctgcactgtctctggtgctccatcagcagcagtaccttacttcgtggggctggactccgccacgcccccgaggggaacgggctgggtaggtggtagttaggggagttactttacccgacgtagggttcggggaacgcctaacccgttaaccgtaacccgtaaacccccggttacccctaacgtaaaaaacggttcggaacgggacctaaccctaagttaaccgtacccggttaaacggaaccctaaccgttaacccgaaaacgtaaaccctaacgtttccctaccccgtagaaacgtccgttaggaccgtccttcgtcggtaccgacccggccgacgtaacggaccgaccggtcttcggttacttacgttacgtggtacggccggtaccgggcccgacgccgtacggtacggtttcggttaccgtttttaggactttccggttcgtttagtaacgtttacggtcgggtaccggggtaaccgtacgggaacgtaacgtttcgggtacccttacccgttacgtttccttaccgaccggttcccctaaccggaaccccggtacccggtacccgtacggtttcccccgg

SEQ ID NO: 293144 - DNA, 731 bp, Homo sapiens
  misc_feature: GYAE6OF02HR5CE.43.66.F11.1.454.CMB.1.raw
  modified_base (324)..(324): a, c, t, g, unknown or other
  misc_feature (324)..(324): n is a, c, g, or t
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcaggagtccgggcccaggactggtagagccttcggagaccctgtccctcacctgcactgtctctggtgcctccatcagcagctagttaccttacgttcgtcggggtctacggactcccgccgaccgccccggaaggggacgggcgtaggagtggagttggggagttacttaccacgtaggtgggacnccaaccttactaacccaaccccgtacctaacgaaaacgtcgacggccaccagtactaccgtagaccacgtaccaaacgtaacctaacttcctaccgtagaacgtcctaggactaccgtcgtcgtaccggacccgtaccgacaacggaccgtacggtcttacgtaccttaacgtttacgtggttacggaccggtacccggacccggaggtcccgtacgttacgggttccggttttacgtttttagacgttttccggtaccgtttttaggaagtttacggtacggggttacggggaacccgtaaggggtaacctaacgggttccgggtacccgttaccgttccgttaccttaccgtaccgtccccgttacccgaaccgggttaacccggcccgttaacggttcccccgg

SEQ ID NO: 293145 - DNA, 562 bp, Homo sapiens
  misc_feature: GYAE6OF02FV6O9.43.66.F11.1.454.CMB.1.raw
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttctggggctggatccgccagcccccgagggaaggggctggaggtggagttggggagttatttaccacagtgggagcacctactacaacccgtccctacaaaagtcgaggcaaccatactccgtagacacgtaccaaagaaccaattctccctagaagctgagtctctgtcgaccgccgacacgacacggctgtactattactgtgcgacggcccgagcgcagtggtacttttgcttgtcctttagattatggtaggggaccgaaggggaactaagtggtactaccggtccttcgttcacgtccctacccaacccgaacgggacccagttccccgg

SEQ ID NO: 293146 - DNA, 776 bp, Homo sapiens
  misc_feature: GYAE6OF02HDGK6.43.66.F11.1.454.CMB.1.raw
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtcggctccatcagcagcagtacttacttcgtgggctggactccgccacgccccgaggggacggggctgggagtggagttggggagttaatttaccgaacgtaggtaggggacgaccgacccttaacctaacccgtaaacccccgttcccctaaccgtaaaaacggttccggaacgggtacccaaacctaacgttaacgtacccggttaacgaacccgtaccggtaaaccctaaacgaaacccgtaaactttcccgtacccgttacggaaacgtaccgttacggacgtcgtcgttacgttaccgggaccccgtcccggacgtaaccgggacccgtaaccgggtcttacgggttaacttaacgtttaccgttgggtaccggacccggtacccggggaccccgaagggtcccgtacggtagggtttccggtttcgttttttagacgtttcggttcctttaggtaactttggttcgggtacggggtaccgtaagggtactaacggttcggtaccgtacccggttcttacccgttcgacgtaccctaccgaacccggaaccggtccctacggttccccg

SEQ ID NO: 293147 - DNA, 676 bp, Homo sapiens
  misc_feature: GYAE6OF02G8L6V.43.66.F11.1.454.CMB.1.raw
  modified_base (334)..(334): a, c, t, g, unknown or other
  misc_feature (334)..(334): n is a, c, g, or t
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcaggagtcgggcccaggactggtgaagccttcggacgaccctgtccctcacctgcactgtctctggtgctccatcagcagcagtacttacttcgtgggctggactccgccacgcccccgagggaacggggcgtggagtggagttgggagttatttaccgacgaggtgggagccacctaactaccaaccccgtcctanaaaacgtcgaggccacatacgtccgtagtacacgtacaaagaacctaattcctaccctagaaacgcttagacgtctacgtcggtacgtacccgccgtacaacgaccgaccggtcttaggttacttaacgttaccgcggttcggccccggggtcccgacgccggacgtacggttcgggttaccgttttttagacgtttcggttccttttaggacgtttacggtcggtacggggacccgaaagggtcctaaaggttcggtaaccgttacccgttcgttaccgttcgtaacccgtcccgtacccgaacccggaccgggtaccctaccggttcccgttacccccgg

SEQ ID NO: 293148 - DNA, 782 bp, Homo sapiens
  misc_feature: GYAE6OF02JOVBZ.43.66.F11.1.454.CMB.1.raw
  modified_base (145)..(145): a, c, t, g, unknown or other
  misc_feature (145)..(145): n is a, c, g, or t
  modified_base (672)..(672): a, c, t, g, unknown or other
  misc_feature (672)..(672): n is a, c, g, or t
tcagtgtgagtagtcacgaccggtgctcgatttagtcacgcgagaaggggagtctcgatgtgcaagaaaatgaagcacctgtggttcttcctcctgctggtggcggctcccagatgggtcctgtcccagctcgcagctgcgaggngtccgggcccaggacctgggtgaacgtccttcgggagtaccccgtcgtccctccaccttgcctactcggtcctcgtcggtcggaccttccatccgagtccgagcctaacgttacctttacgtttccggtggggaccttgggacgttccccgcccgaaccggcccccccgaagggggtaaaccgggggcgttacgggacggttagggacgttgggggtaacgttacgtttacccgtaacgagggtttcggggaggtaccaaccgttaccgtaacccgtaacccccggttaccccggttacaaaaaccggttcggaacgggtaccctaaccgaacctttaacgtcccggttaaacggaacccgtaccgttaaccaaacggtaaaaccctaacgtttacccttaccgtacgaaacgtacgcgttacggaccttcgttacgccgtaacccggcccgacgacgtaaccgacgtccttaggtactaacgttccagttacggccgtacggcccacgccagtcgtcgtgttttanacgttcgtccgttagtagtcgtggtaccggacgtaacggaccgagttccgggtaaccttcgggtaccttctaccgacgtccgtcccgacgaccggaccttcgtaccccgg

SEQ ID NO: 293149 - DNA, 589 bp, Homo sapiens
  misc_feature: GYAE6OF02FREYO.43.66.F11.1.454.CMB.1.raw
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttcgtgggctggactccgccacgcccccaggggaacggggctgggagtggagttgggagttatttaccacgtaggtgggagcacctactaccaacccgtcctacaaagtcgaggcaccatactccgtagacacgtacaacgaaccaacttctacctagaacgtctagacgtctctgtcgaccgcgacacgacacggctcgtactactacgtgtcgcgacggcccgagccgcgaggttcggtcgtttttgacttcggtcctttgtagttacgtagggttcggggaccgtagggtactaacgttcggtactacccggtcttacgttccgacgtccctaccgaccgaacggtccctagtccccgg

SEQ ID NO: 293150 - DNA, 552 bp, Homo sapiens
  misc_feature: GYAE6OF02FH2U7.43.66.F11.1.454.CMB.1.raw
  modified_base (472)..(472): a, c, t, g, unknown or other
  misc_feature (472)..(472): n is a, c, g, or t
  modified_base (489)..(489): a, c, t, g, unknown or other
  misc_feature (489)..(489): n is a, c, g, or t
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttcgtggggctggactccgcccacgcccccgaggggaacggggctgggaggtgggagttggggagttactttaccacgaggtggggagcaacctactaccaacccgtcctacaaagtcgaggcaccatactccgtagacacgtaccaaacgaaccaatttcctaccctagaacgtctaggacgtctctgtcgacccgccgcagacacggctgtctatctgtcgcgcggcccgagcgcgagtcgtnttttgattgtcctttgnttgtggcgggcaggcagtcgtactccgtcttcgtcgcgcctaccacgtacggcctagtcccgg

SEQ ID NO: 293151 - DNA, 639 bp, Homo sapiens
  misc_feature: GYAE6OF02HIHFR.43.66.F11.1.454.CMB.1.raw
  modified_base (233)..(233): a, c, t, g, unknown or other
  misc_feature (233)..(233): n is a, c, g, or t
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctcgtggtggctccatcagcagcagtacttacttcgngggctggactccgccacgccccgagggaagggctggagtggagttgggagttacgttaccgagacggtgggagccgtaacctaactaccgaaccccgtccctacaaaacgtcgacggcaaccatactccgtaagacaacgtacaacgaaccattcctccgtagaagcgtagacgcctcgtgcgacccgcgacgacgacgccgctcgtactacttacgtgttcggcggaccggccccgaggccgagtacgggttcgttacgttttagacgttcgttacccgttttagtacgttaggttcgggtacggggtaccgtaagggtacgtagttccgggttcccacgggttccttcggttaccaccgtccccgtaaccgacccggtaaccggtacccgtacgttacccccgg

SEQ ID NO: 293152 - DNA, 748 bp, Homo sapiens
  misc_feature: GYAE6OF02F3I24.43.66.F11.1.454.CMB.1.raw
  modified_base (185)..(185): a, c, t, g, unknown or other
  misc_feature (185)..(185): n is a, c, g, or t
  modified_base (232)..(232): a, c, t, g, unknown or other
  misc_feature (232)..(232): n is a, c, g, or t
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctnacctgcactgtctctggtcgctcatcagcagcagttacttacttcgngggctggactccgccacgccccgagggacgggctggagtggtagttgggagttactttaccgacgtagggtgggacggacctaaccgttaacctaacccgtaacccccggttaccccttaacgaaaaacggttccggaacgggtaccaaccgtaattaacgtacccggtaaacgacctaaccgtaaccaaaacgtaaccctaaactttccgtacccgttagaacgtccgttacgacggtccttacggtacgtaccggacccgtaccgacgaacgtaccgacgtactcgttacttacgttacgtggttcgacggtaccggacccgagtccgacggttaggttccggtttacgtttttcggacgtttaccgttccgtttaggtaacgttacggttacggggtacgggtacccggtaaggtaccgttaacggtcggtaccgttaacccggttccgtttaacgtccgtaccgtcccctaaccggtaacccgtaccggggttaccctacccggttccccgg

SEQ ID NO: 293153 - DNA, 739 bp, Homo sapiens
  misc_feature: GYAE6OF02JKQM6.43.66.F11.1.454.CMB.1.raw
  modified_base (311)..(311): a, c, t, g, unknown or other
  misc_feature (311)..(311): n is a, c, g, or t
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcaggagtcgggcccaggactggtgaagccttcggagacccctgtccctcacctgccactgtctctggtggcctccatcagcagcagtacttacttcgtggggctggatcccgaccacgcccccgaggggacgggctggacgtggagttgggagttacttaccagacggtggganccaacctactaccgtaaccccgtccctacgaaaagtccgaggaccaccaatactaccgtacgacaccgtaccaagaaaccctaacttacctcccgtagaacgtctagacgtcctgtcgtacgacccgtccgacaacggaccgtacggtctacgttacctaagttaccgttcggttacggaccggtaccggacccccggaaggtccggaccgtaggttccgggtttctttttacgggacgtttcccgtaccggttttgtaacgtttacggtacggggttaccgggggaacccgttaacggggtaaccgaagggtttcccggttacccgtaacccggtttccgttaacccgtttccggaacccggttacccccttaaccccgggaacccgtaacccgggggttaccccctaccggtttaacccccccggg

SEQ ID NO: 293154 - DNA, 624 bp, Homo sapiens
  misc_feature: GYAE6OF02HLYUW.43.66.F11.1.454.CMB.1.raw
  modified_base (389)..(389): a, c, t, g, unknown or other
  misc_feature (389)..(389): n is a, c, g, or t
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcaggagtcgggcccaggactggtagaacgccttcggagaccctgtccctcacctgcactgtctctggtcgctccatcagcagcagttacttacgttcgtgggctggactccgccaccgcccggaggggacgggcgtggagtggagttgggtattacttaccgagtaggtggacgctacctacaccgtacccgtcctaagaaacgtcgacgcaccatactcgacacacgacaacactaactctcctagactcngctctgtgacgaccgcgacgacgacgacgtctacgtctagtacgtgtcgcgaccggtccgagccgtacgtacggttcgttcgttttacggacgtttcgttaccgtttagtacgttacggtcgggtacgggtacgaacgggtaactacgggtttccggaaccttcccggttcgttaccgttaccgaccgtacccgtaacccgtaacccggaacggttcccctaacggttcccccgg

SEQ ID NO: 293155 - DNA, 724 bp, Homo sapiens
  misc_feature: GYAE6OF02H8NFX.43.66.F11.1.454.CMB.1.raw
  modified_base (238)..(238): a, c, t, g, unknown or other
  misc_feature (238)..(238): n is a, c, g, or t
  modified_base (244)..(244): a, c, t, g, unknown or other
  misc_feature (244)..(244): n is a, c, g, or t
  modified_base (267)..(267): a, c, t, g, unknown or other
  misc_feature (267)..(267): n is a, c, g, or t
  modified_base (272)..(272): a, c, t, g, unknown or other
  misc_feature (272)..(272): n is a, c, g, or t
tcagtgtgagtagtcacgaccggtgctcgatttagtcacgcgagaagggggatctcatgtgcaaagaaaatgaagcacctgtggttcttcctcctgctggtggcggctcccagatgggtcctgtcccagctgcagctgcgaggagtccgggcccaggactggtgaagccttcggacgaccctgtccctcacctgcactgtctctggtgctccatcagcagcattacttacttgcgggntggacnccgccacgccccgagggagggcnggagngagtggagttactacagaggtggatcctaccgtacaaccgaaccctacctagaaacgtcgacgtcaacctatacgtaccgtaagacccgtaacgtaaccgaaagttaacctaaacgtttacctcccgtaaaggaaacgttccgtaggtaccgtacttccggtacggtacggtacccgacccggacgtaacgtaccgtaaccggtcttacggtaacctttaacggtttaacgtcgggttaccggtacccggtaacccgggtacccggtaacgggtccggaccgggttacgttaccgggtttacgttttttacggacgtttacgtttccggtttagtaaccgttaggtccgggttacggggaaccgtaacgggacgtaacgtacggtaccgttaaccgtccgttaactccgacgtcctaacccggtacgacccgggtcctacggtttaccccgg

SEQ ID NO: 293156 - DNA, 808 bp, Homo sapiens
  misc_feature: GYAE6OF02IO9GQ.43.66.F11.1.454.CMB.1.raw
tcagtgtgagtagtcacgaccggtgctcgatttagtcacgcgagaagggggatctcatgtgcaaagaaatgaagcacctgtgttcttcctcctgcgtggtggcggcctccagagtcgggtcctcgtcccagctgcgtagctgcgaggtacggtccgggccaggacgtggtagaacgtccgttcggacgcccttggtcccctcacctgcctacttcggtctcgtggcgacctcagtcagtcgagctacgttacttcgtggtcggctacgacgtccgaccgccggacccggaggggtaggtcgtacggaggttacggtggttacggtacgttacttacgaagtggacgcacctacgtacacccgacctacgtaacaggtcgacgactacgtagactacgacgacctacgtaccgaaccgttacctcgttaccgtacgtagaaccctgtacgaccttacgcgtaccgtacccgccggtaaccgcaaccggtccgtaccggttactaccgttaccgttagttaccgggtaccgtccggggttacccgacccggttaaccccgtcggtaccggtaaccggttgggttttacccggttacggttttacgaaccccgtttttcgggttaaaccgttcgtaaaacgggtttccggtacggggtaaccgggttaaaccgggttaaacgggtacccgtttaccggttacccgggttacccggttttacccgtacgttttacccggtaccttaaccgggttccccctaaacggtaaaccccgggggtacccttccccggttaacccggttttccccggg

SEQ ID NO: 293157 - DNA, 672 bp, Homo sapiens
  misc_feature: GYAE6OF02I0J2I.43.66.F11.1.454.CMB.1.raw
  modified_base (236)..(236): a, c, t, g, unknown or other
  misc_feature (236)..(236): n is a, c, g, or t
  modified_base (269)..(269): a, c, t, g, unknown or other
  misc_feature (269)..(269): n is a, c, g, or t
  modified_base (329)..(329): a, c, t, g, unknown or other
  misc_feature (329)..(329): n is a, c, g, or t
  modified_base (347)..(347): a, c, t, g, unknown or other
  misc_feature (347)..(347): n is a, c, g, or t
  modified_base (474)..(474): a, c, t, g, unknown or other
  misc_feature (474)..(474): n is a, c, g, or t
tcagtgtgagtagtcacgaccggtgctcgatttagtcacgcgagaagggggatctcatgtgcaaagaaaaatgaagcacctgtggttcttcctcctgctggtggcggctcccagatgggtcctgtcccagctgcagctgcaggagtcgggcccaggactggtgaagccttcggacgaccctgtccctcacctgcactgtctcgtggtgctccatcagcagcagttacttacgtcgngggctggactccgccacgccccgagggaaggcncggagtggagttgggtatatttaccactaggtggagcacctactaaccgacctcccgtanaaaagtcgaagcaacganagtccagacacgtaccaaacgtaacaacttcctacctagacgtctggactcgtacgtcgtcggacccgtaccgcgaacgacgacgctcgtacttaacttaacgtcgtcgtcggaaccgtaccccggngtaccggctaaggttcggttcgttttttacgaagttcgttccgtttacgtaagtttacgttacgggtccgggggaacgtaaccgggtaacggtaacgttaccgggttaccgtaacccggttaccgttaccctttaccggtacctcccgttaccccgaaacccgggtaaacccgggttaccccgtaaccgttccccggg

SEQ ID NO: 293158 - DNA, 781 bp, Homo sapiens
  misc_feature: GYAE6OF02GNQ6O.43.66.F11.1.454.CMB.1.raw
  modified_base (261)..(261): a, c, t, g, unknown or other
  misc_feature (261)..(261): n is a, c, g, or t
tcagtgtgagtagtcacgaccggtgctcgatttagtcacgcgagaaggggggatctcatgtgcaagaaaatgaagcacctgtggttcttcctcctgctggtggcggctcccagatgggtcctgtcccagctgcagcctgcaggaggtccgggacccaggactgggtgaacgtccgttcgggacgtaccccgttgtcccctcacctgcctacctgtcctcgtggtcgctccatcagcagctacgttacttacgttcgcgggntcggactcccgacccaccgacccccgaggggaacgggcgtagggcgtagggtagttagggtacgttacttaccacgtacgggtagggacactaccgtaacctaaccgtaaccccgtcccgtaaccgaaacggtccggagacccacgtactacgtccgtaagaccaccgtaacaaccgaacctttacgtccctaccgtagaacgtcgttacgcgtaccttcgtccggtacggacccgtacccgtacgacggaccgtcggtacgtttacgttactttacggttacctggtacggtacccgggaccccggacccgtacggtccggtaccgtagggtttaccgtttgttttaccggtactttccgggtttacctttagacgttacggttgggtaaccgggggtaaccgtagggtaacgtacccggtttcggtacccgttacccggttcttccccgtttaacgacccttaccccgtaaggaacccccgggttaccgggtaccccttaccgggtttcccccccggg

SEQ ID NO: 293159 - DNA, 874 bp, Homo sapiens
  misc_feature: GYAE6OF02GI1WC.43.66.F11.1.454.CMB.1.raw
tcagtgtgagtagtcacgaccggtgctcgatttagtcacgcgagaagggggatctcatgtgcaagaaaatgaagcacctgtggttcttcctcctgctggtggcggctcccagatgggtcctgtcccagcctgcagctgcgaggaggtccgggcccagggactgggtagaacgtccttacgggacgaccccttcgtcccctacacctgacctacttcgtctcgtgggtacgcctccatcacgcacgctacgttaccgtttacgttcggtagggccttacggactacccggaccgacccgggacccccggtaaggggggaacgggtcggtagggtacggtagggtacggttagggtactttaaccgtttaacccgacggtaggggtacggggacgtaccgtaaccccgttaacccgtaacccgtaacccccgttacctaaaccggtaaaaacgtaccgtaaacgaccgtaaaccctacttaaccgtaaccgtaacggaaccgtaaccgtaacccgaaaccgtaaccttacgttacccgttaccgtaacgaaccgtcgtaacggtacgtccgttacggtacctaccgggacccgtacgaccgtacgaacccgtcgtacgttacttaacgttacgttaccgtcggttacgacccggtaaccggacccggtccgccgttaccggttacgggtttacggttacgtttttaccgacgttttccgttaagttttcggtaacgttgggttaaccggggtaccgggaacgggttaacggaaggtaaccggttccgggtaaccctcgttacccgtccgtttaaaccgaccgttccccggtaaaccggaacccggtaacccggttacccttccgggttacccccgg

SEQ ID NO: 293160 - DNA, 705 bp, Homo sapiens
  misc_feature: GYAE6OF02FY209.43.66.F11.1.454.CMB.1.raw
  modified_base (539)..(539): a, c, t, g, unknown or other
  misc_feature (539)..(539): n is a, c, g, or t
tcagtgtgagtagtcacgaccggtgctcgatttagtcacgcgagaagggggatctcatgtgcaagaaaatgaagcacctgtggttcttcctcctgctggtggcggctcccagatcgggtcctgtcccagctgcagctgcaggagtcgggcccaggactggtgaagccgttcggagtaccctgtccctcaccgtgcctatcgtctcgtggtcgcctccatcagcagctagttacttcgttcgtcggggctggactccgccacgccccgagggaacgggctaggagtggtacgttgggacgttatttaccacgaggtacgggacgtcaacctaccgtaccaaccccgttaccctaacgaaaaggtccgacggccaaccatacgtccgtaagaccctacgtaccaaacgaacctaacttcctaccgtagaacgtcgtacggcgccgtttctcggtaccgacccggtccgcgaaacgcccgtaacggttccttacgtaccgttaacgttacgttcggttaccggtccgggaccggaccccggnggtacccggcgtaggttcgttacggttttgacgttcgttccgtttagattacgtcgggttacggaaccgtagggtaactacggtttcgggaccctaccggttcccttacttaccggaccgttcccgtacccgaaccggtaacccggacccgttaccgttccccggg

SEQ ID NO: 293161 - DNA, 607 bp, Homo sapiens
  misc_feature: GYAE6OF02GPMW8.43.66.F11.1.454.CMB.1.raw
  modified_base (314)..(314): a, c, t, g, unknown or other
  misc_feature (314)..(314): n is a, c, g, or t
  modified_base (454)..(454): a, c, t, g, unknown or other
  misc_feature (454)..(454): n is a, c, g, or t
  modified_base (513)..(513): a, c, t, g, unknown or other
  misc_feature (513)..(513): n is a, c, g, or t
tcagtgtgagtagtcacgaccggtgctcgatttagtcacgcgagaaggggggatctcatgtgcaagaaaatgaagcacctgtggttcttcctcctgctggtggcggctcccagatgggtcctgtcccagctgcagctgcatgagtcgggcccaggactggtgaacgccttcggagaccctgtcccctcacctgcactgtctcgtggtcggcctccactcagcagcagttacttacttcgtggggctggactccgccaccgccccggaggggaacggcgaggagtgggagttgggattacgttacagaggtgganaccgacctacgaccaccctacctacaaagtcgaggccaactatacgtaccgagtacctaccgtaccgaaacaacctactcctaccgtagtacgctacgactccgtgtacggtccgacccgcgagaccgacgacggtcgtnttacctatcgttcgtagaccggtaccgcccgtagccggacgtagtcggtttcttttcgntttcgtacctttgacgttgttcgggacggtacgaacggtactgggtacctaccgaccgttcttctcgcgtcccacgaacgacccggtctcccgg

SEQ ID NO: 293162 - DNA, 814 bp, Homo sapiens
  misc_feature: GYAE6OF02G4TNM.43.66.F11.1.454.CMB.1.raw
tcagtgtgagtagtcacgaccggtgctcgatttagtcacgcgagaagggggatctcatgtgcaagaaaatgaagcacctgtgttctcctcctgctggtggcggctcccagatgggtcctgtcccagctgcagctgcgaggacgtcgggcccaggactggtagaacgtccttcggacgtaccctgtccctcacctgctactcgtctcgtgggtgcctcatcagcgagtccagttaccttacgttcgtgggcctggcctcccgccaccggaccccgaggggaacgggtcgtacgggaggtaggtacggttagggtaacgttactttaaccgacgtagggtagggtaccgaaccgtaaccccgttaaccgtaacccgtaaccccggttaccctaaacgtaaaacggtcgaacggtacctaaccgtaacgttaccgtaccggtaacgaaccgtaaccggtaaccaaaccggtaaacccttaactttacccgtacctaacggtaaactccgtaggtacgtccttacgtcgggtaccgaccccgaccgaccgtaaccgacccggaccgttacgttccgtaaccgtttacgttaccgttcgggtacggacccggtacccgggaacccgcggtaccgcgttacgggttcggttttaccttttagaccgtttctaccggtttagtaacttgggttacggggtaccgtaaggaaccggttaacggtacggttcgggtaacccttaccggttcctttacccgttacggtaccccgtcccgttaaaccggccccggttaaccgggtcccttacccggttcccccgg

SEQ ID NO: 293163 - DNA, 677 bp, Homo sapiens
  misc_feature: GYAE6OF02HGL4L.43.66.F11.1.454.CMB.1.raw
tcagtgtgagtagtcacgaccggtgctcgatttagtcacgcgagaagggggatctcatgtgcaagaaaatgaagcacctgtggttcttcctcctgctggtggcggctcccagatgggtcctgtcccagctgcagctgcgaggagtcgggcccaggactggtagaagccttcggagaccctgtccctcacctgcacttgtctcgtgggtcgcctccatcagcacgacacgttacctttacgttcgtgggggacttggactccgccgaccgccccggaggggacgggcgtagggtacggtcggtagttaggggattacgttaaccgagtaagggtgggacgaccgaaccgtaacctaacccgtaaccccgtacccctaacgaaaacggtcggaacgaccaaccaagtactccggtaagacaaccgtaccaaacaaacctaacttccctactagacgctgactccgttctggtccggaccgcccgagaacgaacgtcggtcttagttaaccgttattaccggtgttaccggcgaccgggccctagggccgtacgtgttaggtttccgtttagtacgttcggtactttagagttggttaggggcggggtaacgaggtagtacgtcggtaccgtccttacgtctctaccgcctaccggtaccgaacggccctacggttcccg

SEQ ID NO: 293164 - DNA, 976 bp, Homo sapiens
  misc_feature: GYAE6OF02H0DMY.43.66.F11.1.454.CMB.1.raw
  modified_base (130)..(130): a, c, t, g, unknown or other
  misc_feature (130)..(130): n is a, c, g, or t
tcagtgtgagtagtcacgaccggtgctcgatttagtcacgcgagaagggggatctcatgtgcaagaaaatgaagcacctgtggttcttcctctgctggtggcgctccagatgggtcctgtccagctgcanctgcaggagtcggccaggtactgggtagaacgtccgttacggacgtaccctgttcccctcgacctggcctacttcgttcgtcgttggtcggtcctcctaatcgaggcaagtctaagttaccttacggttgtcggtacgtcggaactcccggaccgtaaccggccccgggtaaagggacgggtccgtagggtaggtaggtacggtttacgggtacgtttaacgtttaacccgaggtacgggttcggggtaaccgacccgttaaaccccgtacttaaaccccggtaacccccgttaaccccggttaaaacggtaaaaaccgggttcccgggaaaccgggtaacccgttaacccgtaaggtttaacccggtttaaccccggtaaaccgggaacccttaccgtttaaacccggaaaaccggttaaaccttaaccggttttaacccccgttaacccggtaaggggtaaaccgttaccgggtaacggttacccgtaccggttcccggtttaagggttaccccgggtaaccccgggcccggtaaccggtaaccggtaacccggtacggtttaccgtttaccggtaacgtttaaccgtttacggttacggccgggtaaccgggtaacccggggtacccgaacgggtcccggtacggttaacgggtttaccgttttaccgttttacgggtacctttacgggtttacccgttaaggttaccgttaagggttccggggtaaaccggggtacgtaacggggttacgtaacggtacggtttcccgaagtttcccgtaaccgttcgtaccggaacccgtcccgttaaacccggggtacgtcccttaccggttaccccggg

SEQ ID NO: 293165 - DNA, 566 bp, Homo sapiens
  misc_feature: GYAE6OF01ENQPB.4.27.C05.1.454.CMB.1.raw
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagctgggttttccttgttgctactttaagaggagtccactgtggggtacagctgctggagtctggaggaggcatgatccagcctggggggtccctgagactctcctgtgcagcctctgggttcaccgtcacttacagccacatgagttgggtccgccaggctccgaggggaaggggctgggagtgggtctcgaggttctcataacgatggtactacatcgtactcagactcccgtgaacgggccattccaccatctccagagacaattaccaagaacatggtttatcttacaaatgaatagactggcgggccgaggacgaccggccgttctactactgtggcggagggggagcgaggtggcgttgggttactttccgttttgggtttcgtcggggtaccgacggggtacccgtgggtacccg

SEQ ID NO: 293166 - DNA, 650 bp, Homo sapiens
  misc_feature: GYAE6OF01CRIB2.4.27.C05.1.454.CMB.1.raw
  modified_base (344)..(344): a, c, t, g, unknown or other
  misc_feature (344)..(344): n is a, c, g, or t
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagcttgggttttccttgttgctactttaagaggagtccactggtggggtacagctgctggagtctgggaggaggcatgatccagccgtgggggtccctgagacctctcctgtgcagcctcgtgggttcaccgtcacttacagccacatgagttgggtccgcaggctccgagggaagggctggagtgggtctcgaggttcncataacgatggtactacatcgtactcaagactccgtaggaacggccgtattccaccatcctacagaagacctaaattaccaagaaactagttaggtttaactacttaactaaactagtaaataacggactacgggccgggaacccggaggaacccgtacccgggtccgttaccgtaaccgttactacgggtcggacggggagggggtaacgcgagggttcggtacgttgggtttaccttttccggttttcgggtttccggttacgggggaccctaacgggggtaaaccccgttgggttacccccgg

SEQ ID NO: 293167 - DNA, 540 bp, Homo sapiens
  misc_feature: GYAE6OF01DYD8D.4.27.C05.1.454.CMB.1.raw
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagcgtggtttcctgttagctacttaagaggagtccactgtggggtacagctgctggagtctggaggaggcatgatccagcctggggggtccctgagactctcctgtgcagcctctgggttcaccgtcacttacagccacatgagttgggtccgcaggctccgagggaaggggctgggagtgggtctcgaggttctcataacgatggtactacatcgtactcagactccgtgaaggccgattcaccatctccagagacaattccaagaacatgtttatcttacaatagaatagactgcgggccgaggacacggccgtctactactgtggcgagggggagcgaggtggcgttgtactttccgtttggttcgtaggggccgagggaccctgggtacccg

SEQ ID NO: 293168 - DNA, 541 bp, Homo sapiens
  misc_feature: GYAE6OF01CJ0C4.4.27.C05.1.454.CMB.1.raw
  modified_base (392)..(392): a, c, t, g, unknown or other
  misc_feature (392)..(392): n is a, c, g, or t
  modified_base (483)..(483): a, c, t, g, unknown or other
  misc_feature (483)..(483): n is a, c, g, or t
tcagagcactgtagcacgaccggtgctcgatttagacgcgatcgaagggtttggggggggagaggagcccagcactgggattccgaggtgtttccattcggtgatcagcactgaacagagaggactcaccatggagttttggctgagctgggttttccttgttgctactttaagaggagtccactgtggggtacagctgctggagtctggaggaggcatgatccagccgtggggggtccctgagactctcctgtgcagcctctgggttcaccgtcacttacagccacatgagttgggtccgccaggctccgagggaggggctggagtgggtctcaggttctcataacgatggtactacatcgtactcagactcgtgaaggccatcaccatcnccagagacaattccaagaacatgtttatcttacaaatgaatagactggccggacgaggaccacggcctactactactgtgcggagggggancgaggtggcttggtacttccgtttggttcgtggggcctacgggaccctgggtaccccg

SEQ ID NO: 293169 - DNA, 599 bp, Homo sapiens
  misc_feature: GYAE6OF01CW4IF.4.27.C05.1.454.CMB.1.raw
tcagagcactgtagcacgaccggtgctcgatttagacgcgatcgaagggtttgggggggagaggagcccagcactgggattccgaggtgttccattcggtgatcagcactgaacagagaggactcaccatggagttttggctgagctgggttttccttgttgctactttaagaggagtccactggtggggtacagctgctggagtctggaggaggcatgatccagccgtggggggtccctgagactctcctgtgcagcctcgtgggttcaccgtcacttacagccacatgagttgggtcccgccaggctccgaggggaacgggctgggagtgggtctcgaggttctcataacgatggtactacatcgtactcagactcgtgaacggcatcacatctcagagacaattccaagaactagtgtttatcttacaaatgaatagacgtggaccgggacgacggaccacgggtcctacttactacgtggtcggacgggagggggagccgtagggtcgggtacgttgggtttaccgttttccgtttttgggtttacccggtcgggggtaccccgtaacgggggtaacccccgttgggttaccccg

SEQ ID NO: 293170 - DNA, 611 bp, Homo sapiens
  misc_feature: GYAE6OF01BL782.4.27.C05.1.454.CMB.1.raw
  modified_base (428)..(428): a, c, t, g, unknown or other
  misc_feature (428)..(428): n is a, c, g, or t
  modified_base (537)..(537): a, c, t, g, unknown or other
  misc_feature (537)..(537): n is a, c, g, or t
tcagagcactgtagcacgaccggtgctcgatttagacgcgatcgaagggtttggggggagaggagcccagcactgggattccgaggtgtttccattcggtgatcagcactgaacagagaggactcaccatggagttttggctgagcttgggttttccttgttgctactttaagaggagtccactggtggggtacagctgctggagtcgtgggaggaggcatgactccaggccgtggggggtccctggacgacctctcctgtgcacgcctcgtcgggttccaccggtcaccttacagcccacatggaggttcgggtccgccaggcctccgaggggaagggcgtgggaggtgggtctcgtaggttctacaagtaacgagtggtaactacactcgtactcagtacctccgtaggaacggccattccacctntcctacagacactaattaccaaagaactagttcgtttaatcttacaaatgaaactagactggcgggaccgaggacgacggtcctactacgtactgcggacggaggggancgaggtggacgttggttacgtttccgtttgggtttccgtcggggtacccggtacgggtacccgttggtaccccg

SEQ ID NO: 293171 - DNA, 619 bp, Homo sapiens
  misc_feature: GYAE6OF01EBCUO.4.27.C05.1.454.CMB.1.raw
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagctgggttttccttgttgctactttaagaggagtccactgtgggtacagctgctggagtctggaggaggcatgatccagccgtgggggtccctgagactctcctgtgcagcctctgggttcaccgtcacttacagccacatgagttcgggtccgccgaggctccgaggggaggggcgtggggtggtctcgaggttctcataacgatacggtactacatcgtactcagactccgtagaacgggtccgattacacctactcctccgaacgacgaactaacttaccaaagaactattacggtttactactttacaaagtagtaataacgtacgtggaccgggaccggtaacggacgtaaccgggtccgttacctacgttacgtggtcggacggagggggacgcgaggtcggtcgttgggttactttccgtttgggtttcggtcggggtaccgtacgggtacccgtggtccgtacccg

SEQ ID NO: 293172 - DNA, 595 bp, Homo sapiens
  misc_feature: GYAE6OF01BCFB0.4.27.C05.1.454.CMB.1.raw
  modified_base (528)..(528): a, c, t, g, unknown or other
  misc_feature (528)..(528): n is a, c, g, or t
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagctgggttttccttgttgctactttaagaggagtccactggtggggtacagctgctggagtctgggaggaggcatgatccagccgtgggggtccctgagctctcctgtgcagcctcgtgggttcaccgtcacttacagccacatggaggttcgggtccgccgaggcctccgaggggagggctgggagtgggtctcgaggttctcataacgatggtactacgatcgtactcagactccggtagacggtcctattccacctatcctacagacgactaactaccaagaactagttagtttacttacttaactaaatagaaatacgacgtcggccgggacgacggaccgacggccgtactactacgtggtaggcgggaggggagcgnggtggcgttggttactttccgttttgggttccgtcgggggaccctacggggtaccctgggtaccccg

SEQ ID NO: 293173 - DNA, 836 bp, Homo sapiens
  misc_feature: GYAE6OF01C5PGO.4.27.C05.1.454.CMB.1.raw
  modified_base (307)..(307): a, c, t, g, unknown or other
  misc_feature (307)..(307): n is a, c, g, or t
tcagagcactgtagcacgaccggtgctcgatttagacgcgatcgaagggtttgggggggagaggagcccagcactgggattccgaggtgtttccattcggtgatcagcactgaacagagaggactcaccatggtagttttggctgagtcttgggttttccttgttgctaactttaagaggagtccagtggtggggtacagctgctggagtcgtgggaggaggcatgactccgaggcccggtcggggggtccctggacgtactcctcctgtgcagcctcgtgggttcaccgtcacgttacagtcccanagtggaggttcgggcccgaccgaggctaccggaggggaacggggcgtagggaggttcgggtctcgtaacggttctacaaataaaccggtattacgggtaacctaacgtaacgttaccggttaactaccgtaagtaacccgtttccgggaacgggaaacgggggtcccctaaatttcccaaccctacgtttccaccgaaaggaacgtaaacctaaactttaacccgaaaacggtaaacctaaaggttttacgggttttaactttaaccttaaaccgtaaaaagtttacggtaaaagttaacggtaaaccgtcggggtacccggggaacccggtaaacggggaacccgtaacccgggtacccggttaccctttaaccgtaacccgttaggttacgggaccggggaacggggggtaagaccgggtagggttgggtaccgtttacggggtttaaccttttcccggtttttacgggtttaccggtacggggttaaccccgggtaacgggtaaaccccgttccgggttaaccccg

SEQ ID NO: 293174 - DNA, 811 bp, Homo sapiens
  misc_feature: GYAE6OF01C7J8M.4.27.C05.1.454.CMB.1.raw
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagcttgggttttccttgttgcttactttaagaggagtccactgtggggtacagctgctggagtctgggaggaggcatgatccagccgtgggggtccctgagactctcctgtgcagcctcgtgggttccaccgtcacttacagccacatgaggtttgggccgcaggctccgagaggaagggctgggagttcgggtctcgaggttctacgtaattaaaccggattacgggttaacctaacgtaacgtttaccggttaaccttcgaaacggtaacccttccccgggttaaggaaaccggggtccctaagttttacccaaccctaacttcctaccccgaaggaacgaaccctaaacgtttacccgaaaagtaacctaagtttaacgggtttttaactaccgttttaacctaaaagttaggtaaaattaacgggtaaccgttacgggaaccgggggtaccccggaaacgggtaacccggtaacccggggtaccccgttaccgttaaacccgttaaccggttacgggttacgggaccggggtaaaggggggacggtaccggttaaggggttcgggtcgtttacggggtttaacgtttttcccggtttttacgggttttaccgggttaccgggggtaaccccggtaaccgggggtaaccccggtttacccgggg

SEQ ID NO: 293175 - DNA, 572 bp, Homo sapiens
  misc_feature: GYAE6OF01A4I9Y.4.27.C05.1.454.CMB.1.raw
  modified_base (343)..(343): a, c, t, g, unknown or other
  misc_feature (343)..(343): n is a, c, g, or t
  modified_base (508)..(508): a, c, t, g, unknown or other
  misc_feature (508)..(508): n is a, c, g, or t
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagctgggttttccttgttgctactttaagaggagtccactgtggggtacagctgctggagtctggaggaggcatgatccagccgtgggggtccctgagactctcctgtgcagcctctgggttcaccgtcacttacagccacatgagttcgggtccgccaggctccgaggggaagggctgggagtgggtctcgaggttcncataacgatggtactacatcgtactcagactccggtgaacgggccattccaccatctaccagacgactaattccaaagaactattggtttatcttacaaatgaaattagactggcgggaccgaaggaccaccgggccttactacgtacgtgtggcggagggggancgaggtggcgtggttactttccgtttggtttccgaggggacccaggggtacccctgggtacccc

SEQ ID NO: 293176 - DNA, 683 bp, Homo sapiens
  misc_feature: GYAE6OF01AWGB0.4.27.C05.1.454.CMB.1.raw
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagctgggttttccttgttgctactttaagaggagtccactgtggggtacagctgctggagtctgggaggaggcatgatccagccgtggggggtccctgacgactctcctgtgcacgcctcgtgggttcaccgtcacttacagccacatgagttgggtcccgccaggcctccgaggggaaggggctgggaggtgggtctcgtaggttctcaagtaaccgatcggtaactacacttacgtacctcgacgtacctccggtaggaacgggtcccgtatttccaacctattcctacccgaaggacgaacctaaactttaccgaaacgaaactagtttagggtttaacttaccttaactaaaatgtaaattacggacgttgggccgggtaccgaaggaccgaccggtcccgttacgtaccgttacgtacgggtaacggaggggggtacagacggtgggtacgttgggttaccttttccggtttcgggttttcggtacgggggtacccgtaacggggtaacccccttggggtcccgttaaccccgg

SEQ ID NO: 293177 - DNA, 701 bp, Homo sapiens
  misc_feature: GYAE6OF01B4YG6.4.27.C05.1.454.CMB.1.raw
  modified_base (379)..(379): a, c, t, g, unknown or other
  misc_feature (379)..(379): n is a, c, g, or t
  modified_base (591)..(591): a, c, t, g, unknown or other
  misc_feature (591)..(591): n is a, c, g, or t
tcagagcactgtagcacgaccggtgctcgatttagacgcgatcgaagggtttggggggagaggagcccagcactgggattccgaggtgtttccattcggtgatcagcactgaacagagaggactcaccatggagttttggctgagctgggttttccttgttgctactttaagaggagtccactggtggggtacagctgctggagtcgtggaggaggcatgatccagccgtgggggtccctgagactctcctgtgcagcctcgtgggttcaccgtcacttacagcccaacatggagttcgggtcccgccgaggcctccggaggggaagggctgggagtggggtctcgtaggttcctacaactaaacgtatggtaacctanagttccgtactcgaagtacctccggtgaacgggccctattcccacctactcctccgaagaacaactaaacttacccgaaagtaaactagtttaggtttaatccttaacaaatacgtaaatacggaccgttcggccggggacccgaagggaacccgtaccgggtacccttacgttaaccgtacgtcgggtacgggaccgggaagggggtaacnccggtagggttagggcggtttacgggtttacgttttcccggttttacgggttttccgggtaccggggggtaacccttaccgggggtaacccccgttggggttaacccccg

SEQ ID NO: 293178 - DNA, 666 bp, Homo sapiens
  misc_feature: GYAE6OF01ECCPO.4.27.C05.1.454.CMB.1.raw
  modified_base (305)..(305): a, c, t, g, unknown or other
  misc_feature (305)..(305): n is a, c, g, or t
  modified_base (390)..(390): a, c, t, g, unknown or other
  misc_feature (390)..(390): n is a, c, g, or t
tcagagcactgtagcacgaccggtgctcgatttagacgcgatcgaagggtttggggggagaggagcccagcactgggattccgaggtgtttccattcggtgatcagcactgaacagagaggactcaccatggagttttggctgagcttggttttccttgttgctactttaagaggagtccactggtggggtacagctgctggagtcgtggaggaggcatgatccagccgtgggggtccctgacgactctccgtgtgcagcctcgtggttccaccgtcacttacacgccacatgagttcgggtccnccgaggctccgaggggacgggcgtggagtggtctcgaggttctacgaataacgtatggtactacatcgtactcgacgactccggngaacgggccgtattaccaccatccctaccgaagagtaacctaaacttaccaaagtaaactagttaggttttaattaccttaacaaagtagtaaatacgtacgtcgggaccgggaccggaacggacccgtaccggtacccgttaccgttaacgtaccgttgggtacgggaccgggagggggacgcgtaagggttcgtcggtttcggttacgttttccggttttcgggtttccgggtcgggggacccgtaaccggggtaccccgttgggtaacccccg

SEQ ID NO: 293179 - DNA, 643 bp, Homo sapiens
  misc_feature: GYAE6OF01BJWLK.4.27.C05.1.454.CMB.1.raw
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagctgggttttccttgttgctactttaagaggagtccactgtggggtacagctgctggagtctggaggaggcatgatccagccgtggggggtccctgagactctcctgtgcagcctcgtgggttcaccgtcacttacacgccacatgagttcgggtccgccgaggcctccgaggggaaggggctgggagtgggtctcgaggttctcataacgatcggtactacatcgtactcacgactccggtagaacgggcctattccacctactcctaccgaacgacgacctaaacttacccaaagtaaacctagtttaggtttaacttacttactaaatagaaattagaccgtggccgggaccgaggaccgaccggtacccttaccgtaactacgtggtcggacgggacgggggagaccggaggtcggcgttgggttacgttttcccggtttacgggtttccggacgggggtaccccaacgggggtaccccgttggggttaccccg

SEQ ID NO: 293180 - DNA, 1043 bp, Homo sapiens
  misc_feature: GYAE6OF01B9LG7.4.27.C05.1.454.CMB.1.raw
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagctgggttttccttgttgctactttaagaggagtccatgtgggtacagctgctggagtcgtgggaggaggcatgactccgaggccgtggggggtccctggacgacctctccgtgtcgcgacgtccctcgtcggggttccacccggtctaaccttaccacgacccaacagtggtaacggtttcgggggtccccgccgaacggggtcccgttacccggaaaggggggaaaggggggtccgttagggggtaacgggttcggggggtttaccctaccggttaacggggttttccttaccgaaaagtttaaaaccggtaagtttacggggttaaacccctttaaacgtaaccgtttacccgggtttaaaccccttaccggtaaacggtaaccccggttttacccccggggtaagggggtaaaaacccgggggtccccccgggttaaaattttaccccccggaaacccctttaaccgtttacccccgttaaccccgaaacgggtaaaaccggaaacccttaaaaaccgttttaaacccccgaaaaaacgggtaaaacccctttaaaggttttaacggggttttttaaaacctttacccgttttaaaccgttaaaaaaccgttaagggttaaaaaccgttaacgggtaaccgttacggggccccgggggtaaccgggaaccggggtaaacccgggtacccggggtacccccggtttaccttaacccggttaccgttcggggttaacgggaccggggtaagggggggtaacgcccgggtaaggggttcgggtacgggtttagggtttacccgtttttcccggttttttcggggttttacccgggttaccggggggttaaccccggtaacccgggggttaaacccccgttcgggggttaacccccgg

SEQ ID NO: 293181 - DNA, 720 bp, Homo sapiens
  misc_feature: GYAE6OF01C6FCA.4.27.C05.1.454.CMB.1.raw
  modified_base (287)..(287): a, c, t, g, unknown or other
  misc_feature (287)..(287): n is a, c, g, or t
  modified_base (365)..(365): a, c, t, g, unknown or other
  misc_feature (365)..(365): n is a, c, g, or t
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagctgggttttccttgttgctactttaagaggagtccactgtgggtacagctgctggagtcgtggaggaggcatgatccagccgtgggggtccctgagactctcctgtgcagcctcgtgggttcaccgtcacttacagcccanatggtaggttcgggtcccgccgaggcctccggaaggggaacgggctgggagtgggtctcgtaggttctacagtaacgngtaggtactacagttcgacttcgagtacctccggtaggaaacggggccctaagtttccgaaccctatacctaccgaacgtacgaactaaacgtttacccaaagtaaacctagtttacgggtttaacttacgtttaaactaaacgttaggaaaagttacggtaccgtagggacccggggtaccggtaacgggaacccgtacccgggaccgttacccgttaacgtcgttacggtcggaccgggtagggggtaacgcggtacgggtcgggtacggtttcgggtttaacgttttcccggttttgggtttcccgggtacgggtaccccgtaacgggggtaccccgttgggttaacccccg

SEQ ID NO: 293182 - DNA, 883 bp, Homo sapiens
  misc_feature: GYAE6OF01C4GKX.4.27.C05.1.454.CMB.1.raw
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagcttgggttttccttgttgctactttaagaggagtccactggtggggtacagctgctggagtcgtgggaggaggcatgatccagccgtgggggtccctgagactctctgtgcagcctctggattctacgtttagccaacctaatcggccctggtacggtttcggggtaccccgccgtaacgggcccttacccgggaaggggggtaaacggggggccggttagggggtaaggggttccggggggttaccggaccgggacggggaccgaaacgttccggtaagggtttacggggtttaacggggttaacggggtaaaaaagtttgggtaaaacgttttttttaaaaggaacccgtaaacgggtaaacccttaccgggaaccgtaaacggtaaccctttccggttagggttacgggggaacccggggggtaccccgtaacccggttaacccaaccccgtaaccgttaccccgttacccgtaaaggaaccgtaaccgtaacctttaccccgaacgttaaccggaaacccctaaccccgtttacggttaacttccgttacgtaaccaaaagttacgaaaccgtaacgtacgtaggaacggaccggaccgaaccgggaaccgaaccgggtaccgttaaccttaaccgtaaccgttcgggaacccggtaaacgggtaaaaggtaaacgggtaaacgggggttacgggggggttaaacccttaaaccggttgttacggtttaacgg

SEQ ID NO: 293183 - DNA, 622 bp, Homo sapiens
  misc_feature: GYAE6OF01EOJ8X.4.27.C05.1.454.CMB.1.raw
  modified_base (352)..(352): a, c, t, g, unknown or other
  misc_feature (352)..(352): n is a, c, g, or t
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagctgggttttccttgttgctactttaagaggagtccactgtggggtacagctgctggagtctggaggaggcatgatccagcctggggggtccctgagactctcctgtgcagcctcgtgggttccaccgtcacttacagccacatgaggtttcgggtccgccgaggctccgaagggggaaggggctgggagtcgggtctcgaggttcncataacgatgtactacatcgtactcagactccgtagaacgggcctattcaacctatcctaccagacgactaaacttaccaaagtaactattaggtttatacgttacaaatagaaatagacctggaccgggaccgaaggaccgaccggtccgttactaccttacgtggtggacgggagggggacgcggtaggtggtacgttgggttacttttcccggttttgggtttccggtacgggggtacccgaacggggtaccccgttgggtaccccg

SEQ ID NO: 293184 - DNA, 658 bp, Homo sapiens
  misc_feature: GYAE6OF01EKU1N.4.27.C05.1.454.CMB.1.raw
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagcgtggttttccttgttgctactttaagaggagtccactgtggggtacagctgctggagtctgggaggaggcatgatccagccgtgggggtccctgagcctctcctgtgcagcctcgtgggttccaccgtcacttacagcccacatgaggtttcgggtccgccgaggcctccggaggggaaggggctgggagtgggtctgaggttctacaataacgatggtactacactcgtactcgacgactccgaggaacgggcctattaccacctactcctaccagaacgaactaaacttaccaaagtaactaagttacgtttaacttacttaacgtaaattagaaattaacgacgtcggaccgggaccggaggaccgtaccggtaccgttacgtaacgtacgttcggtcggacgggtaggggggacgacggtagggttcgggtcgttcgggtttaccttttccggttttcgggtttcggtacgggggacccgtaacggggtacccgttcgggtaccccg

SEQ ID NO: 293185 - DNA, 578 bp, Homo sapiens
  misc_feature: GYAE6OF01BSUHB.4.27.C05.1.454.CMB.1.raw
  modified_base (516)..(516): a, c, t, g, unknown or other
  misc_feature (516)..(516): n is a, c, g, or t
tcagagcactgtagcacgaccggtgctcgatttagacgcgatcgaagggtttggggggggagaggagcccagcactgggattccgaggtgtttccattcggtgatcagcactgaacagagaggactcaccatggagttttggctgagctgggttttccttgttgctactttaagaggagtccactgtggggtacagctgctggagtctggaggaggcatgatccagccgtggggggtccctgacgactctcctgtgcacgcctcgtgggttcaccgtcacttacagccacatgaggttcgggtccgccaggctccgaggggaaggggctgggagtgggtctcgaggttctacataacgataggtactacatcgtactcagactccgagaacggccatccactatctacaagacgactaattaccaagaactattaggtttactacttactaaatagaatagacgtcggcgggacgacggacgacggccgtactactacgtgtggacggaggggacncgagtggcgttggttactttcggtttgttcggtcgggtaccacggggtacccgtgggtcccg

SEQ ID NO: 293186 - DNA, 667 bp, Homo sapiens
  misc_feature: GYAE6OF01B4GTM.4.27.C05.1.454.CMB.1.raw
  modified_base (301)..(301): a, c, t, g, unknown or other
  misc_feature (301)..(301): n is a, c, g, or t
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagcttgggttttccttgttgctactttaagaggagtccactggtggggtacagctgctggagtctgggaggaggcatgactccgaggcccgtggggggtcccctggacgacctctcctgtgctagcctcgtgggttcacccgtcacttacacgccanatgagttgggtcccgccgaggcctccgaggggaacggggtcgtgggaggtgggtctcgtaggttcctacaataacgataggtactactatcgtactcagacctcggtagaacgggccgtattaccacctatcctaccagaacgactaaattaccaaagtaaactagttaggtttaactacttactaaatgtaaactagacgtggccggggaccgaagggaccgtaccgggtacccgttactaaccgttagtcggtcggcggggagggggacgcggtaggtggtaccgttgggtttaacttttcccggttttcgggtttaccggtcgggggtaccccgtacggggtaaacccccgttgggtaccccg

SEQ ID NO: 293187 - DNA, 818 bp, Homo sapiens
  misc_feature: GYAE6OF01CO9PT.4.27.C05.1.454.CMB.1.raw
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagcttgggttttccttgttgctactttaagaggagtccactgtggggtacagctgctggagtctggaggaggcatgatccgagccgtgggggtccctgacgactctcctgtgcagcctcgtgggttccaccgtcacttacagtccactatggagttcggggtcccgccgaggtcctaccggaagggggaacggggcgtagggaggttcggggtccttcgtagggttcctacgaattaaaccgagttacgggtaaacctaacgaattaccgtaacctcgacggtacctcccggtaggaaacggggtcccgtaattccgaaccctagtccctaccgagaacgaacctaaacgttacccaaagtaaacctagtttacgggtttaacttacctttaacgaaaattaggtaaactaggtaaccgtcgggtacccgggggaaccgtaacgggacccggtacccgggtacccgtttaaccgttaaccgttacggttacgggtacggggtacccgggaggggggggtaacctacgggtaacgggttacggggtaccggttttcggggtttaaaccttttttccccggggttttttaggggttttacccccggggttacgggggggtaaccccccgtttaacggggggtaaacccccccggtttcggggtttaacccccccgg

SEQ ID NO: 293188 - DNA, 548 bp, Homo sapiens
  misc_feature: GYAE6OF01BC2QZ.4.27.C05.1.454.CMB.1.raw
  modified_base (375)..(375): a, c, t, g, unknown or other
  misc_feature (375)..(375): n is a, c, g, or t
tcagagcactgtagcacgaccggtgctcgatttagacgcgatcgaagggtttggggggagaggagcccagcactgggattccgaggtgtttccattcggtgatcagcactgaacagagaggactcaccatggagttttggctgagctgggttttccttgttgctactttaagaggagtccactgtggggtacagctgctggagtctggaggaggcatgatccagcctggggggtccctgagactctcctgtgcagcctcgtgggttcaccgtcacttacagccacatgagttgggtccgccaggctccgaggggagggctgggagtgggtctcgaggttctcataacgatggtactacatcgtactcagctccgngaaggccattcaccatctcagagacaataccaagactatgtttatcttacaaatgaatagactgcggcgaggacacggcctctactactgtgcggaggggagcgaggtggcgttggttactttccgttttcgggtttcgtacgggggtacccacggggtaccctgggtacccg

SEQ ID NO: 293189 - DNA, 603 bp, Homo sapiens
  misc_feature: GYAE6OF01BJL79.4.27.C05.1.454.CMB.1.raw
  modified_base (300)..(300): a, c, t, g, unknown or other
  misc_feature (300)..(300): n is a, c, g, or t
  modified_base (444)..(444): a, c, t, g, unknown or other
  misc_feature (444)..(444): n is a, c, g, or t
tcagagcactgtagcacgaccggtgctcgatttagacgcgatcgaagggtttggggggggagaggagcccagcactgggattccgaggtgtttccattcggtgatcagcactgaacagagaggactcaccatggagttttggctgagctgggttttccttgttgctactttaagaggagtccactgtggggtacagctgctggagtctggaggaggcatgatccagccgtgggggtccctgagactctcctgtgcagcctctgggttcaccgtcacttacagccacatgagttgggtccnccaggctccgaggggagggctgggagtgggtctcgaggttctcgaataacgagtggtactacatcgtactcagactccgagaacggcctattcaccatcctaccagacaactaattaccaagtaacagttcggtttaatcctanaaattgaacttagactggaccgggacgaacgggaccacgggtcctactaacgtacgtggtacggacgggaggggtacgcgtaaggtggcgtttgggttacgtttccgttttggggtttccgacgggggaccctacggggtaaccccgttgggtaccccg

SEQ ID NO: 293190 - DNA, 849 bp, Homo sapiens
  misc_feature: GYAE6OF01ERRKT.4.27.C05.1.454.CMB.1.raw
  modified_base (206)..(206): a, c, t, g, unknown or other
  misc_feature (206)..(206): n is a, c, g, or t
tcagagcactgtagcacgaccggtgctcgatttagacgcgatcgaaggggtttgggggggagaggagcccagcactgggattccgaggtgtttccattcggtgatcagcactgaacagagaggactcaccagtggtagttttggctgagtcgttgggtttttccttgttgcttaactttaaggaggtagtcctagtggtgggtacngctgcgtggagtcgtgggaggaggcagtgactccgacggccggtcgggggtccctaggacgtactcctccgtgtcgcgcgtccttcggttcggttaccaccgtactaccttaccagacccagtagtcggtacgggttccggtcccgccgtacggtccgtaccggggaagggggtaacggggtcgtagggtacggggttcgggttaccttacgggtacggtttacctaacgtaaacgtaaccggttaagttacggtaaccttaacaccgtttaccgtacctaccgaacggtacccgttaccgggtaggaaccggggtcccgtaacttacccaacccgtacttacccgtacccggtaaggaacccgtaaacttaaacgttaaccgaaaagtacgtttaacgtttacggtttttaacctacgttaaacctaaagttaggtaaaacgtacggtccgggtaacggaccccgggggaccgaacggtacccgtacccggtacccgttaccttaacgtacgggttacggcggggtaaccggggaggggtacacgggtgggtacggttccggttaggtttacccgttttcgggtttacgggttacccgggacggggttaacccggacccgggtaccgttcccgggtaccccg

SEQ ID NO: 293191 - DNA, 637 bp, Homo sapiens
  misc_feature: GYAE6OF01DX3JZ.4.27.C05.1.454.CMB.1.raw
  modified_base (565)..(565): a, c, t, g, unknown or other
  misc_feature (565)..(565): n is a, c, g, or t
tcagagcactgtagcacgaccggtgctcgatttagacgcgatcgaaggggtttgggggggagaggagcccagcactgggattccgaggtgtttccattcggtgatcagcactgaacagagaggactcaccatgggagttttggctgagtcttgggttttccttgttgcttactttaagaggagtccacgtggtggggtacagctgctggagtcgtggaggaggcatgatccagccgtgggggtccctgagactctcctgtgcacgcctcgtgggttccaccgtctaaccttacacgccaactatggagtttcggggtcccgccgaggccgtaccggaggggaagggctgggagtgggtctcgtaggttctacgaataacgattggtaactacacgtcgtactcacgtactccgtaggaacggcctattacacctatctaccaagtacgaactaacttaccaaagtaactagtttggtttaactcttaacaaacttgaaattagaacgtgggaccgggaccgaggaccgtacggccgttactacgtacgtggtcgacgggaggggnacgtaggtggtacttggttaactttccggttttggttccggtcggggacctacgggtaccttgggtaccccg

SEQ ID NO: 293192 - DNA, 571 bp, Homo sapiens
  misc_feature: GYAE6OF01AKVCS.4.27.C05.1.454.CMB.1.raw
tcagagcactgtagcacgaccggtgctcgatttagacgcgatcgaagggtttgggggggagaggagcccagcactgggattccgaggtgtttccattcggtgatcagcactgaacagagaggactcaccatggagtttttggctgagctgggttttccttgttgctactttaagaggagtccactgtggggtacagctgctggagtctggaggaggcatgatccagccgtgggggtccctgagactctcctgtgcagcctctgggttcaccgtcacttacagccacatggagttgggtccgccaggctccgaggggaggggctgggagtgggtctcgaggttctcagtaacgatggtactacatcgtactcagctcgtgaggccattcaccatctacagacgacaattccaagaactatgtttatacttacaaatgaatagactggcgggccgaggacaccggcctctaacgtcgtggtggcggtagggggacgcgtaggtggcttcgggttactttcccggttttgggtttcggtcggggtacctacggggtaaccccttgggtaccccg

SEQ ID NO: 293193 - DNA, 859 bp, Homo sapiens
  misc_feature: GYAE6OF01EBS1Q.4.27.C05.1.454.CMB.1.raw
tcagagcactgtagcacgaccggtgctcgatttagacgcgatcgaagggtttgggggggagaggagcccagcactgggattccgaggtgtttccattcggtgatcagcactgaacagagaggactcaccatgggtagttttggctgagcttgggttttccttgttgctactttaagaggagtccactggtggggtacagctgcgtggagtcgtgggaggaggcatgactccaggccgtcggggggtccctggacgactctccgtgtgcacgtccttcgtcgggttccaccgtctaaccttaccagcccactaacgtggtacggtttcggggtcccgccgaacgggccgtacccggaaggggggaacggggccgtggggagggttcggggtcttacggtacggtttcctacgtaacgttaaacgtagttacgggtaactaacgtacgtaccgtacctacgtaacgtaccgtccgggtaggaaaccgggtcccgtaacttaccaaccgtacttaccgtacccgaagtaacgtaactaaacgtttaccaaaacgtaaactagtttacgggttttaacttaccttaaactaaaagttacgtaaacgttaacggaccgttacgggaccggggaacccggtaacggggtacccgtaacccgggtacccgtttaacccgttaacgttacccggttgggtaccgggacggggggtaacggggggacgtacgggtaacggttggggttaccggtttcgggttttaccggtttttacccggtttttcgggggtttttaccccgggtacgggggggttaacccccgtaaaccgggggggttaaccccccgtttcgggggttaaccccccg

SEQ ID NO: 293194 - DNA, 836 bp, Homo sapiens
  misc_feature: GYAE6OF01E4928.4.27.C05.1.454.CMB.1.raw
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagctgggttttccttgttgctactttaagaggagtccactggtggggtacagctgctggagtctgggaggaggcatgatccagccgtggggggtccctgacgactctcctgtgcagcctcgtgggttccaccgtcacttacagccacagtggtagttcgggtccgccgaggcctaccggaggggacggggcgtgggaggttgggtcctcgtaggttcctacgaagtaacggtagttacgggttaacctactaacgttaccgttaactcgaacggtacccgttaccgggtaacgggaaacggggtccctaacgtttacccgaaccctataccccgtaccgaaggtaacgtaaaccctaacgtttaaccccgaaaaggtaaaccgttaagtttcgggtttttaaacttaccgtttaaaccgtaaaagtaccggtaaaattaacgggtaacgttcggggacccggggaaccggaacgggtaacccggaaccggggttccccgtttaacgttaacccgtaacggttcgggtaccgggtaacggggggtaacggggggacgtaccggtacggggttacggggtaccggttttacggggtttaccgtttttcccgggtttttacgggggttttacccgggttccggggggaaccccggtaaaccggggggttaacccccgttccggggttaacccccg

SEQ ID NO: 293195 - DNA, 744 bp, Homo sapiens
  misc_feature: GYAE6OF01BJJF9.4.27.C05.1.454.CMB.1.raw
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagctgggttttccttgttgctactttaagaggagtccactggtggggtacagctgctggagtcgtgggaggaggcagtgatccaggccgtggggggtccctgacgactctcctgtgcacgcctcgtgggttccacccgtcaccttacagccacagtggaggttcgggtccgccgaggccgtccgagggggaagggcgtgggaggtcgggtctcgtaggttctacaagtaacgagtcggtaactactactacgtactcgaagtaccgtccggtaggaaacgggcccgtattccaacctatcctaccgaagtaacgaactaaagttaccaaagtaacctagtttacggtttaacttacctttaactaaaagttgaaacgttacggaaccgttcggggacccggggtaccggaacgggacccgtaaccgggtacccgttaccgttaaccgtacgttaggtacggggccggggtaaaggggggacgtccggtaagggttccgggtacggttaccgggttttacgttttcccggttttacggggttttacccggtcggggggtaaccccgttaacgggggtaacccccgtttcggggtacccccg

SEQ ID NO: 293196 - DNA, 725 bp, Homo sapiens
  misc_feature: GYAE6OF01D8GY9.4.27.C05.1.454.CMB.1.raw
tcagagcactgtagcacgaccggtgctcgatttagacgcgatcgaagggtttggggggggagaggagcccagcactgggattccgaggtgtttccattcggtgatcagcactgaacagagaggactcaccatggtagttttggctgagtcttgggttttccttgttgcttactttaagaggagtccactgtggggtacagctgctggagtcgtgggaggaggcatgatccaggccgtggggggtccctgacgacctctcctgtgcacgtcctcgtcgggttcaccgtctaaccttacacgccacatggaggtttgggtcccgccgagggcctccggaggggaaggggctgggagttgggtctcgtaggttcactaagtaacgagtcggtaactacagttacgtactacgacgacgtaccggtaggaacgggcccgtaattccaacccgtaatccgtaccaaggaacaactaaacgttaccaaagtaaactaagtttaggttttaacttacttaacaaaacgttagtaaataacgaccgtgggaccggggtaccgaacgggaaccgtaccgggtacccgttacgttaacctacggttggtacggacggggtaagggggacaccggtaagggttcgggtacgtttacgggtttatttcccgggtttttacgggtttaccggtacggggggtaccctaacgggggtaccccctttggggtaacccccg

SEQ ID NO: 293197 - DNA, 785 bp, Homo sapiens
  misc_feature: GYAE6OF01B7C5G.4.27.C05.1.454.CMB.1.raw
tcagagcactgtagcacgaccggtgctcgatttagacgcgatcgaagggtttgggggggagaggagcccagcactgggattccgaggtgtttccattcggtgatcagcactgaacagagagactcaccagtggtagtttggctgagtcgtttggttttccttgttgacttaacgtttaaggaggacgtccagtgggtcgggtacagtctgcgtggagtcgagggaggagcagtcgactaccgacggtccggggttcgggggtccctaggacgtaccttccgtccgtggtcgaccgtacgtcccgttcgtcgggttacccaccgttactaaccttacgacgacccatagtcggtacggttccgggcccgaccgacggtccgtaccgggaagggggaacgggtcgtgggtacggtcggtcgtacgtacggttcctacgaaacgtacgtacgttacggtaacctacgtacgttacgtaccacgaacggtacccgtacggtaggaaccggtcctaacgttaccaccgtataccgaccgaagaaccgtaacttaaacctacgaaactaacgttagtttacgtttacttactaacgaaatagaatacggacgtacgggaccggaccggagacccgtaccggttaccgttactaacggttacgtggacggggacggggaacggggtacgtacggtagggtcgggttacggtttacgttttaccgttttcccgggttttagggttcccgggtaccggggtacccggaacgggttccccgtcgggttaaccccg

SEQ ID NO: 293198 - DNA, 782 bp, Homo sapiens
  misc_feature: GYAE6OF01B06DR.4.27.C05.1.454.CMB.1.raw
tcagagcactgtagcacgaccggtgctcgatttagacgcgatcgaagggtttgggggggagaggagcccagcactgggattccgaggtgtttccattcggtgatcagcactgaacagagaggactcaccatggtagttttggctgagcttgggttttccttgttgctaactttaagaggagtccacgtggtggggtacagctgctggagtcgtggaggaggcatgatccagccgtcgggggtccctgagtacctctcctgtgacgacgccttcgtcggttccaaccgtcaacttacacgtaccaacagtggacggttcgggcccgaccgaggcctaccggaaggggaacgggcgtgggacggttgggtcctagtacggttctacgtaagtaaacgtagttacggtaactacgtaacttaccgttaacctacgtaacgtacccgttcccgggtaaggaaaccggggtccctaaagtttcccaacctacgtccctaccgaagaacgaactaaacttaaccgaaagtaaaccttaagttacggttttaaacttacctttaaactaaacgttaagtaaagttaacgaaccgttacgggaaccgggtaccggaacggacccgaccgggtacccgttacgtaaccttacggtacggttcggaaggggtacgggggaacgcgggtaacggttgggtaccggtttgggtttacgttttccgggttttacgggtttccgggtaccgggggtacccggtaaaccggggtaaccccgttcgggttaacccccg

SEQ ID NO: 293199 - DNA, 773 bp, Homo sapiens
  misc_feature: GYAE6OF01CK8MQ.4.27.C05.1.454.CMB.1.raw
  modified_base (587)..(587): a, c, t, g, unknown or other
  misc_feature (587)..(587): n is a, c, g, or t
  modified_base (674)..(674): a, c, t, g, unknown or other
  misc_feature (674)..(674): n is a, c, g, or t
tcagagcactgtagcacgaccggtgctcgatttagacgcgatcgaagggtttggggggggagaggagcccagcactgggattccgaggtgtttccattcggtgatcagcactgaacagagaggactcaccatggagttttggctgagtcgttgggtttttccttgttgcttaacgttttaagaggagtccactggtggggtacagctgctggagtctgggaggaggcatgatccgacggtcccggtcgggggggtccctaggacgtaccttccgtccgtggtcgccacggtcccttcggtcgggtttcccaacccgttcctacctttaccgacgccaactagttggtaggttcggggtccccgccgacgggtcccgtaccgggaagggggaacggggcgtggggagggttcgggtctacggtacggttcacgtaagttaacggagttacggtaactacgtagttccgtactacgaacgtccgtaccggtaggaacgggtaccctacgttacccacgtacttccctaaccgacggtaacgaacctaaacttaccgaaacgtaacttagtttacgtttacttacttaanaaatagtaaagtacgtacgtcgggccgggaccgaacggaccgtaccgggtccttacgtacgtacgtggtacgggacgggaggggganacggtcgggttacgttcggttcggttttaccgttttccggtttttacgggttccgggtaccgggggtacccgtaacccggggtaccgttcggtaccccg

SEQ ID NO: 293200 - DNA, 627 bp, Homo sapiens
  misc_feature: GYAE6OF01BT78H.4.27.C05.1.454.CMB.1.raw
  modified_base (295)..(295): a, c, t, g, unknown or other
  misc_feature (295)..(295): n is a, c, g, or t
  modified_base (422)..(422): a, c, t, g, unknown or other
  misc_feature (422)..(422): n is a, c, g, or t
  modified_base (521)..(521): a, c, t, g, unknown or other
  misc_feature (521)..(521): n is a, c, g, or t
  modified_base (542)..(542): a, c, t, g, unknown or other
  misc_feature (542)..(542): n is a, c, g, or t
tcagagcactgtagcacgaccggtgctcgatttagacgcgatcgaagggtttgggggggagaggagcccagcactgggattccgaggtgtttccattcggtgatcagcactgaacagagaggactcaccatgggagttttggctgagcttgggttttccttgttgctactttaagaggagtccacgtggtggggtacagctgctggagtctggaggaggcatgatccagccgtcgggggtccctgacgctctcctgtcgcacgcctcgtgggttccaccgtcacttacacgccanagtggaggttcgggcccgacgaggcctccggaggggacgggctgggagtcggtctcgtagttctacacgtaacgagtcggtaactacatcgtactcgagtccgtacgtaggaacggctactcacctntcctcagacactaactacaagactagttcggtttaatacttacaaagtgaaacgtaggacgtggccgggaacgagaccgtaccggtaccttactacgtntacggtggacgggacgggganacgtagggttcgacggtttggttaccgttttccggtttacgggttccggacggggtaccctacgggtaccccgttcgggtacccg

SEQ ID NO: 293201 - DNA, 816 bp, Homo sapiens
  misc_feature: GYAE6OF01EGZSF.4.27.C05.1.454.CMB.1.raw
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagcgttgggttttccttgttgcttactttaagaggagtccactggtggggtacagctgctggagtcgtggaggaggcatgactccaggccgtggggggtaccctgacgactctccgtgtgcacgccttcgtcgggttccaccgtcacgttacagcccacagttgacggtttcgggcccgaccgagggccgtaccggaaggggtaacggggcgttgggaggttggggtccttggaacggtttctacgaataacggatacggtaactactatcgtactacgacgtaccgtaccggtaggaaaccggggccctaagtttccgaaccctagtttaccccgtaccgaaagtaacgtaaacttaaacccgtttaaccaaaacggtaaaccttaagtttacgggtttttaaacctacgtttaaccgaaaaagttcggtaaaaactttacggacgttacggggacccgggtaaccgaacgggtaacccgtaacccgggttcccgttaaccttaaccgtaacggttcgggtacgggacggggaaacgggggtagacggtaacggggttccgggtaacgttttcggggtttaacccgtttttttccggttttacggggtttaaccgggaccgggggtaaccccgtaaaccggggggttaacccccttggggttaaccccccg

SEQ ID NO: 293202 - DNA, 860 bp, Homo sapiens
  misc_feature: GYAE6OF01C86CG.4.27.C05.1.454.CMB.1.raw
tcagagcactgtagcacgaccggtgctcgatttagacgcgatcgaaggggtttggggggggagaggagcccagcactgggattccgaggtgtttccattcggtgatcagcactgaacagagaggactcaccatggtagtttggctgagtcgttgggtttttccttgttgcttaactttaaggaggtacgtccacgtggtggggtacagctgcgtgggagtcgtgggaggaggcagtgactccaggccggtgggggtccctggagtcctcctccgtgtcgcgacgccgttcgttacgggttccaccgtactaaccttacacgacccacagttcggtacggttcgggtcccggccgacgggtcccgtaccggaacgggggaagggcgtgggtacggttcgggtcgtcgtacggttctacaacgtaacggtagttcggtaactacgtacttacgtactcgaacgtaccgtacggtacggacggtcgtacttaccacctacttcccaccgtaacgaacgtaaactaaacgtttaaccgaaaacgttaaacgttacggttttacggttttaactttaaccgttaaacgtaaacgtttaaacggtaaacggttaacggtaccggttaccgggggaacccggggtaacccggaaccgggtacccggtacccggggttacccgttacccgtttaacccgttacggttcgggacgggtaccgggggaagggggtaccgtcggtaacgggggttcggttacggttttacgggttttacggttttttcccgggtttttacgggggtttacccggggttacccgggggttacccgggttaaaccggggttccccggttcgggttacccccgg

SEQ ID NO: 293203 - DNA, 814 bp, Homo sapiens
  misc_feature: GYAE6OF01EKEZR.4.27.C05.1.454.CMB.1.raw
tcagagcactgtagcacgaccggtgctcgatttagacgcgatcgaagggtttgggggggagaggagcccagcactgggattccgaggtgtttccagttcggtgatcagcactgaacagagaggactcaccatggtagttttggctgagtcttgggttttccttgttgcttactttaagaggagtccactggtgggtacagctgcgtggagtcgtgggaggaggcatgactccgaggtccggtcgggggtccctggacgtacctctccgtgtcgccacgtccgttcgtcgggttaccacccggtcctaccgttaacgacgccaactagtggtacggtttcggggtccccgaccgtacgggtcccgttacccggggaaaggggggtaacggggtccgtaggggttacgggttcggggttccgttaccggtacgggttttacctaaccgtaaacgttaaaccggtagttacgggtttaacctaacgtacgttaccgtactaccgtaacgtaccgtccgggtacggaacgggtcctacttccaacctacgtcctaccgaagtactaactaactaccgaagtaactagttaggtttacttacgttaactaaagtagtaaacgtacggtacggtcggtacgggaccggaacggtaacccgaccgggttacccgtacgtaccgttacggtggtacgggacggggagggggactacgggtacgggttcggttacggtttggtttaccgttttaccggtttcgggtttttacgggaccggggttaacccggtaacccggggtacccgttccgggtacccccgg

SEQ ID NO: 293204 - DNA, 627 bp, Homo sapiens
  misc_feature: GYAE6OF01E2ICY.4.27.C05.1.454.CMB.1.raw
  modified_base (433)..(433): a, c, t, g, unknown or other
  misc_feature (433)..(433): n is a, c, g, or t
  modified_base (435)..(435): a, c, t, g, unknown or other
  misc_feature (435)..(435): n is a, c, g, or t
  modified_base (453)..(453): a, c, t, g, unknown or other
  misc_feature (453)..(453): n is a, c, g, or t
  modified_base (526)..(526): a, c, t, g, unknown or other
  misc_feature (526)..(526): n is a, c, g, or t
tcagagcactgtagcacgaccggtgctcgatttagacgcgatcgaagggtttggggggggagaggagcccagcactgggattccgaggtgtttccattcggtgatcagcactgaacagagaggactcaccatggagttttggctgagcgtggttttccttgtagctactttaagaggagtccactgtggggtacagctgcgtggagtcgtggaggaggcatgatcccagccgtggggggtccctgaggacctctcctgtcgcagcctcgtgggttccaccgtcacttacacgccacatgaggttcggggtcccgccgagcctccggaggggaacggggtctgggtacgtggggtctacgtggttcacaagtaacgagtacggtacactagtcgtactcgaacgtacctccggtaggaacgggccaattccacncnctcagacgacaatacaanactagttagttatcttacaatagaatagacgtcggcgggaccggacggaccgtacggacctactactacgtgnggcggggaggggagacggtaggtggtcggttcggttacgtttccggttttcggttaccggtacgggggtaccgaccggggtaaacccgtcgggttaacccg

SEQ ID NO: 293205 - DNA, 801 bp, Homo sapiens
  misc_feature: GYAE6OF01BAJ51.4.27.C05.1.454.CMB.1.raw
  modified_base (181)..(181): a, c, t, g, unknown or other
  misc_feature (181)..(181): n is a, c, g, or t
  modified_base (201)..(201): a, c, t, g, unknown or other
  misc_feature (201)..(201): n is a, c, g, or t
tcagagcactgtagcacgaccggtgctcgatttagacgcgatcgaagggtttgggggggagaggagcccagcactgggattccgaggtgtttccattcggtgatcagcactgaacagagaggactcaccatggtagttttggctgagtcttgggttttccttgttgcttacgtttaagagngtccacgtggtgggtacagntgcgtggagtcgtgggaggaggcagtgtactccgaggccggttcggggggtcccctaggacgtaccttccgtccgtggtcgccgacgtcccgttcggttcggggtttccctaaccccggttcctaaccgtttaaccgacgacccaacgtaagttcgggttacgggttcggggttcccccgccgacgggtcccgttaccggaacgggggtaaggggtccttggggacggttgggttacctcggtaacgtttcaccgtaagtacggtagttcggtaactacgacgttcgtactcgaagtaccgtcggtaagacggtcctacgttaccacctagtaccgtaccgaagtacgtaacttaactaaccgaagtaacgttagtttaggttactacttaacgaagtacgtaacgtagtacccgagggcccggtaacggacggaaccttaccgggtacccgttaacttacccggtagttcgggtaacgggacgggtaggggaacgttacggcgggttacgggtcgggtttacgtttacccggttttccggttttggggtttcccggaggggttacccccggaacgggtttacccccggtggttcccccg

SEQ ID NO: 293206 - DNA, 832 bp, Homo sapiens
  misc_feature: GYAE6OF01EVKJE.4.27.C05.1.454.CMB.1.raw
  modified_base (178)..(178): a, c, t, g, unknown or other
  misc_feature (178)..(178): n is a, c, g, or t
  modified_base (213)..(213): a, c, t, g, unknown or other
  misc_feature (213)..(213): n is a, c, g, or t
tcagagcactgtagcacgaccggtgctcgatttagacgcgatcgaagggtttgggggggagaggagcccagcactgggattccgaggtgtttccagttcggtgatcagcactgaacagagaggactcaccagtggtacgttttggcctgagcgtggttcgtgtagcgtacgtagtagngcatgtggtcagctgatgtagtcgtggagagcatnagtccagtcggtcggggttccaggtacactctccgtgtcgctacggtccttcgtcggttaccaccggtactacttacgacgacccgaccgttagtaccggtaaggtttcccggtaccgacccggaggtcccgttaccggggaacgggggtaaccgggtaccggttggttaaccggtttcgggtacctttaacccgtaaagggtttcccttaagggaaactaaaccgtaacgtttaccgtaaaccttaccgtaaccgttacgtaccccgttaacgacccggtaccgtttaccggaacggtaccggtacctaacttaacccgaactttacgaacccgttaaccggaagtaaccgtaccttaaacggtaccctaaacgaacccggtaacccttagtaaccggttagtaaccgttacgaaccgtaacggtaaacccgcggttaaagtacccggaaacgttacccgggaacccgaacgggtaccctaaacccggtacgtaaccgtttaaccacgtacccggtaacgaaacggtaaaacgtacggtaacggggtaaacccgttaaacgaccgtagtttaaccgtacgtttaagtaacggttacggtaaccgggtaacgaaaccgg

SEQ ID NO: 293207 - DNA, 797 bp, Homo sapiens
  misc_feature: GYAE6OF01EFXBA.4.27.C05.1.454.CMB.1.raw
tcagagcactgtagcacgaccggtgctcgatttagacgcgatcgaagggtttggggggggagaggagcccagcactgggattccgaggtgtttccattcggtgatcagcactgaacagagaggactcaccatggagttttggctgagctgggttttccttgttgctactttaagaggagtccactgtgggtacagctgctggagtcgtaggaggaggcatgactccgaggccgtggggggtccctaggacgtacctctccgtggtcgcgacgtccttcgtcgggttaccaccgtcctaaccttaacgacgacccaactagtcggtacggtttcgggtcccgaccgaacgggtccgttaccgggaacggggggtaaacggggtccggttaggggacgggtttcggggttaccttacggtacggtttccgtacgtaacgttaaacgtagttacggttaacctaacgtacgttaccggttaactaccgtaacgtaccgtaccggtacgggtaaacggggcccttaacgtttacccgaacctacgtcccgtaaccgaagtaaccgtaaccgtaaacttaccgaaaaacgtaacgttaagtttacgggttttaactacgtttaaactaaagttaacgaaacgttacggtaccgtacgggaccgggtaaccgaacgggaccgtaccggtccggttaactaccgtacgtggcggtacggggagggactcgggtaggttcggtcgttagggttacttttccggttaggttccggacgggtacccgtacggtacccgtggtaaccc

SEQ ID NO: 293208 - DNA, 837 bp, Homo sapiens
  misc_feature: GYAE6OF01AEA4E.4.27.C05.1.454.CMB.1.raw
  modified_base (221)..(221): a, c, t, g, unknown or other
  misc_feature (221)..(221): n is a, c, g, or t
tcagagcactgtagcacgaccggtgctcgatttagacgcgatcgaaggggtttggggggggagaggagcccagcactgggattccgaggtgtttccattcggtgatcagcactgaacagagaggactcaccatggagttttggctgagtcttgggttttccttgttgcttaactttaagaggatccactggtggggtacagctgctggagtcgtgggaggnggcagtgactccgacggtccggtcgggggtccctgacgcctctctgtgcacgtcctcgtcggttccaccgtctaacgttaccgacgcctaacagtcggtacggtttccgggccccgaccggacggtccgtaaccggagggggtacggggcgtggggaggttcgggtctacggtaccggttctaacgtaacgtaacgtacgttacggtaactaacgtacgttaccgtaaccgtacgaaccggttaccgtacccgggttaaggggaaaccggtcccttaaacgttccccgtaaacctacccgtccgtacccgtaaacggaacctaaacccgttaaaccttaaaccgaaaagttacccttaaggttttacggttttaacctaactttaaacgaaagttacgtaaacgttcggaaccgggttcgggaaccggggtaccggaaccgggtacccgtaccccggtaccgtttaactaccgtacggttggggtcgggaccggggtaggggactcgggtacgggttcggttccggtttaagggtttacctttttcccggggtttaggggttaccccgggtcgggaaccccgggtttaccgggttaccccgttcggggttaccccc

SEQ ID NO: 293209 - DNA, 1030 bp, Homo sapiens
  misc_feature: GYAE6OF01C9BM4.4.27.C05.1.454.CMB.1.raw
  modified_base (225)..(225): a, c, t, g, unknown or other
  misc_feature (225)..(225): n is a, c, g, or t
tcagagcactgtagcacgaccggtgctcgatttagacgcgatcgaagggtttggggggggagaggagcccagcactgggattccgaggttgtttccattcggtgatcagcactgaacagagaggactcaccatggtagttttggctgagtcgttgggttttccttgttgctacgtttaagaggactccgagtggtacgggtacagcgtgctggagtcgtggaggngcagtgactccgaggccggtgggggtaccctgacgtaccttcgtcccgtggtcgccgtacgtcccgttggttaccgggttcccaaccggttacaccgttaccgaccgaccctaacgtaggttacgggtacggttttccggggacccccgaccgtacggggtacccgttaaccggggaagggggggtaacggggtaccgttagggggtaagggttcccggggttaacctttaccggggttacggttttacctaacgtaaacggtttaacgggaggttttaaccggaaccttaacgtaacgtttacccggtaaaccgttcgaacccggttaccggtaacccgggtttaacggggaaaccgggttacccttaaaccgtttaccccggaaaccgtaaccgttacccgtaaacccggaacgggtaaacctaaaccgttaaaccgttaaaccgaaacggttaaaccgttacggttttaaacgggtttaactttaacccgttaacgtaaaagttaaccgtaaacggtttaaaccggtacggtaaccggggtaccggggtaacccggtaaccgggaaccccggtttaacccggacccgggtttaaacccgtttaaccgggttaccggttaaccgggttacggggggaaccggggtacgggggtaaggaaccggggttacggtttaaccggggttccggtttacgggtttttacccgttttacggggtttttttaccgggttcccggggttaacccggggggtaacccggttaaccccggggttaacccgggttacccgggtttaacccccggg

SEQ ID NO: 293210 - DNA, 951 bp, Homo sapiens
  misc_feature: GYAE6OF01B0T9D.4.27.C05.1.454.CMB.1.raw
tcagagcactgtagcacgaccggtgctcgatttagacgcgatcgaagggtttgggggggagaggagcccagcactgggattccgaggtgtttccattcggtgatcagcactgaacagagaggactcaccatgggtagttttggctgagtcgttgggttttccttgttgctactttaagaggagtccactggtggggtacagctgcgtggagtcgtgggaggaggcatgactccgaggtcccggtcggggggtccctggacgtaccttcctccgtggtcgcacgtccttcgttcgggttaccaccgttctaccttacacgtaccacgtagttcggtacggttcgggtaccccgccggacggtacccgtaccgggaagggggtaacggggtcggtaggggtagggttcggggttaccgttacggtaacggtttaccctaacgttaaacgtaaacggtacggtttaacggtaaccttaacgtaacgtttaccgttaaccgtaacgtaacggtacccggttaccgggttaacgggaaccggggtacccttaaccgtttaccctaaacccgtaccgttaccccgtaaaccggaacggtaaaccgtaaacccgttaaacccgttaaacccgaaaacggttaaaccgtttaaggttttaccggttttaaacctttaaccgtttaaaccgtaaaaggttaacggtaaacgtaacggtaaccgggtaccggggacccgggaacccggggtaacggtaaccccgggtacccgggttacccgtttaacccgttaccggttaaccggttcggggaaccggggcggggtaaaccgggggacgtacgggtacggggttccgtttacggggtttacggtttacccgtttttcggggttttcgggtttaccgggtcccggggtaaacccggttacccggggttaaccccgttccgggttaacccccg

SEQ ID NO: 293211 - DNA, 934 bp, Homo sapiens
  misc_feature: GYAE6OF01ESKIC.4.27.C05.1.454.CMB.1.raw
tcagagcactgtagcacgaccggtgctcgatttagacgcgatcgaagggttgggggggagaggagcccagcactgggattccgaggtgtttccattcggtgatcagcactgaacagagaggactcacatggagttttggctgagctgggttttccttgttgctacttaagaggatccactgtggggtacagctgctggagtcgtgggaggaggcagtgactccgacggtccggtcggggggtcccctaggacgtacctccttcccgttggtacggtccacggtcccgttccggttccggttcccgtacccgtacctaccgttaacgaaccgccctaaactacggttggttaccgggtttcccgggggtaccccgaaccggtccgggaccggttccccggggaaaggggggggaacgggggtcccggttgggggtaccggggttttacgggttcccggttacggtacggttttaccgtaaaccgtaacggttaaaaccggtacggtttaacggttaaaccctaacgtaaacctttcccgggttaacctaacccgtaaccggggttaaccctttacccggggaaggggtaaaccccgggggtaccgtttaaacctttaccccgaaaccgtacccttacccgtttaaaccgaagtaaaccgtaaacccttaaaaccgttaccggaaaacgttaaacgttaacgtttacgggttttaacttaccttaaagtaaactaagtaacgtacgtacggtcggaccgggtacggaaccgggtaccgaccggtaaccgtttaccgtaccggttacgtgggtaccgggacggggaggggtacggtacggtaggtcgggttaggtttaccggtttcggtttttaccgggtttccgggtttcgggtaccggggaccggttaaccgggttccccggtacgttaccccgg

SEQ ID NO: 293212 - DNA, 903 bp, Homo sapiens
  misc_feature: GYAE6OF01AY9ER.4.27.C05.1.454.CMB.1.raw
tcagagcactgtagcacgaccggtgctcgatttagacgcgatcgaaggggtttgggggggagaggagcccagcactgggattccgaggtgtttccattcggtgatcagcactgaacagagaggactcaccatggtagttttggctgagtcgttgggtttttccttgttgacttaacgtttaagaggtacgtccacgtggtggggtacagtctgcgtggagttcgtgggaggaggcagtcgactccgacggtccgggtcgggggtccctaggacgtacctctccgtgtcgctacgtccgtcgtcgggttcctaccgtactaccttacacgtccatagtcggtaggttccgggccgaccgacggtccgtacgggagggggtaacgggtcggtaggggtacggttgggtcctacggtacggttcctacgtaacgtaaacgtagttacggttaaccttaacgtacgttaccgtacttaccgacggtacccggtccgggtaacgggtaccggtaccgttaacttccgaaccctacttcccgtaacgaacgtaacgtaacttaaactacgtaaacgtaactttacggtttaagttttaaccttaaccgtttaaacgtaagttaaacggtaacgttaccggtaaccgggtcggggtaaccccggggaaccgggtaaccgggtaccccgggtaacccggttacccggttaaaccgtttaaccgttaccgggtagggttaccggggaaccggggggtacggggtacggttaccgggtggggttaccggggttactttttccggggttttaccggtttttaccgggttttccgggggtttacccgggttacccgggggggtaaacccgggtttaaccccggttaaaccccgggttccgggtttaaccccccgg

SEQ ID NO: 293213 - DNA, 883 bp, Homo sapiens
  misc_feature: GYAE6OF01D8W8E.4.27.C05.1.454.CMB.1.raw
tcagagcactgtagcacgaccggtgctcgatttagacgcgatcgaagggtttggggggagaggagcccagcactgggattccgaggtgtttccattcggtgatcagcactgaacagagaggactcaccatggtagttttggctgagtcttgggtttttccttgttgcttaactttaagaggagtccacgtgtggggtacagctgcgtggagtcgtgggaggaggcagtgactcccacggtcccggttggggggttacccctggacggacccttccgtcccgttgtcgaccgacggtcccgttcgttacggggttccaacccggttcctaaccgtttaaccaccgacccaccgagttaggtacgggtttccgggtccccgaccgacgggtccgtaccggaagggggaacggggtcgtgggtaggttcgggttcctacggtacggtttcacgtaacgttaaccggtagttacggttaacctaactacgttaccgttaacgtcctaacggtcccgttaccggacggtaaacggggacccttacgttaccgtaaccctacgttaccttacccgaaaggtactaaacctaaaccgttaccaaaacgtaactaaggttttacgtttaactttcgttaaaccgtaagttaacggtaacgttaacggtacggtcgggtaacccggggaccgggaacgtaacccggtaccggtacccgtttacgtaacccgttaccggtggtaccgggtaacggggacgggggtaagccgggttacggtcggggttacgttttccggggtttaaccgtttttcccgggtttttacggggtttcccgtacccggggggtaaccggtaacccggggttaaccccgtttcggggtaaaccccccg

SEQ ID NO: 293214 - DNA, 783 bp, Homo sapiens
  misc_feature: GYAE6OF01BKMK6.4.27.C05.1.454.CMB.1.raw
tcagagcactgtagcacgaccggtgctcgatttagacgcgatcgaagggtttggggggagaggagcccagcactgggattccgaggtgtttccattcggtgatcagcactgaacagagaggactcgaccagtggacgttttggctgagtcttgggtttttcctgttgcttaacgtttaagaggagtccacgtggttcggggtacagcgtgcgtggagtctgggagaggtcaagtgactccgagtccggtcgggggtcctagacgtcctctccgtagtcgacacgcgttcgtcgggtttaccaccgttactaaccgttacacggtaccctagtacggttcggtaaggtttccgggtccgaccgtaacggtccgtaccggggaaggggtaacgggtcgtcgggacggttcgggtactccggttacggtttccgtaacgtaacgttaacggtcgttacggtaaccttacgtaccgttacgtaccgtacgtaccggtactccgggttacggaacggtccctaacttaccgaacctgtaccgtaccggaataccgtaacgtaacgtaccgaagtaccgtagttacgtttacttaccgtaacttaacgtagtaacttcggtacgtaccggccgggtaacggaggtaccccgtacgtaccttacggttacctacggtcgtacgggacgggtacgggtagtccgtaagggtcgttcggttcggtttccgttttacccgtttacgggtcggttacggggaccccgtgggttaaccccgtggttaacccccgg

SEQ ID NO: 293215 - DNA, 786 bp, Homo sapiens
  misc_feature: GYAE6OF01EQ0AV.4.27.C05.1.454.CMB.1.raw
  modified_base (353)..(353): a, c, t, g, unknown or other
  misc_feature (353)..(353): n is a, c, g, or t
tcagagcactgtagcacgaccggtgctcgatttagacgcgatcgaagggtttgggggggagaggagcccagcactgggattccgaggtgtttccattcggtgatcagcactgaacagagaggactcaccatggtagttttggctggagcttgggttttccttgttgcttaacgtttaaggaggagtccacgtggtggggtacagctgcgtggagtcgtgggaggaggcatgaactccgacggtccggtcgggggtccctaggacgtacctcgtccgtgtcgcacgtccgttcggtcggtccaaccgtctaacgttacacgaccctaactagtggtacggttcgggccgaccgnggtccgtacggaggggagggctggggtacgtcgggtctcgtaggtttcctagaacgttaacgtaagtcggttaacctacgtacgtacctaacgtaccgaacggtaccctacggggtacggaaccggaccgttaacttacccgtaacgtactacccgtacaaggtaactaaccttaaagttaacccgaaaataaccgtaagtttacggttaacttacgtaaacgtaaataagtaacgtacgtacggtcggtaccggggaaccggaacggtacccggtaaccgttccccgttagtaaccccgtagttaccgggtgggacggggtaaggggaacgccggttaaacggttcggtaacggttttcggttacgttttccggttttagggttcccgggtagggtacccgggtaaacggtaccccggttgggtaacccccg

SEQ ID NO: 293216 - DNA, 814 bp, Homo sapiens
  misc_feature: GYAE6OF01ARI9V.4.27.C05.1.454.CMB.1.raw
  modified_base (727)..(727): a, c, t, g, unknown or other
  misc_feature (727)..(727): n is a, c, g, or t
tcagagcactgtagcacgaccggtgctcgatttagacgcgatcgaagggtttgggggggagaggagcccagcactgggattccgaggtgtttccattcggtgatcagcactgaacagagaggactcaccatggtagttttggctgagtcgttgggttttccttgttgcttaacgtttaaggaggtacgtccgacgttggttaggggtacagtctggcgttggacgtcgtagggacggaggctatcgactccgacggtccggttcgggggtccctggacgtccttcctcgtggtcgcgtacgtccgttacggttcggttacctacccgtactaaccgttaccgacgacctactaggttcggtacggttccggggtcccgaccggacggtcccggtacggggaagggggtacgggtcggttagggtacggttcggtcgttacggtcggttacctacgtaacggtaacgtacgttacggttaaccctacgttaccgtaccgtaccgtacgaaccggttaccggttacccgggtaacgggtaaccgggtcccttaaccgttacccaaccgttccgtaccgtaccgaacgtaacgtaacttaaacccgtaacgaaagttaccgttagtttaccgtttaataacctagtaaagtacggtaagtaccggtacgtacgggcccgggtaaggacccgtaccgggtaccgtaccgttactacgtacggtggacgggnggggacgtacggagtcggttagtccggtttgtttcccgttttgggttccggtacggaccggggttacaccgggttccgtcgtacccg

SEQ ID NO: 293217 - DNA, 766 bp, Homo sapiens
  misc_feature: GYAE6OF01EP05F.4.27.C05.1.454.CMB.1.raw
  modified_base (267)..(267): a, c, t, g, unknown or other
  misc_feature (267)..(267): n is a, c, g, or t
  modified_base (303)..(303): a, c, t, g, unknown or other
  misc_feature (303)..(303): n is a, c, g, or t
tcagagcactgtagcacgaccggtgctcgatttagacgcgatcgaagggtttgggggggagaggagcccagcactgggattccgaggtgtttccattcggtgatcagcactgaacagagaggactcaccatggtagttttggctgagcgttggttttcctgttgctacttaagaggagtccactggtggggtacagctgctggagtcgtgggaggaggctatgactccgacgccggtcgggggtccctgacgtctctccgtgtcgcncgtcctcgtcggttccaccgtcacttacgacaccanagtggtacggttcgggtccgccgacggccgtaccggaagggggaagggcgtagggtaggtcgggtactcggtacggtttcactaacgtaacgagttacggttaactaacgtacgttacgtacctacgaacgtacccgtaccgggtagggaaccgggtccgttaacttacccgaaccttacgtcccgaaccgaagaaccgtaaactaaaccttaaccgaaagtaaccgtttaagttttacggtttttaactaacctttaaacgaaaagttagtaaacgttacggtaccgggtcggggacccggggtaacccggaacgggtacccgtacccgggttcgttaacccgttaacgttacgtcgggacgggtacggggaaggggactcgggtaggtcgtacggtttcggttacgtttttcccggtttgggttccggacggggtaccgtaacgggttcccggtgtacccg

SEQ ID NO: 293218 - DNA, 832 bp, Homo sapiens
  misc_feature: GYAE6OF01BSSDO.4.27.C05.1.454.CMB.1.raw
tcagagcactgtagcacgaccggtgctcgatttagacgcgatcgaagggtttgggggggagaggagcccagcactgggattccgaggtgtttccattcggtgatcagcactgaacagagaggactcaccatggtagttttggctgagcgttgggttttccttgttgctaactttaagaggagtccactggtgggtacagctgctggagtcgtgggaggaggcatgactccgaggccggtcggggggtaccctggacgtactcctcgttggtcgcacgtcctcgttcgggttccaccgtctaccttacacgccacagttggtacggttcggggtaccccgccgtacggccgttaccggaagggggaacggggtccgtggggtacgggttcgggtctccggttaggttcctaagtaacgttaaacgagttacggttaactaacgtacttcgtaactacgaacggtaccttaccggaggaaccggtccgtacttacccgacctacttacctacccaagaacaactaaactttaaccaaacgtaaacttaggtttagttttaacgtttaccttaaataaacgttagtaaaggttacgaccgtcgggcccggggtaaccgaacgggtaaccccgaccgggtttaacccgttacgttaacccgtacgggttcgtacgggggtaccgggtagggggaatacccgggttaggggtttaccgggtacggttttacgggttttacccgggttttcccggtttttacggggttttaccggggtacccgggggttaaccccggtaaccgggggttaaccccgttcccggggtttaacccccggg

SEQ ID NO: 293219 - DNA, 1086 bp, Homo sapiens
  misc_feature: GYAE6OF01BTNT9.4.27.C05.1.454.CMB.1.raw
tcagagcactgtagcacgaccggtgctcgatttagacgcgatcgaagggtttgggggggagaggagcccagcactgggattccgaggtgtttccattcggtgatcagcactgaacagagaggactcaccatggtagttttggctgagtcttgggtttttccttgttgcttaactttaagaggagtccacgtggtggggtacagctgcgtggagtcgtgggaggaggcatgactccgaggtcccggtgggggtcccctaggacgtaccttccgttccgttggtacgccgtacggtcccgttcggttcgggttccacccgttacctaacctttaaccgacgaccctaacgtacgttacggttacggtttccggggtaccccgaccggtaacgggtcccgtaacccgggaaggggggtaacggggtccgttaggggtacggtttcggggttacctttaccggtacgggtttacctaaccgtaaagttaaccggtaagttacgggttaacccttaacgtaacgttaccgtaaccgtacgtaacggtacccgttacccgggtaaagggtaaacccgggtacccgttaaaccttacccgaacccgttactttaccccgtaacccgtaaagggtaacccgtaaaacccgttaaacgtttaaacccgaaaacggtaaaacgttttacggttttaaccggttttttaaacctttaacccgtttaaaacgttaaaaacggtttacggtaaaaacggtttaacccgggttaaccgggttacgggggtacccccgggggtaaaccccgggtaaaaccggggtaacccccgggttaaacccgggggttacccccttttaacccgggttaaaccgggttcccggttagggggttaaacccgggaccgggggggttaacggggggtaaccgtaccggggttaacggggtttcgggttaaccgggtttttaccgggtttttaccccggtttttttccccggggtttttagggggtttacccccgggttacccgggggggttaaaccccccggggttaacccggggtttaaacccccccggtttcggggtaaaccccccccgg

SEQ ID NO: 293220 - DNA, 913 bp, Homo sapiens
  misc_feature: GYAE6OF01ECBP8.4.27.C05.1.454.CMB.1.raw
tcagagcactgtagcacgaccggtgctcgatttagacgcgatcgaagggtttgggggggagaggagcccagcactgggattccgaggtgtttccattcggtgatcagcactgaacagagaggactcaccatggtagttttggctgagtcgttgggttttccttgttgctaacgtttaaggaggagtccacgtggtgggtacagctgcgtggagtcgtgggaggaggcagtgaactccgacggtccggttcggggggtaccctaggaccgtaccttccgtccgttggtcgaccgtacgtcccgttcggttcgggttacccgtacccgttaccgtaacctttaacgacgtaccaacgtagtacgggtaccgggtttccggggaccccgtaccggtacgggtaccgtaccggggtaacggggggtaacggggtcgttaggggtaacgggtttcgggttaccgttacggtacggttttaccgtaacgtaaacgttaaacgtacgttacggttaacctaacgttacgttacgtaacccgtacgtaaccggtaccgtaccggtagggaaccggtaccttacgtaccaccgtactaccgtacgaaggactaaactactaaccgaaagtaacgttagttacgtttaactaccgttaaataaacgtagtaaactacggtaccgtacgggacccgggtaaccggaacgaacccggtaacccggttacccgttacgttaaccgtacgggttacgggaacggggttaccgggggaaacggggacgtacggttccgggttaggggttaccccggtttaagggttttccccggtttttccggggttttaaccggggtttccggggaaccccgggggtttaaccccgggaaacccggggtttcccccgttccggggttaaccccccgg

SEQ ID NO: 293221 - DNA, 751 bp, Homo sapiens
  misc_feature: GYAE6OF01E2K5G.4.27.C05.1.454.CMB.1.raw
tcagagcactgtagcacgaccggtgctcgatttagacgcgatcgaagggtttggggggggagaggagcccagcactgggattccgaggtgtttccattcggtgatcagcactgaacagagaggactcaccatggagttttggctgagcttgggttttccttgttgctactttaagaggtagtccactggtggggtacagctgctgggagtcgtggagggaggcatgatccgagtccggtcggggggtccctgacgtcctctccgtgtgcacgcctcgttcgggttccaccgtctaacttacacgccactagtggtacggtttcgggcccgccgtaggccgtccggaagggggtaacgggcgtgggtaggttcgggtcctacgtacggttctacgtaacgtaaacggtagttacggtaacctactacgttaccgtaccgtacgacgtacccgtccggtaaggaaccggggtcctacgttaccaaccttactaccgtaccgaagaacgtaacctaaactttaaccgaaacgtaacgttagtttacgggtttaacttacgttaactaaagtacgtaagtacggtacgtcgggaccgggtaaccgacggtaaccggaccggtccgtaccttacgtacggttcgtagggccgggtaaggggactaccggaggttcggtacgtttggtttaccgtttccggtttacgggttccggtacggggtaaccccgttacgggtacccgttcggttaaccccg

SEQ ID NO: 293222 - DNA, 889 bp, Homo sapiens
  misc_feature: GYAE6OF01CC5PG.4.27.C05.1.454.CMB.1.raw
  modified_base (130)..(130): a, c, t, g, unknown or other
  misc_feature (130)..(130): n is a, c, g, or t
tcagagcactgtagcacgaccggtgctcgatttagacgcgatcgaagggtttgggggggagaggagcccagcacgtgggattccgaggtgtttccattcggtgatcagcactgaacagagagactcaccntggtagtttgctagagtcgttgggttttccttgttcgtacttacgttaaggagacgtcctacgttggtacgggtacagtcgtgtcgtaggagtcgtgggaggacggtctagtgtaactccgacggtcccggttcgggggtccctagacgtccttcctccgttacgtacgaccgttccgtttaccggttacggttcccgtaaccggttacctaaccgttaacgaccgtccctaagtaggtttacgggtaggttttcccggggcccgtacccggtaccggtacccgttacggggaacggggtaaacggggttcgggtcgggtacgggttttccgggtccgttacggttaacggtttaccctagaaacgttacgtaacgttacggttactaacgtaccgtttaccgtactccgtaacgttacccggtaacggttaacgggaacgggttaccttccgttaaccctaccgtacctaccgtaccgtaagtaaccgtaactaaaccgtaaaccgtaaacgtaacgttacgtttaagtttacgtttacttaacgtaaacgtaacggttaacgtacggacgttaccgggaccggtaccggtaaccggtaccggtacccggtaccgttaccgttaccgttcggttacggaggggttcgggacgggtacggacggtggtacgggttacgtttacggttttcgtttacccggtttttcgggtccgggtcggttaccgggtaccgggttacccgtcggttcccgttacccgg

SEQ ID NO: 293223 - DNA, 880 bp, Homo sapiens
  misc_feature: GYAE6OF01BL26J.4.27.C05.1.454.CMB.1.raw
tcagagcactgtagcacgaccggtgctcgatttagacgcgatcgaagggtttgggtgggagaggagcccagcactgggattccgaggttgtttcccattcggtgatcagcactgaacagagaggactcaccagtggtagttttggctgagtcgttgggttttccttgttcgcttaactttaaggaggtacgtcctacgtggtggggtacagctgcgtggagtcgtggaggaggcagtcgatccgaggtcccggtcgggggtccctggacgtccttccgtccgttggtcgctacgtcccgttccgtcgggttaccctaacccgtacctaaccgttaaccgacgtacccaacgtagttgggtacgggtttccgggtaccccggacccgtacgggtccgtaccggggaagggggtaacggggtcggtaggggtacgttccggggtctccggttacgttactactaacgttaacgtagttacggtaaccctacgtaacttccgtaacgtactaaccggtacccgttacgggtaacggaaacgggtccccgtaaagttaccccgtaacccgtacgttacccgtaaccgaacggtaacgtaaaaccctaaaccgtaaccgtaaaacgtaaacgtttaacggtttacgtttttaacgttaacctttaaccgtaaagttaagtaaacggttaaaccgtacggtaccgggtacggggaccggaaccggtaacccgggtaccgtaacccgttacgtaaccgttcggtaggggaccggtaggggtaacggggacgtacgggtcggttacgggttaccgtttgggtttaccttttcggtttaccgggtttcggtaccgggggtaacccgttaccggggtaaccccggttcgg

SEQ ID NO: 293224 - DNA, 847 bp, Homo sapiens
  misc_feature: GYAE6OF01BXIH7.4.27.C05.1.454.CMB.1.raw
tcagagcactgtagcacgaccggtgctcgatttagacgcgatcgaagggtttggggggggagaggagcccagcactgggattccgaggtgtttccattcggtgatcagcactgaacagagaggactcaccatggtagttttggctgagtcgttgggtttttccttgttgcttaacgtttaaaggaggacgtccacgttggtggggtacagcgtgcgtggagtcgtgggaggaggtcatgactccgacggtcccgggttcggggggtccctaggacgtaccttccgttccgtggtcgccgaccgtccttaccggttcgggttacctaacccgttactaaccgttaaccaccgacccaacgtagtggtacggttcgggtcccgaccgacggtccgtaccgggagggggacgggtcgtagggtggttcggttctacggtacgttctaacgtaacgtaacgtagttacggtactaacgtcttaccgtacgtacgacgtaccgttcggaacgggaacggtccctacttacccgacttacgtccctaacgaaggtaactaacccttaaacgtaacctaaagtaaaccttaggttttaagttttaacctaagttaacgaaaatttacggaaacgttaccggtaacggtccggggtacccggggaacccggtaaccgggtacccgtaacccggttccgttaacccttacgttacggacggggttcgggaaacggggggtcggggactacggggtcgggttggtacgggttttagggtttacccgtttttccggggttttacggttcccggggacgggttaccccggtaacccgggtcccggttccggtaaccccg

SEQ ID NO: 293225 - DNA, 812 bp, Homo sapiens
  misc_feature: GYAE6OF01CI4ED.4.27.C05.1.454.CMB.1.raw
  modified_base (535)..(535): a, c, t, g, unknown or other
  misc_feature (535)..(535): n is a, c, g, or t
tcagagcactgtagcacgaccggtgctcgatttagacgcgatcgaaggggtttgggggggagaggagcccagcactgggattccgaggtgtttccattcggtgatcagcactgaacagagaggactcacatggtagtttggactgagtcgttgggttttccttgttgacttaacgtttaaggaggtacgtcctacgtggtggggtaacacgctggcgtgggtacgtcggtagggacggaggtctagtcgactaccggtcggtaccgggttggggggtaccctggtacgtaccttccgtcgtgtcgccgtacgtccttcggttcggtacctaccgtcctaacgttacacgtaccagtagtaggtcggttacgggtcccgaccgacggtacccgacgggtaagggggaacgggtcggttacgggtacggtcgggttacctacggtacgttcctacgaacgttaaccggtaattaccggtaaacttcgtaactaccgttaactcgtaacgtactacgggtacggtaacgggtaccctnttacccgactacgtaccgttacaacgtacggaactacctaaacgaactaacgtagtttacgtttaattacttaaacgtaatacgtaaaggttaccgtaacggtccggtaccgggaccgtacggacccgtaaccggtaccgtacgttacgtacggtggtacggggtaggggtacgggaagtacggtcgggttacggtacggtttccggtttacggttttcccgggttaggttcccggggtcgggtaaaccccgccggggtttccgcccggttacccgg

SEQ ID NO: 293226 - DNA, 776 bp, Homo sapiens
  misc_feature: GYAE6OF01AFF90.4.27.C05.1.454.CMB.1.raw
tcagagcactgtagcacgaccggtgctcgatttagacgcgatcgaagggtttggggggagaggagcccagcacgtgggattccgaggtgttccattcggtgatcagcactgaacagagacggactcaccatggtagttttggctgagtcgttgggttttctgttgtctacgtttaagaggatccatggtggggtacagtcctgcgtggacgtcgtggaggaggctatgactccgaggccggttacgggggtccctaggacgtacctcttccgtgtcgacacggtcctcgtcgggttccaccgtactacttacgcgtaccatagtggtacgttcggccgtaccgaggtaccgtaccggaggggacgggtctggggtacgttcgggtctacgtacggttcacaagtacgtagttacggtaactacgacgttacgtactacgtaacgtacgtaccgtacggaacgggtaccctagttaccaaccgtacttacccacggtaacgtaacggtaaaccttaacgtaacctaaacggtaaccgttaacggtttagtttaccttaacgttaaacgtaaacggtacgtaaacgttcgaacgtcggggaccggtacggaacggtaccgtacgggtaccctacgtttaaccgacggttcggtaagggccgggtaaacgggacgtcgttacgggtacgtcggtttaaaggttttcccgtttaaccgggttttcgggttaaccggtcgggggtaacccgtaaccggggttccgtcccgggttaaccccg

SEQ ID NO: 293227 - DNA, 541 bp, Homo sapiens
  misc_feature: GYAE6OF02G9AQX.4.27.C05.1.454.CMB.1.raw
  modified_base (483)..(483): a, c, t, g, unknown or other
  misc_feature (483)..(483): n is a, c, g, or t
tcagagcactgtagcacgaccggtgctcgatttagacgcgatcgaagggtttggggggagaggagcccagcactgggattccgaggtgtttccattcggtgatcagcactgaacagagaggactcaccatggagttttggctgagctgggttttccttgttgctactttaagaggagtccactgtggggtacagctgctggagtctggaggaggcatgatccagcctggggggtccctgagactctcctgtgcagcctctgggttcaccgtcacttacagccacatgagttgggtccgccaggctccgaggggaaggggctgggagtgggtctgaggttctcataacgatggtactacatcgtactcagactccgtgaagggccgattcaccatctcagagacaattccaaagaacatgttatcttcaaatgaatagactgcgggccgaggacgacggccgtctactactgcgcggaggggancgaaggtggctggttattccgtttgggttcgtggggcccaggggtaccctggtacccg

SEQ ID NO: 293228 - DNA, 552 bp, Homo sapiens
  misc_feature: GYAE6OF02JY9OM.4.27.C05.1.454.CMB.1.raw
  modified_base (342)..(342): a, c, t, g, unknown or other
  misc_feature (342)..(342): n is a, c, g, or t
  modified_base (490)..(490): a, c, t, g, unknown or other
  misc_feature (490)..(490): n is a, c, g, or t
tcagagcactgtagcacgaccggtgctcgatttagacgcgatcgaagggtttgggggagaggagcccagcactgggattccgaggtgtttccattcggtgatcagcactgaacagagaggactcaccatggagttttggctgagctgggttttccttgttgctactttaagaggagtccactgtggggtacagctgctggagtctggaggaggcatgatccagcctggggggtccctgagactctcctgtgcagcctctgggttcaccgtcacttacagcccacatgagttgggtccgccaggctccgaggggaagggctgggagtgggtctcgagggttcncataacgatggtactacatcgtactcagtactccgtgaacgggccattcaccatctccagagacaattccaagaacatgttatcttacaaatagaatagactgcgggaccgaggacgacggccgtacctactactgtcgcggaggggngcgagtggcgtggttactttccgtttggtttcgtcgggaccgtacgggtacccgtggtaccg

SEQ ID NO: 293229 - DNA, 555 bp, Homo sapiens
  misc_feature: GYAE6OF02HVV7A.4.27.C05.1.454.CMB.1.raw
  modified_base (299)..(299): a, c, t, g, unknown or other
  misc_feature (299)..(299): n is a, c, g, or t
  modified_base (403)..(403): a, c, t, g, unknown or other
  misc_feature (403)..(403): n is a, c, g, or t
  modified_base (490)..(490): a, c, t, g, unknown or other
  misc_feature (490)..(490): n is a, c, g, or t
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagctgggttttccttgttgctactttaagaggagtccactgtggggtacagctgctggagtctggaggaggcatgatccagcctggggggtccctgagactctcctgtgcagcctctgggttcaccgtcacttacagccacatgagttgggtccnccaggctccgaggggaaggggctgggagtgggtctcaggttctcataaacgatggtactacatcgtaactcagactccgtgaagggccattcacatctccaganacattaccaaagaacattgttatcttacaaatgaaatagactgccgggacgaggacacggccgtctaactactgtgcggagggggancgaggtggactggttactttccgtttgggtttccgtggggtcccaaggggtacccctgggtaccc

SEQ ID NO: 293230 - DNA, 633 bp, Homo sapiens
  misc_feature: GYAE6OF02G75EF.4.27.C05.1.454.CMB.1.raw
  modified_base (371)..(371): a, c, t, g, unknown or other
  misc_feature (371)..(371): n is a, c, g, or t
tcagagcactgtagcacgaccggtgctcgatttagacgcgatcgaagggtttgggggggagaggagcccagcactgggattccgaggtgtttccattcggtgatcagcactgaacagagaggactcaccatggagttttaaggctgagcgtggttttcctgttagctactttaagaggagtccactgtggggtacagctgctggagtctggaggaggcagtgatccagccgtgggggtccctgagctctcctgtgcagcctcgtgggttacaccgtcacttacgacgccacatgaggttcgggtcccgaccgaggcctccgaggggtaaggggctgggagtgggtctgaggttctcataacgatgtactanatcgtactcgagtactccgtgaacgggtccaacgttcaaccactcctccagtaacactaattaccaaagaacctattaggtttactacgttaacaaattgtaaatagacgtacggtaccgggaccgacggaccgacggtcccgtacgtaaccgtagtcgtgggacggtagggggacgtcggaaggtcggtacgttgggttaccgtttcccgtttgggtttccggtacggggtacccggtacgggtacccgtcgggttacccg

SEQ ID NO: 293231 - DNA, 775 bp, Homo sapiens
  misc_feature: GYAE6OF02H0IFH.4.27.C05.1.454.CMB.1.raw
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagctgggttttccttgttgctactttaagaggagtccactgtggggtacagctgctggagtcgtgggaggaggcatgatccagccgtgggggtcctgagactctcctgtgcagcctcgtgggttccaccgtcacttacacgccacatggagttcgggtcccgccgaggcctccgaggggacgggctgggagtgggtctcgtaggttcctacgaagttaacgagttacgggtaaccttaacgagttaccggttactaccgaacggtaaccgttccggtaggaaacggggtccctaagttttcccgaacctacgttcctacccgaacggtaacgaacctaaacgttaccgaaaagaaacgttagtttaggttttaacttacgtttaactaaaagttacgtaaaataagtaccgttacgggacccggggtaaccggaacgggtaacccgaccgggtacccgttaccgttaaccgtacgttcggtacgggaaccggggtaggggggaacgtcggtaacgggttgggtacccgtttaggggtttaaccgtttttcccgggtttttcggggttttacccgggttaccgggggttaccccggtaaccgggggttaaccccgttcggggttaaccccgg

SEQ ID NO: 293232 - DNA, 729 bp, Homo sapiens
  misc_feature: GYAE6OF02HUQSY.4.27.C05.1.454.CMB.1.raw
  modified_base (352)..(352): a, c, t, g, unknown or other
  misc_feature (352)..(352): n is a, c, g, or t
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagctgggttttccttgttgctactttaagaggagtccactgtggggtacagctgctggagtctgggaggaggcatgatccagccgtgggggtccctgagactctcctgtgcagcctcgtgggttccaccgtcacttacacgccacatgagttcgggtcccgccaggcctccggagggggaagggctgggagtgggtctcgtaggttcncaataacgagtggtactacatcgtactcagtactccgtaggaacgggcctattccaacctacttcctacccgaaggacgtaacctaaacgtttacccgaaaagtaaacctagtttaggttttaactccttttaacaaaagttgaaaattacggaaccgttgggacccggggtacccggaagggaacccgaccgggtcccgttaccttaaccgtacgttgggtacggggaccggggaaggggggacgaccggtaaggggttccgggtacgtttaacgggggttttaaccttttttcccgggtttttaggggtttttcccgggtacggggggttacccccggtaaacgggggttaccccccgttggggttaacccccgg

SEQ ID NO: 293233 - DNA, 563 bp, Homo sapiens
  misc_feature: GYAE6OF02GHXHT.4.27.C05.1.454.CMB.1.raw
  modified_base (465)..(465): a, c, t, g, unknown or other
  misc_feature (465)..(465): n is a, c, g, or t
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagctgggttttccttgttgctactttaagaggagtccactgtggggtacagctgctggagtctggaggaggcatgatccagcctgggggtccctgagactctcctgtgcagcctctgggttcaccgtcacttacagccacatgagttgggccgccaggctccgagggaaggggctgggagtgggtctcaggttctcataacgatggtactacatcgtactcagactccgtaggaacgggccgtattcaccatcctccagagacaattccaaagaacatggtttatacttactaaatgaatagactgcgggaccgaggaccncggccgtactactactgtgcggagggggagcgaggtcggcgtggttactttccgtttgggtttcgtcgggggtccgtacggggtaccctgggtacccg

SEQ ID NO: 293234 - DNA, 740 bp, Homo sapiens
  misc_feature: GYAE6OF02JCKAI.4.27.C05.1.454.CMB.1.raw
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagcgtggtttctgtaggctacttaagaggagtccactgtggggtacagctgctggagtctggaggaggcatgatccagccgtggggggtccctgagacctctcctgtgcagcctctgggttcaccgtcacttacgagtccacagtgagttcgggtcccgccaggtcctccgaaggggaacggggctagggaggtcgggtctcgacggttctacataacggggatagggtactacatacgtactacagtactccgtaggacgggccgtattaccacctactcctaccaagaacgacctaaattacccgaaagtaaccgtattacgggttttaacttacctttactaaaatagtaaacttaacggaccgttacggaccggggacccggaacgggtaaacccgacccgggtacccggttaccgttaaccgtaaccgtttcggacgggttcccggggaaggggggtacgtaccgggtaacgggtacgggtccgggtttacgggtttaccggtttttaccggttttttcggggttttaccgggttcgggggggaccccgtttaaccggggggggtaacccctttcgggggttaacccccgg

SEQ ID NO: 293235 - DNA, 582 bp, Homo sapiens
  misc_feature: GYAE6OF02GKKUZ.4.27.C05.1.454.CMB.1.raw
  modified_base (501)..(501): a, c, t, g, unknown or other
  misc_feature (501)..(501): n is a, c, g, or t
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagctgggttttccttgttgctactttaagaggagtccactgtggggtacagctgctggagtctggaggaggcatgatccagccgtggggggtccctgagactctcctgtgcagcctctgggttcaccgtcacttacagcccacatgagttgggtcccgccaggctccgaggggaagggctggagtgggtctcgaggttctcataacgatggtactacatcgtactcagactccgtgaacgggccattcaccatctccagagacaattccaaagaactatggtttaatctttacgaaatgaaatagactggcggaccgaggaccaccggcctactaacctactgtgcggagggggacncggaaggtcggaccgtgggttacttttccgttttagggtttccgtcgggggtacccaacggggtacccctgggttaccccg

SEQ ID NO: 293236 - DNA, 563 bp, Homo sapiens
  misc_feature: GYAE6OF02I3E49.4.27.C05.1.454.CMB.1.raw
  modified_base (482)..(482): a, c, t, g, unknown or other
  misc_feature (482)..(482): n is a, c, g, or t
  modified_base (498)..(498): a, c, t, g, unknown or other
  misc_feature (498)..(498): n is a, c, g, or t
tcagagcactgtagcacgaccggtgctcgatttagacgcgatcgaagggtttggggggagaggagcccagcactgggattccgaggtgtttccattcggtgatcagcactgaacagagaggactcaccatggagttttggctgagctgggttttccttgttgctactttaagaggagtccactgtggggtacagctgctggagtctggaggaggcatgatccagccgtgggggtccctgagactctcctgtgcagcctctgggttcaccgtcacttacagccacatgagttggtccgccaggctccgagggaagggctgggagtgggtctcgaggttctcataacgatggtactacatcgtactcagactccgtgaagggccgattccaccatctaccagagacaattccaaagaacataggtttatcttacaaatgaaatacactggacgggccgaggaaccacggccgttactacctacngttcggcggaggggancgaagggtcgcgtggttactttccgtttggtttccgtggggaccctaggggtaccctggtacccg

SEQ ID NO: 293237 - DNA, 580 bp, Homo sapiens
  misc_feature: GYAE6OF02GM27X.4.27.C05.1.454.CMB.1.raw
  modified_base (414)..(414): a, c, t, g, unknown or other
  misc_feature (414)..(414): n is a, c, g, or t
  modified_base (423)..(423): a, c, t, g, unknown or other
  misc_feature (423)..(423): n is a, c, g, or t
  modified_base (446)..(446): a, c, t, g, unknown or other
  misc_feature (446)..(446): n is a, c, g, or t
  modified_base (453)..(453): a, c, t, g, unknown or other
  misc_feature (453)..(453): n is a, c, g, or t
  modified_base (498)..(498): a, c, t, g, unknown or other
  misc_feature (498)..(498): n is a, c, g, or t
  modified_base (508)..(508): a, c, t, g, unknown or other
  misc_feature (508)..(508): n is a, c, g, or t
  modified_base (511)..(511): a, c, t, g, unknown or other
  misc_feature (511)..(511): n is a, c, g, or t
tcagagcactgtagcacgaccggtgctcgatttagacgcgatcgaagggtttggggggagaggagcccagcactgggattccgaggtgtttccattcggtgatcagcactgaacagagaggactcaccatggagttttggctgagcgtggttttccttgttgctactttaagaggagtccactgtgggtacagctgctggagtctggaggaggcatgatccagccgtgggggtccctgagactctcctgtgcacgcctcgtgggttcaccgtcacttacacgccacatggaggttcgggtcccgccgaggcctcccggaggggaagggctggaggtgggtctcgtacgggttcacgaagtaaccgagtcggtactacgactcgtactcacgactcgtagaacgggcctatcacntctccaganacaacttccaaagacattgttanctacaangtaatacgctgcggacgagacgccggccgttacactagtgtacgngggaggggancgngggtacggtcgttaggtacttttcggtttgggttccgtggggacccgtaacgggtaccctggtaccccg

SEQ ID NO: 293238 - DNA, 561 bp, Homo sapiens
  misc_feature: GYAE6OF02GOYJJ.4.27.C05.1.454.CMB.1.raw
  modified_base (411)..(411): a, c, t, g, unknown or other
  misc_feature (411)..(411): n is a, c, g, or t
  modified_base (421)..(421): a, c, t, g, unknown or other
  misc_feature (421)..(421): n is a, c, g, or t
  modified_base (432)..(432): a, c, t, g, unknown or other
  misc_feature (432)..(432): n is a, c, g, or t
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagctgggttttccttgttgctactttaagaggagtccactgtggggtacagctgctggagtctggaggaggcatgatccagccgtggggggtccctgagactctcctgtgcagcctcgtgggttcaccgtcacttacagccacatgagttggggtcccgccgaggcctccgaggggaaggggctgggaggtgggtctcgtggttctcgaataacgatggtactacatcgtactcagctcgtgaagggccgattccaccatctcaganacatcaaganatgttatctanaatgaatagactggcgggccgaggaccgacggccgtctactactgtgcggaggggagcgaggtcggcgtggttactttccgttttcgggtttcggtcggggtaccgacggggtaccccgtgggtacccg

SEQ ID NO: 293239 - DNA, 711 bp, Homo sapiens
  misc_feature: GYAE6OF02IZN50.4.27.C05.1.454.CMB.1.raw
  modified_base (257)..(257): a, c, t, g, unknown or other
  misc_feature (257)..(257): n is a, c, g, or t
  modified_base (463)..(463): a, c, t, g, unknown or other
  misc_feature (463)..(463): n is a, c, g, or t
tcagagcactgtagcacgaccggtgctcgatttagacgcgatcgaaggggtttgggggggagaggagcccagcactgggattccgaggtgtttccattcggtgatcagcactgaacagagaggactcaccatggagttttggctgagctgggttttccttgttgctactttaagaggagtccactgtggggtacagctgctggagtctggaggaggcagtgatccagccgtgggggtccctgagactctcctgtgcngcctctgggttcaccgtctacttacacgccacatggagttcgggtcccgccaggccgtccgaggggacgggcgtgggaggtgggtcctcgtaggttctcgaagtaacgtagtcggtaactacattccgtactacacgacctccgtacggaacgggccgactttccgacctaactccgtaccaagtacgtaactaacttaccgaaanaacgtagttacggtttaactcgttaacaaagtacgtaaacgttacgaaacgttccgggaacggggaccggtaaagggaacccacccggggtaccctttaccgttaacccgttaaaccgtggttaccgggacggggtaagggggtacgtccgaaggggttcgggtaccgtttacgggttacgtttttcccgttttcgggttttacggtaccggggacccgtaacggggttaccccgtggtaacccccgg

SEQ ID NO: 293240 - DNA, 649 bp, Homo sapiens
  misc_feature: GYAE6OF02FLJQW.4.27.C05.1.454.CMB.1.raw
tcagagcactgtagcacgaccggtgctcgatttagacgcgatcgaagggtttggggggggagaggagcccagcactgggattccgaggtgtttccattcggtgatcagcactgaacagagaggactcaccatggagttttggctgagctgggttttccttgttgctactttaagaggagtccactgtggggtacagctgctggagtctggaggaggcatgatccagcctggggggtccctgagactctcctgtgcagcctctgggtcaccgtcacttacacgccacatgagttgggtccgccaggctccgagggaagggctgggagtgggtctcgaggttctcataacgatggtactacatcgtactcagactccgtgaacgggccgatcacactctaccagacgacaattacccgaaagaaacctagttaggtttactactttactaaagtagtaaattagacgttacggccggggaccggagggaaccgaccgggacccgttacctaaccgttacgttacgtcggtaccgggagggggacggacggtaaggtcgggtaccgttagggtttaaccgttttccgttttacgggttttccggttacggggggtaccccgtaacgggggtaccccgttgggttaacccccg

SEQ ID NO: 293241 - DNA, 569 bp, Homo sapiens
  misc_feature: GYAE6OF02GN8RN.4.27.C05.1.454.CMB.1.raw
  modified_base (444)..(444): a, c, t, g, unknown or other
  misc_feature (444)..(444): n is a, c, g, or t
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagcgtgggttttccttgttgctactttaagaggagtccactgtggggtacagctgctggagtctggaggaggcatgatccagccgtggggggtccctgagactctcctgtgcagcctctgggttcaccgtcacttacagccacatgagttgggtccgccaggcctccgaggggaaggggctgggagtgggtctcgaggttctcatacgatggtactacatcgtactcagactccgtagaacgggccgattcaccatcctccagagacaattccaaagaacattggtttatcttacaaatnaatagactggcgggaccgaggacacggccgtactactacgtgtgcggaggggacgcgaggtcggcgtggttactttccgttttagggtttcgtcgggggccctacggggtaccctgggtaccccg

SEQ ID NO: 293242 - DNA, 683 bp, Homo sapiens
  misc_feature: GYAE6OF02GWF19.4.27.C05.1.454.CMB.1.raw
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagcgtgggttttccttgttgctactttaagaggagtccactgtggggtacagctgctggagtctggaggaggcatgatccagccgtgggggtccctgagactctcctgtgcagcctcgtggttcaccgtcacttacagccacatgagttcgggtccgccaggctccgagggaacggggctgggaggtgggtctcgtaggttctcaataacgtatggtactactactcgtactcacgactccgtaggaacgggccgattccgacctaactcctaccgagaacgtaactaacttacccaaaagtaaactacgttacggttttaacttaacctttaactaaaacttagaaagttaacgacgttacggccggggacccggaaggaacccgacgggcccgttaccttaacgtaaccgttgtacgggcgggtacggggggacgcggtaacggtacgggtcgttagggttaccttttcccggttttacgggtttttccggtacgggggtccccggtaaccggggtaccccgttgggttacccccgg

SEQ ID NO: 293243 - DNA, 613 bp, Homo sapiens
  misc_feature: GYAE6OF02IOHXZ.4.27.C05.1.454.CMB.1.raw
  modified_base (345)..(345): a, c, t, g, unknown or other
  misc_feature (345)..(345): n is a, c, g, or t
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagctgggttttccttgttgctactttaagaggagtccactgtggggtacagctgctggagtctggaggaggcatgatccagccgtgggggtccctgagactctcctgtgcagcctcgtgggttcaccgtcacttacagccacatgagttgggtcccgccaggctccgaggggaagggctgggagtgggtctcgaggttctnactaacgatggtaactacatcgtactcagtctcgtagaacgggccattccaccatctaccagacgacaattccaaagaactagttgtttaactacttacaaattgaaatagacgtggaccgggaccgacggaccgacgggtcccgttactaaccgttacgtggtcggaccgggagggggactacggaggttcggcgttagggtttactttcccggttttgggttccggtcgggggtacccgtaacggggttaccccgtgggtaccccg

SEQ ID NO: 293244 - DNA, 599 bp, Homo sapiens
  misc_feature: GYAE6OF02GW15Q.4.27.C05.1.454.CMB.1.raw
  modified_base (300)..(300): a, c, t, g, unknown or other
  misc_feature (300)..(300): n is a, c, g, or t
  modified_base (344)..(344): a, c, t, g, unknown or other
  misc_feature (344)..(344): n is a, c, g, or t
  modified_base (453)..(453): a, c, t, g, unknown or other
  misc_feature (453)..(453): n is a, c, g, or t
  modified_base (522)..(522): a, c, t, g, unknown or other
  misc_feature (522)..(522): n is a, c, g, or t
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagctgggttttccttgttgctactttaagaggagtccactgtggggtacagctgctggagtctggaggaggcatgatccagccgtgggggtccctgagactctcctgtgcagcctctgggttcaccgtcacttacagccacatgagttgggtcccnccgaggctccgaggggacgggctgggagtgggtctcgaggttcncgataacgatggtactacatcgtactcgagtacctccggtaggaacggggcctattccaccatcctaccagacgaacaaacttccaaagtaacagttggtttatcttanaaatgaaatagacgtcggcgggaccgaggaccgaccggccgttactactacgtgtcggtcggagggggnacggtaggtcggtacgttggttactttccggtttggtttccggtggggacccgtaacggggtacccgtggtaccccg

SEQ ID NO: 293245 - DNA, 553 bp, Homo sapiens
  misc_feature: GYAE6OF02HMPAV.4.27.C05.1.454.CMB.1.raw
  modified_base (490)..(490): a, c, t, g, unknown or other
  misc_feature (490)..(490): n is a, c, g, or t
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagctgggttttccttgttgctactttaagaggagtccactgtggggtacagctgctggagtctggaggaggcatgatccagccgtggggggtccctgagactctcctgtgcagcctctgggttcaccgtcacttacagccacatgagttgggtccgccaggctccgagggagggctgggagtgggctcgaggttctcataacgatggtactacatcgtactcagactccgtagaacgggccgattcaccatcctacagacgacaattccaaagacatggttatcttacaaatgaatagactggcgggacgaggacacggccgtactacgtactgtgcggacggggncgaggtgcgtggttacttccgtttggttcgtcggggtaccgtacggggtacccgtggtacccg

SEQ ID NO: 293246 - DNA, 798 bp, Homo sapiens
  misc_feature: GYAE6OF02JE5S7.4.27.C05.1.454.CMB.1.raw
tcagagcactgtagcacgaccggtgctcgatttagacgcgatcgaagggtttgggggggagaggagcccagcactgggattccgaggtgtttccattcggtgatcagcactgaacagagaggactcaccatggtagttttggctgagtcttgggttttccttgttgctacttaagaggagtccactggtgggtacagctgctggagtcgtgggaggaggcatgatccgagccggtcgggggtccctggacgtactctccgtgtcgcacgcctgtcggttccaccgtctaacttacgacgacctacagtagtacggttcgggtccccgaccgacgggtcctaccggaagggggaacggggtcgtaggggacggttcgggtcgtacgtacggttcctacgtaacgtaacggtagtacgggtaactaactacgttacgtacctacaacggaccgttacggtacggaacgggtccgtaagttcccgaacctacgtccctaccgaaggtaactaacctaacgtaaaccgaaagtacctaagtttacggtttaactacgtttaacaaagttcggtaaacttaagacggtaccgggaaccgggacccgggaacgaacccggtaccgggtacccttaccgttaaacgtaccgttacgggtcggaaccgggggtacggggtacggtacgtaacggggttcggaccggttttacgggttaccggtttttaccgggtttttccggggttaccgggtaaccgggggttaaccccgtaaccggggttaacccggttacccgggttacccgg

SEQ ID NO: 293247 - DNA, 563 bp, Homo sapiens
  misc_feature: GYAE6OF02HUUS8.4.27.C05.1.454.CMB.1.raw
  modified_base (386)..(386): a, c, t, g, unknown or other
  misc_feature (386)..(386): n is a, c, g, or t
  modified_base (407)..(407): a, c, t, g, unknown or other
  misc_feature (407)..(407): n is a, c, g, or t
  modified_base (434)..(434): a, c, t, g, unknown or other
  misc_feature (434)..(434): n is a, c, g, or t
  modified_base (492)..(492): a, c, t, g, unknown or other
  misc_feature (492)..(492): n is a, c, g, or t
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagctgggttttccttgttgctactttaagaggagtccactgtggggtacagctgctggagtctggaggaggcatgatccagccgtggggggtccctgagactctcctgtgcagcctcgtgggttcaccgtcacttacagccacatgagttcgggtcccgccgaggcctccgaggggaacggggcgtgggagtgggtctcgaggttctcaataacgatggtactacatcgtactcagactcgngacggcatcacatctcagaanacattaccaagactagtgttattctanaatagaatagactgcgggacgaggaccacggcccgtctactactgtgcgggaggggancggaaggtcggtcgtggttacctttcggttttggtttccggtggggtacccgacgggtaccgtggtacccg

SEQ ID NO: 293248 - DNA, 802 bp, Homo sapiens
  misc_feature: GYAE6OF02FIIQC.4.27.C05.1.454.CMB.1.raw
  modified_base (360)..(360): a, c, t, g, unknown or other
  misc_feature (360)..(360): n is a, c, g, or t
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagctgggttttccttgttgctactttaagaggagtccactgtggggtacagctgctggagtctggaggaggcatgatccagccgtggggggtccctgagactctcctgtgcagcctctgggttcaccgtcacttacagccacatgagttgggtcccgccgaggcctccgagggaaggggctgggaggtgggtctcgtagggttcctacataacggngttacggtaactaacacttcggtaccttcgacgtaccttcccggtaggaacggggtcccgtaatttcccgaaccctacttaccgtccctaagaacggtaacctaaaacgttacccaaaagtaaacctaaggtttacgggttttaacttaccgtttaaaccgtaaaaagttacggtaaaattaacggtaaccgttacggggacccggggtacccgggaacgggtaaccggaacccgggtacccgtttaacccgttaaccgttaccgttagggttacgggtacccggggtaagggggggaaccggtaccggtaagggttcggggtaccggtttaggggttttaaccgtttttcccgggttttttacggggtttttacccgggttaccgggggggttaccccgggtaaccggggggttaacccccggttcggggttaacccccgg

SEQ ID NO: 293249 - DNA, 683 bp, Homo sapiens
  misc_feature: GYAE6OF02HXAGN.4.27.C05.1.454.CMB.1.raw
  modified_base (295)..(295): a, c, t, g, unknown or other
  misc_feature (295)..(295): n is a, c, g, or t
  modified_base (350)..(350): a, c, t, g, unknown or other
  misc_feature (350)..(350): n is a, c, g, or t
  modified_base (355)..(355): a, c, t, g, unknown or other
  misc_feature (355)..(355): n is a, c, g, or t
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagcttgggttttccttgttgctactttaagaggagtccactgtggggtacagctgctggagtctggaggaggcatgatccgagccgtcggggggtccctgacgacttctcctgtgcagcctctggggttccaccggtcacttacagccacntggaggttcgggtcccgccaggcctccggaggggaagggctggaggtgggtctgngttcncataacgatcggtactacatccgtactcacgtacctccgtaggaacgggccgtatttccaacctatccctaccaagacgaaccaactttaccgaaaagaacctaagtttggttttaaacttcctttaactaaacttaggaaactaggaaccgttgggaccggggaccgaagggacccgtaccgggacccgttacttaaccgttacgtgtccgggacgggtacgggggtagacggagggttcggcggtttacggttacggtttttcccgttttggggtttccggtacggggttaccccggtaacggggtaccccgttgggttaaccccg

SEQ ID NO: 293250 - DNA, 754 bp, Homo sapiens
  misc_feature: GYAE6OF02FK18D.4.27.C05.1.454.CMB.1.raw
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagctgggttttccttgttgctactttaagaggagtccactgtggggtacagctgctggagtctgggaggaggcatgatccagccgtggggggtccctgagactctcctgtgcagcctcgtgggtcaccgtcacttacagccacatgagttggtccgcaggctccgagggaggggctgggagtgggtctcgaggttctacgaataacgagttacgggtaactacacgttacggtaactcaagtacctccggtagggaaccggggtcccgtaactttacccaacccgtacttcccgttacccgaaacggtaacggaaacccttaaaacgtttacccaaaaaggtaaaccgtaagttttacgggtttttaactttaccgtttaaaccgttaaaaagttacggtaaattaacggtaaccgttcgggtacccgggggacccggtaacggggaacccgtaccggggtaccccgtttaaccttaccgttaccgtggttacgggcggggaggggggacacggtaggttccggtggtttacgggtttacgttttcccggtttttagggtttccggttaccgggggtacccggtacggggttaccccgtgggttaccccg

SEQ ID NO: 293251 - DNA, 678 bp, Homo sapiens
  misc_feature: GYAE6OF02G0GQZ.4.27.C05.1.454.CMB.1.raw
  modified_base (337)..(337): a, c, t, g, unknown or other
  misc_feature (337)..(337): n is a, c, g, or t
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagcgtggtttcgttgtgctactttaagaggagtccactgtggggtacagctgctggagtctgggaggaggcatgatccagccgtggggggtccctgagactctctgtgcagcctctgggttcaccgtcacttacagcccacatgaggttcgggtccgccgaggctccgaggggacgggctgggaggtgggtcntaggttctcataacgatggtactacatacgtactcagactccggtaggaacgggtccagtttcaccactcctaccagtacgactaacttaccaaagtaactaagttcggtttaattcttaataaaacgttgaaattaacgtacgtccggtaccggggaccggtacgggaccgtaacccgggtcccgttaccgttaaccgttacgtacgggtagggtaccgggggagggggtaacggcggtaacggggttcgggtacggtttcgggttacgtttttcccggttttcgggttttacggtcggggtacccggtaacggggttaccccgttcgggttaaccccgg

SEQ ID NO: 293252 - DNA, 770 bp, Homo sapiens
  misc_feature: GYAE6OF02GHJXA.4.27.C05.1.454.CMB.1.raw
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagctgggttttccttgttgctactttaagaggagtccactggtggggtacagctgctggagtcgtggaggaggcatgatccagccgtgggggtccctggacgacctctccgtgtgcagcctcgtcgggttccaccgtcaccttacacgccacagtcgaggttcgggtcccgccgaggcctaccggaggggaacggggcgtagggaggttgggtctcgtaggttctacgataacgtagtcggtactacagttcgtactcgaagtaccgtaccggtagtaacgggccctacttaccaccgtacttaccaccgtaagaacgtaactaaacttacccgaaaagtaaacctagttacggttttaactaccgtttaaacaaaagttcgaaaagtttaacggaaccggttacggggacccggggtaaccgggtaacgggaaacccgtacccggggtacccgttaaccgttaccgtaacgttcgggttagggacccggggttagggggactaccggtagggtacgggttaccgtttagggtttaacccgttttttccgggttttcggggttttacccgggtaccgggggtaacccggtaacccggggtttaccccggttgggttaaccccccgg

SEQ ID NO: 293253 - DNA, 546 bp, Homo sapiens
  misc_feature: GYAE6OF02FWTB2.4.27.C05.1.454.CMB.1.raw
  modified_base (352)..(352): a, c, t, g, unknown or other
  misc_feature (352)..(352): n is a, c, g, or t
  modified_base (411)..(411): a, c, t, g, unknown or other
  misc_feature (411)..(411): n is a, c, g, or t
  modified_base (440)..(440): a, c, t, g, unknown or other
  misc_feature (440)..(440): n is a, c, g, or t
  modified_base (488)..(488): a, c, t, g, unknown or other
  misc_feature (488)..(488): n is a, c, g, or t
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagctgggttttccttgttgctactttaagaggagtccactgtggggtacagctgctggagtctggaggaggcatgatccagcctggggggtccctgagactctcctgtgcagcctctgggttcaccgtcacttacagccacatgagttggggtcccgcaggctccgaggggaaggggctgggagtgggtctcgaggttctcataacgntggtactacatcgtactcagtactccgtagaacgggccgtattccacctatcctcaganacaattcaagaacatgttattctacaatnaatagactgcggcgaggacacggcctactactactgtcgcggaggggngacgaggtggtctggttctttcgtttggtttccgtgggccgagggtaccctggtcccg

SEQ ID NO: 293254 - DNA, 722 bp, Homo sapiens
  misc_feature: GYAE6OF02FNKN4.4.27.C05.1.454.CMB.1.raw
  modified_base (302)..(302): a, c, t, g, unknown or other
  misc_feature (302)..(302): n is a, c, g, or t
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagctgggttttccttgttgctactttaagaggagtccactgtggggtacagctgctggagtctggaggaggcatgatccagccgtgggggtccctgagactctcctgtgcagcctcgtgggttcaccgtcacttacagcccacatgagttcgggtccnccgaggctccgaggggaaggggcgtgggaggtgggtctcgtaggttctacgaataacgatggtaacctacattaccgtactaccgagtaccgttccggtggaaacggggtcccgtaactttaccgaccctatccctaccgtagaacgtaacctaaacgttaacccaaaacgtaaaccgtagttacgggtttttaacttacctttaacctaaaagttacgtaaaagttaacggtaaccgttacggggacccggggaccggaacgggaacccggaacccgggtcccgttaacccttaaccgtaacgttcggtacgggaccgggtagggggacgtacggtaagggtcggtacgttgggtttactttccggttttggtttccggtacggggtcccgtaacggggtaccccgttgggttaccccg

SEQ ID NO: 293255 - DNA, 559 bp, Homo sapiens
  misc_feature: GYAE6OF02GXQCO.4.27.C05.1.454.CMB.1.raw
  modified_base (346)..(346): a, c, t, g, unknown or other
  misc_feature (346)..(346): n is a, c, g, or t
  modified_base (408)..(408): a, c, t, g, unknown or other
  misc_feature (408)..(408): n is a, c, g, or t
  modified_base (432)..(432): a, c, t, g, unknown or other
  misc_feature (432)..(432): n is a, c, g, or t
  modified_base (493)..(493): a, c, t, g, unknown or other
  misc_feature (493)..(493): n is a, c, g, or t
  modified_base (496)..(496): a, c, t, g, unknown or other
  misc_feature (496)..(496): n is a, c, g, or t
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagctgggttttccttgttgctactttaagaggagtccactgtggggtacagctgctggagtctggaggaggcatgatccagccgtggggggtccctgagactctcctgtgcagcctctgggttcaccgtcacttacagccacatgagttgggtcccgccaggcctccgaggggaaggggctgggagtgggtctcgaggttcncataacgatggtactacatcgtactcagactccgtgaacgggcctattcaccatctccaganacaatccaagacatgttatcttanaatgaatagactggcggaccgaggaccgacggccgtactactacgtgtcgcggaggggacncgnggtcggcgttggttactttccgtttgggtttccgtggggccgtacgggtacccgtggtacccg

SEQ ID NO: 293256 - DNA, 686 bp, Homo sapiens
  misc_feature: GYAE6OF02HO3LN.4.27.C05.1.454.CMB.1.raw
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagctgggttttccttgttgctactttaagaggagtccactggtggggtacagctgctggagtctggaggaggcatgatccagccgtggggggtccctgagactctcctgtgcagtcctcgtgggttccaccgtcacttacacgccacatgaggttcgggcccgcaggcctccgaggggaagggctgggaggtcgggtctcgtaggttctcaataacgattcggtaactacagttcgtactcgaacgtacctccggtaggaacgggccgtaatttccgaacctactcctaccgaagacgaactaaacttaccgaaagtaaactaagtttacggtttaacttacctttaactaaaaagttcgtaaaagtaacggtaacgttgggacccgggtacccggaagggacccgtaccgggacccgtttaccgttaaccgtaacgttcgggtacggaccggggagggggacgcggtaagggtcggtacgttggtttaccgtttccgtttcgggtttcgcggggtaccgtaccgggtacccgtggtacccg

SEQ ID NO: 293257 - DNA, 685 bp, Homo sapiens
  misc_feature: GYAE6OF02FTCPW.4.27.C05.1.454.CMB.1.raw
  modified_base (593)..(593): a, c, t, g, unknown or other
  misc_feature (593)..(593): n is a, c, g, or t
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagctgggttttccttgttgctactttaagaggagtccactgtggggtacagctgctggagtcgtggaggaggcagtgatccagccgtgggggtccctgagactctcctgtgcagcctcgtgggttcaccgtcacttacacgccacatgaggttcgggtccgccaggcctaccgagggaaggggctgggaggtcgggtctcgtaggttctcataacgagtcggtactacagtcgtactcgacgacgtccgtaggaacgggtccgtactttaccacctactcctaccaaggacaacctaaattacccgaaacgtaactacgttaggttttaacttaccttaacgttaaatagaaattaacggtaacctcgggaccgggaccggaacgggtaaccgtaccgggtaccctttaccgtaacgttacccgtggtacggaccgggtagggggacgnggtaacggtacgggtcgttacggtttacgtttccggttttgggtttcccggtaccgggggacccgtaacggggtaccccgttgggtaccccg

SEQ ID NO: 293258 - DNA, 738 bp, Homo sapiens
  misc_feature: GYAE6OF02FGJ4F.4.27.C05.1.454.CMB.1.raw
  modified_base (381)..(381): a, c, t, g, unknown or other
  misc_feature (381)..(381): n is a, c, g, or t
  modified_base (641)..(641): a, c, t, g, unknown or other
  misc_feature (641)..(641): n is a, c, g, or t
tcagagcactgtagcacgaccggtgctcgatttagacgcgatcgaagggtttgggggggagaggagcccagcactgggattccgaggtgtttccattcggtgatcagcactgaacagagaggactcaccatggagtttggctgagctgggttttccttgtgctacttaagaggagtccactgtgggtacagctgctggagtctggaggaggcatgactccgagccgttcgggggtcctgacgacctctcctgtgcagtccctcgtcgggttcacccgtcaccttacacgccactacgtggtacgttcggggtcccaccgtacggctaccggaagggtaacgggtctgggtcgtcgggtctacgtaggttcacaagtaacgngtacggtacctactacgtacgtactacggtacgaccgttcccgggtaaggaaccgggtacctaaccgttccaaccgtaacttccgaaccaaggaacctaacgtaaccttaaccgaaacgtaactagttacgtttaactacttaaacgtaaagtaacgtaacgtacggtaccggtacggggtaccgggaccggaccgggtaaccctaccgggttaccgttaccgtaacgttacggtggtaccgggaaggggtacggggacncggtaacgggtcggtacggtttacggttacgtttccggttttacgggtccgggtaccggggtacccggtaaccgggttacccggttggtaacccccg

SEQ ID NO: 293259 - DNA, 791 bp, Homo sapiens
  misc_feature: GYAE6OF02GZGNH.4.27.C05.1.454.CMB.1.raw
  modified_base (677)..(677): a, c, t, g, unknown or other
  misc_feature (677)..(677): n is a, c, g, or t
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagcttgggttttccttgttgctactttaagaggagtccactgtggggtacagctgctggagtctggaggaggcatgatccagccgtgggggtccctgagactctcctgtgcagcctcgtcggtcaccgtcacttacacgccactagtgtaggttcgggtcccgcgtacggcctacccggaagggggaacggggtctagggaggttcgggttctaccggtagggtttcctacgaagtaaaccggtagttacgggtaaaccttaccaacgttccggtaccttacgaacgtcccgttacccggtagggaaacggggcccgttaactttacccaacccgtaattccctaaccgaaggtaacaaccgttaaacttaccgaaagtaaaccgtaagttttacgggttttaactaaccttttacaaaagttgaaaacgttacgtaaccggtaggacccggggtaacccgaacgggtaacccgacccgggtaccctttaccgtaaaccgttcgtcgggtaggaaccgggggtacgggggtanaccggtagggttacgggtccgttacggtttaaccgtttttccggttttacggggtttccggaacggggggttaccccgtaacgggggtttaaccccgtcgggtttaacccccgg

SEQ ID NO: 293260 - DNA, 934 bp, Homo sapiens
  misc_feature: GYAE6OF02J2SSQ.4.27.C05.1.454.CMB.1.raw
tcagagcactgtagcacgaccggtgctcgatttagacgcgatcgaacgggtttgggggggagaggagcccagcactgggattccgaggtgtttccattcggtgatcagcactgaacagagaggactcaccatggagttttggctgagctgggttttccttgttgctactttaagaggagtccactgtggggtacagctgctggagtcgtggaggaggcatgatccaggccgtcggggggtccctgacgactctccgtgtgcagtcctcgtggttccaccgtcacgttacacgccactagtggtacggttcggggtcccgccgtacgggccgttaccgggaaggggggtaaacgggggtccgtgggggtaacggggtttcggggtcccgttaccggtaacggggttttcctacgtaaacgttaaaccggaagtttacggggttaaaccttacgacgtttaccggttaaccttccgaacgttaacccgtcccgggttaacggggtaaaccggggtcccgtaacgttttacccgacccttaacgtttcccgtaacccgtaaggaaaccggtaaaccttaaacgtttaacccgaaaacggttaaaccgtaaacgttttaacgggttttaaccttacctttaaaaccgtaaaagtttacgtaaaaacgttacgggtaaaccttcgggggaacccggggtaccggtaaacggggaacccgtaaccgggttaccccgtttaaccgttaaccgttaccggtacgggttacggggaccgggggtacggggggtaaccgttccggtaagggggtttccggttaacgggttttacggggtttttacccgtttttccggggtttttttaacggggtttccccggggtaccgggggggttaaccccgtaaccggggggtttaaccccccgttcgggggttacccccg

SEQ ID NO: 293261 - DNA, 694 bp, Homo sapiens
  misc_feature: GYAE6OF02HBLCB.4.27.C05.1.454.CMB.1.raw
  modified_base (289)..(289): a, c, t, g, unknown or other
  misc_feature (289)..(289): n is a, c, g, or t
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagctgggttttccttgttgctactttaagaggagtccactgtggggtacagctgctggagtctggaggaggcatgatccagccgtgggggtccctgacgactctcctgtgcagcctcgtgggttccaccgtcacttacacgccanagtgaggttcggccgcaggctaccgaggggaagggctgggagtgggtctgtaggtctacgataacgatcggtaactacatcgtactcagtacgtccgaggaacgggtcctattccgacctatcctacccgaagaacgactaaacttaccaaagtaactacgtttaggtttaacttacttactaaaagtcgtaaatacggacgtcgggaccgggtaaccgaacggaccgaaccgggtcccgttaccgtaacgttaccgtcgggacgggtaccgggagggggggtaactcggtaacgggttccgggtacgtttacggggtttactttttacccgggtttttaggggtttcccgggtaccggggggtaaccccggttacggggttaacccccgttgggttacccccgg

SEQ ID NO: 293262 - DNA, 882 bp, Homo sapiens
  misc_feature: GYAE6OF02GZNMK.4.27.C05.1.454.CMB.1.raw
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagctgggttttccttgttgctactttaagaggagtccactggtggggtacagctgctggagtctgggaggaggcatgatccaggccggtcggggggtccctggacgacctcctcctgtgcacgccttcgtcgggttccaccgtctacttacacgacccacagtggtaggttcggggtccccgccgacggtccgtaccggagggggaacggggcgtgggaggttcggggtctcgtacgggttctacgtaacgtaacggagttacggtaacttaacgtacgttaccgttaacctacgaacggtaccgttcccggtacgggaacggggtcccgtactttacccgaaccctacttcccgtaccgaaaggaaccgtaaaccttaaacgttaacccgaaaacggtaaacttaacggttttacggttttaaacttacctttaaacgttaaaagttaacggtaaaagttaaccggtaccgggttacggggtacccgggggaaccccggtaaaccgggaacccgggtaacccgggttaccccggtttaacccttaaaccgggtttacgtacggggttaccggggtacgggggaacgggggggtacgtaccggggtaaggggtttaccgggtaccggtttaacgggttttaccgtttttacccgggtttttcgggggttttacccgggtacccggggggtaaccccggttaaccgggggtttaacccccgttcggggttaacccccgg

SEQ ID NO: 293263 - DNA, 659 bp, Homo sapiens
  misc_feature: GYAE6OF02IAQCS.4.27.C05.1.454.CMB.1.raw
  modified_base (591)..(591): a, c, t, g, unknown or other
  misc_feature (591)..(591): n is a, c, g, or t
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagctgggttttccttgttgctactttaagaggagtccactgtggggtacagctgctggagtctggaggaggcatgatccagccgtgggggtccctgagactctcctgtgcagcctcgtgggttcaccgtcaacttacacgccacatgtagttcgggtcccgccgaggctaccgaggggaagggctgggagtgggtctcgtaggttctacgaataacgatcggttactacgtattccgtactcgaacgtacctaccggtaggaaccggggccgtaactttccgaaccctatccttcccgaaaggtaacgaacctaaacgttcccgaaaagaaacctagtttaggttttaacctctttaaacaaacttagaaaacttagaaccgtgggtacccggggaccgaggaaccgacggtcccgttacttactacgtggtacgacgggaggggancgtagggtgccgttggttactttccggtttggttcgcggggtacccacgggtacccctggtaaccccg

SEQ ID NO: 293264 - DNA, 731 bp, Homo sapiens
  misc_feature: GYAE6OF02F6L71.4.27.C05.1.454.CMB.1.raw
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagcttgggttttccttgttgctactttaagaggagtccactggtggggtacagctgctggagtcgtgggaggaggcagtgactccgaggcccggtcggggggtccctggacgtcctccttccgtgtcgccacgtccctcgtcggggttccaccgtactaacttaccgacgcccacacgtggtaggttcgggtcccgccgacggccttacccggaagggggacggggccgttaggggagggttcggggttaccgtccggtacgggtttcctacgtaacgtaaacggtacttacgggttaacctaacgtacgtaccggttactacgacgtaaccgttccggtaggaacgggaccgtacttaccgaccgtactccgtaccgaagtacgaaaccttaacgttaacccaaaggtaacctaagtttacggtttacttaccgttacaaagttgaaatagccgtggaacccgggacggacgacccgaggtcccgttactactacgtggtacggagggtcgggagtcggtaggtcggacggttcggttcgtttccgtttcggtccggtcgggaccgtacgggtacctcggtacccg

SEQ ID NO: 293265 - DNA, 834 bp, Homo sapiens
  misc_feature: GYAE6OF02HHLCJ.4.27.C05.1.454.CMB.1.raw
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagctgggttttccttgttgctactttaagaggagtccactgtggggtacagctgctggagtcgtggaggaggcatgactccgaggccggttcggggggtccctgacgtaccttcctcctgtcgcacgccttcgttcgggttccaccggtctaacctttacacgacccacaagttggtacggtttcggggtccccgacccgaacggggccttacccggaaggggggtaacgggggccgttagggggaacggttggggtaccttcggtaaggtttccgtacctaaagttaaacggacgttacgggttaacctaacgtaacgttccggttaaactccgtaacggtaccgttacccgtaaggggaaccggggtacccgtaaccttttacccgaaaccctacgttacccgtacccgaaacggaaacggtaaccttaaaacccgtttaaaccgaaaaacggttaaccgtaagttttacgggtttaacctttaactttaaacgtaaacgttacgtaaagttaaccgacggttacgggaccggggtaccggaacggaccgtaccgggcccttaccgttaactaccgtggtacgggcgggtacgggggatcggtagggttcggccgttaggtttaccgtttccggttttaggttccgggtaccgggtacccggtacgggtaccccggttggtaccccgg

SEQ ID NO: 293266 - DNA, 669 bp, Homo sapiens
  misc_feature: GYAE6OF02FFYX1.4.27.C05.1.454.CMB.1.raw
  modified_base (482)..(482): a, c, t, g, unknown or other
  misc_feature (482)..(482): n is a, c, g, or t
tcagagcactgtagcacgaccggtgctcgatttagacgcgatcgaagggtttggggggggagaggagcccagcactgggattccgaggtgtttccattcggtgatcagcactgaacagagaggactcaccatggagtttggctgagctgggttttccttgttgctactttaagaggagtccactgtggggtacagctgctggagtctgggaggaggcatgactccagccgtgggggtccctgagactctcctgtgcagcctcgtggttcacccgtcacttacagccacatgagttcgggtccgccaggctccgagggaaggggctgggaggtcgggtctcgaggtttctacaataacgagttaggttactacacgttacgtacctcgaagaccttccggtaggtaacggggcccgtaacgttccacctactcctacgagacaacctaaacgttcccaaaagaacctagttacggttttaacnctttaactaaactaggtaaatacgtacgtggccgggaccggacggaccgtaccggtccgttacctaacttacgtcggtacggcgggtagggggcacgggtaacggtgggtacgttcggtttaccttttaccgggttttggttttccgggacggggtccgtaaccgggggtacccttcgggttacccg

SEQ ID NO: 293267 - DNA, 749 bp, Homo sapiens
  misc_feature: GYAE6OF02GF614.4.27.C05.1.454.CMB.1.raw
  modified_base (257)..(257): a, c, t, g, unknown or other
  misc_feature (257)..(257): n is a, c, g, or t
  modified_base (259)..(259): a, c, t, g, unknown or other
  misc_feature (259)..(259): n is a, c, g, or t
  modified_base (292)..(292): a, c, t, g, unknown or other
  misc_feature (292)..(292): n is a, c, g, or t
  modified_base (661)..(661): a, c, t, g, unknown or other
  misc_feature (661)..(661): n is a, c, g, or t
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagctgggttttccttgttgctactttaagaggagtccactggtggggtacagctgctggagtctgggaggaggcatgactccagccgtgggggtccctgacgactctcctgtncncgcctcgtggttcaccgtcacttacacgcccanagtcgtaggttcgggtcccgccgaggtcccgtaccggaagggggtaacggggtcgtaggggtagggttcggggttacctaccggtagggtttcctaccgtaaacgttaaaccggtagtttacggggttaaccttaacgtaacgttaccggtacctacgaacgtacccgttaccggtagggaaccggggtaccgtactttaccaaccgtactcccgtaccgaaggaacgaactaaacttacccgaaaagtaactacgtttagtttaaacttaccttaactaaagttagaaagtacgacgttcgggaccggggaccgaggaccgtaccggtccgttaccttaacgtacgtggacgggtacgggacgggganaccgtgggtacggtccgttggtttaccgtttcggttttacgggttcgggtaccggggtacccgtaacggggtacccgttcggtacccg

SEQ ID NO: 293268 - DNA, 863 bp, Homo sapiens
  misc_feature: GYAE6OF02HX5TC.4.27.C05.1.454.CMB.1.raw
tcagagcactgtagcacgaccggtgctcgatttagacgcgatcgaaggggtttgggggggggagaggagcccagcactgggattccgaggtgtttccattcggtgatcagcactgaacagagaggactcaccatgggagttttggctgagctgggttttccttgttgcttactttaagaggagtccactggtggggtacagctgctggagtcgtgggaggaggcatgatccgacggccggtcggggggtccctaggacgaccttcctccgtgtcgcgtacgcccttcggttcgggttccaaccggtctaaccttacgacgaccaactagttacggtagggtttcggggtacccgacctaggggccttacccgggaaggggggtaacggggtcgtggggtaacgggttcggggtccttacggtacgggtttcctacgtaagtaaaccggtaacgttacgggttaaccttaaccgaagtttccgttaaccgttaccaaacggtaccgtaccgggttaggaaacccggggttccgtaactttacccgaacccgtaacttccgttacccgaaaggtaaacggtaaacctaaacgttaaccgaaaggtaaacctaagtttacggtttaacttacgtttaacaaaagtagtaaactaggtaacgtcgggaacccgggtaccggaacgggaacccgtaccgggtaacccgttaccttaaccgtaacggtcggtacgggacggggtacggggggtaacacgggtaagggtcggtaccggttacggttttaacgtttccggtttttaccgggtttaccggggtacggggtacccggtaaaccggggttaccccggttaccgggttaccccgg

SEQ ID NO: 293269 - DNA, 764 bp, Homo sapiens
  misc_feature: GYAE6OF02ID10J.4.27.C05.1.454.CMB.1.raw
  modified_base (306)..(306): a, c, t, g, unknown or other
  misc_feature (306)..(306): n is a, c, g, or t
tcagagcactgtagcacgaccggtgctcgatttagacgcgatcgaaggggtttgggggggagaggagcccagcactgggattccgaggtgtttccattcggtgatcagcactgaacagagaggactcaccatggtagttttggctgagcgttgggttttccttgttgcttactttaagaggagtccactggtgggtacagctgctggagtcgtggaggaggcagtgatccacggccggtcgggggtccctggacgaccttcctcctgtcgcacgtcctcgtggttccaccgtcacttacacgccanagtgtacggttcggtcccgccgaggtccgtaccggaaggggacgggtcgtagggacggttcgggttcctcggttacggtttcctacgtaaacttaacggtagttcggtaactaacgtacgttccgtaaccgtcgaacgtaccgtacccgtagggtaaccgggtccgtaactttccgaccgtagtacccgtaccgaagtaacgtaactaacgttaaccgaaagtaacgtagtttacggtttaacttacgttaacgtaaagttagtaaatacgacgtcggaccgggaccggacggaacgaccgggtacccttacgttaaccgtacgttcggtacgggacgggtacgggggacgtacggtcggttacggtcggttacggtttacgtttccgggttttacgggtttaccgggtacccggggttaacccggtaacccgggttaccccgttccggttaccccgg

SEQ ID NO: 293270 - DNA, 599 bp, Homo sapiens
  misc_feature: GYAE6OF02HW966.4.27.C05.1.454.CMB.1.raw
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagctgggttttccttgttgctactttaagaggagtccactgtggggtacagctgctggagtctggaggaggcatgatccagccgtgggggtccctgacgacctctcctgtgcagccttcgtgggttccaccgtcacttacagccacatgaggttggtcccgcaggctccgaaggggagggctgggagtgggtctcgtaggttctacgaataacgagttggtaacctacattccgtactacgagtacctccgtaggaacgggcctatttccacctatcctacagacactaattacaagaactagtagtttactacttacaaatagtaaatacgacgtgtccgggaccgaggaccgacggccgtctactacgtgagtcggagggagcgaggtcggtcgtaggttactttcgtttacggttcggttacggaccgtaaccgggtacccgtggtaccccg

SEQ ID NO: 293271 - DNA, 1027 bp, Homo sapiens
  misc_feature: GYAE6OF02H595A.4.27.C05.1.454.CMB.1.raw
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagcttgggttttccttgttgcttaactttaagaggagtccactgtggggtacagctgctggagtctggaggaggcatgactccgagccggtgggggtccctggacgacttctccgtgtgcacgtccttcgttgggttcctaccgtctaaccttacgacgacccacagttaggtacggtttcgggtccccgaccgtacgggtcccgttaccgggaaggggggaacgggggtacgtggggtacgggttcgggttccttacggtacgggtttacctaccgtaaacgttaacggtacgttacgggtaaccttaacgtacgttccgttaactacgtaacggttacccgttccgggtaagggaaccggggtaccctacgtttacccaaccgtactttaccccgtaaccgtaacgggtaacgtaaacccgtaaacgtttaaaccccgaaaacggttaaaccgtttaacgggttttaacggtttttttaaacgacccgtttttaaaacgtaaaacggtttacgggtaaaaaccggtttacggtaacccgggtacgggggtaccccggggggttaacccggtaaaccgggtaaccccgggttaaccccgggggttacccgttttaaacccggtttaaaccggtttttcccgggtaacgggggtttccgggggaacggggggttaaccggggggtaacggttaccggggttaaacgggggtttcccggggtttaaccgggtttttacccgggggttttttaaacccggtttttttcccggggtttttttacgggggggtttttaaccccgggggaccccggggggggttttaaacccccggtaaaccccgggggggtttttacccccccgtttaggggttaacccccccccgg

SEQ ID NO: 293272 - DNA, 589 bp, Homo sapiens
  misc_feature: GYAE6OF02HUVNR.4.27.C05.1.454.CMB.1.raw
  modified_base (114)..(114): a, c, t, g, unknown or other
  misc_feature (114)..(114): n is a, c, g, or t
  modified_base (171)..(171): a, c, t, g, unknown or other
  misc_feature (171)..(171): n is a, c, g, or t
  modified_base (202)..(202): a, c, t, g, unknown or other
  misc_feature (202)..(202): n is a, c, g, or t
  modified_base (251)..(251): a, c, t, g, unknown or other
  misc_feature (251)..(251): n is a, c, g, or t
  modified_base (284)..(284): a, c, t, g, unknown or other
  misc_feature (284)..(284): n is a, c, g, or t
  modified_base (342)..(342): a, c, t, g, unknown or other
  misc_feature (342)..(342): n is a, c, g, or t
  modified_base (359)..(359): a, c, t, g, unknown or other
  misc_feature (359)..(359): n is a, c, g, or t
  modified_base (387)..(387): a, c, t, g, unknown or other
  misc_feature (387)..(387): n is a, c, g, or t
  modified_base (462)..(462): a, c, t, g, unknown or other
  misc_feature (462)..(462): n is a, c, g, or t
tcagagcactgtagcacgaccggtgctcgatttagacgcgatcgaagggtttgggggggaggagggagcccagcactgggatcgaggtgttccattcggtgatcagcactgaanagagaggactcaccatggagttttggctgagcgtgggttttcctgttgctattaagnggatccatggtgggacagctgcgtggacgtntaggaggaggcatgactcacggccgttgggggtcccagagtcctctccngtgcagcctcgtaggtccaacgtccactaacgnccaatagtgaggttcggccgcaagtcacgaggggaggctggtagtcggtcacgtgtcncgatacgatgacaagtnctacactagaccgttcgagaacggccgntttaccgaacaatcctacaaaggacaactaactacaaagaaccagttacgttatacgtataaatagaactagtancggtacggacctaggaaccacggtaccgataccgtatacgaggtggaaggggacgagagggttccggagttaggttacccgttgtttccgttaggccggggtaacccgaggtacccgtcggtaaccg

SEQ ID NO: 293273 - DNA, 774 bp, Homo sapiens
  misc_feature: GYAE6OF02G07IF.4.27.C05.1.454.CMB.1.raw
  modified_base (181)..(181): a, c, t, g, unknown or other
  misc_feature (181)..(181): n is a, c, g, or t
  modified_base (293)..(293): a, c, t, g, unknown or other
  misc_feature (293)..(293): n is a, c, g, or t
tcagagcactgtagcacgaccggtgctcgatttagacgcgatcgaagggtttgggggggaggaggaggcccagcactgggattccgaggtgtttccattcggtgatcagcactgaacagagaggactcaccatgggagttttggctgagctgggttttccttgttgtctactttaagaggntccatgtgggtacagctgctggagtcgtagggaggaacgggctagtcggacttaccgaggcccggtcgggggggttcccctaggtaacggccttccgtcgttacgtcgaccnggtccctgtcggttccaccgtctacttacgacaccactatacgtggttcggtccgccgacggtcctaccggagggaacggggcgtagggtacggttcgggtcgttacgtacggtttactaccgtaaagtaaccggtaagtttacgggtaccttaacgtaaaccgttccggttaccttacccgtaacggtacttaccccgggttaagggaaacccgggtccggtaaacctttaccgtaacccgacctttaccgacccgttaacgacggtaaaccttaaacgtaccgtaaaaccggtaacttaggttaacgtttaactaccgtttaacgtaaatacggtaaatatacgtacggccgggtaacggaccggaacgtaccgcccgttacgtctacgtaccgggtgacgggtagggaccaggtcggtgacgttcggttatttccggttttcggttcggcggttaccgggacggtacgttcggtcccg

SEQ ID NO: 293274 - DNA, 617 bp, Homo sapiens
  misc_feature: GYAE6OF02JZ8XF.4.27.C05.1.454.CMB.1.raw
  modified_base (258)..(258): a, c, t, g, unknown or other
  misc_feature (258)..(258): n is a, c, g, or t
  modified_base (286)..(286): a, c, t, g, unknown or other
  misc_feature (286)..(286): n is a, c, g, or t
  modified_base (411)..(411): a, c, t, g, unknown or other
  misc_feature (411)..(411): n is a, c, g, or t
  modified_base (449)..(449): a, c, t, g, unknown or other
  misc_feature (449)..(449): n is a, c, g, or t
  modified_base (536)..(536): a, c, t, g, unknown or other
  misc_feature (536)..(536): n is a, c, g, or t
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagcttgggttttccttgttgctactttaaggaggagtccactgtggggtacagctgctggagtctggaggaggcatgatccagccgtgggggtccctgagactctccgtgtgcngcctcgtggtcaccgtcactacacgcanatgtacggtcggtccgccgaggccaccggagggacgggcgtgggaggtcgggtctacgtggtctacgagtaacgatggtaactacagtcgtactgacgactcggtagacggtacctatcacctanacctcagacgactaactacaatactagtagttatctanaaagtctaatacgagaccggcgggtaccgacggtaccgacggtacccgttactacggtactggtacgggagggacggggaactcggnggtaccggtcgttacggttacggttttaccgtttcgggtttccggacggggtacccgtacgggtaccccggtggttacccg

SEQ ID NO: 293275 - DNA, 639 bp, Homo sapiens
  misc_feature: GYAE6OF02F8BW0.4.27.C05.1.454.CMB.1.raw
  modified_base (320)..(320): a, c, t, g, unknown or other
  misc_feature (320)..(320): n is a, c, g, or t
  modified_base (359)..(359): a, c, t, g, unknown or other
  misc_feature (359)..(359): n is a, c, g, or t
  modified_base (364)..(364): a, c, t, g, unknown or other
  misc_feature (364)..(364): n is a, c, g, or t
  modified_base (412)..(412): a, c, t, g, unknown or other
  misc_feature (412)..(412): n is a, c, g, or t
tcagagcactgtagcacgaccggtgctcgatttagacgcgatcgaaggggtttgggggggagaggagcccagcactgggattccgaggtgtttccattcggtgatcagcactgaacagagaggactcaccatgggtagttttggctgagtcgttgggttttccttgttgctaactttaagaggagtccacgtggtggggtacagctgcgtggagtcgtgggaggaggcatgactccgacggccggtcgggggtccctgacgacctcctcgtggtgcctacgtcctcggtcggttccaccgtactaccttacacgccactntggtacggttcggcccgcgaggccgacggagggacgggntgggnggtcggtctgtacggttcacgagtacgagtagtactatacgtcgtacncgaacgtacctcggtagaaccgcgtactcactctctacgagataacctataccaaatacgtagttacgttactactaataacgtataaacgtgtaccgtgggaccggcgtacggacctacggccttaactcacggtgcggagggtagggctacgggaggttgtacctttggttaccttttcggttaggttcgggaccggttccggaaccggttcccgtacggttccc

SEQ ID NO: 293276 - DNA, 976 bp, Homo sapiens
  misc_feature: GYAE6OF02IOGQF.4.27.C05.1.454.CMB.1.raw
  modified_base (350)..(350): a, c, t, g, unknown or other
  misc_feature (350)..(350): n is a, c, g, or t
tcagagcactgtagcacgaccggtgctcgatttagacgcgatcgaaggggtttgggggggagaggacgcccagcacgtgggattccgaggtgtttccattcggtgatcagcactgaacagagaggactcaccatggtagtttggctgagtcgttgggttttccttggttgacttaacgtttaaggaggacgtccacgtggtaggggtacagcgtgcgtagggacgtcgtagggacgggaggctagtgacaccggacggtccgggttacgggggtcccaggaacgtcctccgtcgtgcgacgtcgccttcggtcggttaccaccgtaccttacgttaaccgacgccctaanacggttggttaacgggtttccggggccccgaccgaacggggtccccgtaacccggggaaggggggaaccgggttccggtaggggttaccggggtttacgggtcggttccggtaaccggttttcgacctaaacggtaaaaccgggtacgtttacggtaacctaacctagtttaacccgggttacacggtaaccgacgtttccgggaaaccgggtaccgggtaacccgtaatttcccgaaaccccttaactcccggtaaacccgaacgggttaaaaccgtaaacccgttaaacccgttaaaaccggaaaagggttaaaccctttaaacggttttaccggtttaaacttaacccgtttaaacgttaaaagtaacccgttaaacgtacggtaaccgggttaccgggaaccgggggtaacccggtaacccggttaaacccgggaacccgggttacccttaaacccgtttacgtaaaccgggttccggttaggacccggggggaaggggttacgtccggggttaagggtccggttacgggtttaaccggttttacggttttcccgggtttaacggggtttccggtaccggggaacccgggtttacccgggtaaccggttccggttaccccgg

SEQ ID NO: 293277 - DNA, 692 bp, Homo sapiens
  misc_feature: GYAE6OF02I8DOQ.4.27.C05.1.454.CMB.1.raw
  modified_base (438)..(438): a, c, t, g, unknown or other
  misc_feature (438)..(438): n is a, c, g, or t
  modified_base (451)..(451): a, c, t, g, unknown or other
  misc_feature (451)..(451): n is a, c, g, or t
  modified_base (511)..(511): a, c, t, g, unknown or other
  misc_feature (511)..(511): n is a, c, g, or t
  modified_base (615)..(615): a, c, t, g, unknown or other
  misc_feature (615)..(615): n is a, c, g, or t
  modified_base (622)..(622): a, c, t, g, unknown or other
  misc_feature (622)..(622): n is a, c, g, or t
  modified_base (632)..(632): a, c, t, g, unknown or other
  misc_feature (632)..(632): n is a, c, g, or t
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagctgggttttccttgttgctacttaagaggagtccactggtggggtacagctgctaggacgtctggaggacggcacgtgacgtccaggcccggttggggggtcccctaggactccgttacctccgtgtgaccaacggtcctcgttcggggtcaccggttacacttacaacgtcccacgtatggacgtttcgggtcccgcgaacgtctacccggaagggggaacggtccgaggtacggtcgggttaccgtgacggtttctacgaagtaacgtagtcgtaactatactacgttanctacgacctcggnggaaacggcctagttacaccgtatccgtacccgagacgaacttaactacaaacgtaactnttacggttcttaactacgtaaactgaacgtactaggttccggacgggccggttaaacggacccgacggtccgtaaccgtacttacggtcgaggtacggacgggngtaccgnggttaccggntttaacgtcgttttccgtttcggttcggtcgggtacccgacggttacccgtaggtacccg

SEQ ID NO: 293278 - DNA, 837 bp, Homo sapiens
  misc_feature: GYAE6OF02HVQA9.4.27.C05.1.454.CMB.1.raw
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagctgggttttccttgttgctactttaagaggagtccactgtggggtacagctgctggagtcgtgggaggaggcatgactccagccgtgggggtccctgacgtactctcctgtcgccgacgtccgtcgtcgggttcaccgtctaaccttacacgccaacgtagttggtacggttccgggtacccgcccgtaacggtcccgttaccggaaggggggaacggggtccgtaggggtaacggttcggggttcctacggtaggttcctacgtaacgtaaaccgtagttacggtaacctacgtacgttccgtaacgtaccgtacggtacccgttccggtacgggaacggggcccgtaactttcccgaaccctacgttacccgtacccgaaagtaacgtaaaccgtaacttaaccgaaaacgtaacttacggtttacgtttaaccttacttttaacgaaaagtttagtaaaacgttacggtaccgtagggacccgggtaccggtaacggtaacccggtacccgggttaccccgttaaccgtttaaccgttacggttcggtaccgggacggggtagggggacgtaccggtaagggttaccgggttccgttacgggttttacccgtttttaccgttttcggggtttaccggttaccgggggtaccccggttaacggggttacccccgttgggttaacccccg

SEQ ID NO: 293279 - DNA, 917 bp, Homo sapiens
  misc_feature: GYAE6OF02JZUL2.4.27.C05.1.454.CMB.1.raw
  modified_base (260)..(260): a, c, t, g, unknown or other
  misc_feature (260)..(260): n is a, c, g, or t
tcagagcactgtagcacgaccggtgctcgatttagacgcgatcgaagggtttggggggagaggagcccagcactggattccgaggtgtttccattcggtgatcagcactgaacagagaggactcaccatggagttttggctgagctgggttttccttgttgctactttaagaggagtccactgtggggtacagctgctggagtctgggagggaggcagtgactccgacgccgtagggggtcctgagactctccgtgtgcnggccttcgtcggttcaccggtctaccttacgacgtacccgactagtcggtaggttcgggtacccgccgtacggccgtaccggaagggggaacggggtcctaggggaggttcggggttacctacggtacggggtttaccttacggtaaacgtttaaaccggaacggtttaccggttaacccgtttaccaacggttttacccggtaaaccgttcgtaaaaccggtaccccgtttaacccggggaacgggtaaaccggggttccggtaaaccttttacccggaacctaaccgttacccgttaacccgaacggtaaccggtaaactaaaccgttaaacccgtaaaagtaaacctaacgggttttacgttttaacgttaaccgtttaacaaacgttaacggtaaacgttaagtaaccgttgggtaacccggggtacggaacccggtaaccggaacccgggttcccgttaacccgttaaccgtttaacggtacggttacggggaaccggggttacgggggtaaccgacggtaacgggttacggttccggtttaaccgggtttacccggttttttcggttttaccggggtttttacccgggttaccccggggttacccgggtaaacccggggttaccccggtttacccgggtttaacccccggg

SEQ ID NO: 293280 - DNA, 784 bp, Homo sapiens
  misc_feature: GYAE6OF02G7JLK.4.27.C05.1.454.CMB.1.raw
tcagagcactgtagcacgaccggtgctcgatttagacgcgatcgaagggtttggggggagaggagcccagcactgggattccgaggtgtttccattcggtgatcagcactgaacagagaggactcaccatggagttttggctgagctgggttttccttgttgctactttaagaggagtccactgtgggtacagctgctggagtcgtggaggaggcagtgactccgaggccgtgggggtccctgacgacctctcctgtcgcacgccttcgtgggttccaccgtcaccttacacgcccactagtggtacggtttcgggtcccgccgaaggtcccgtaccgggaagggggaacggggtccgtaggggacggttcgggtccttacgtacggtttcctacgaagttaacggagttacggtaaccttaacgactttaccgttactacgtaacgtaccgttaccggtaggaacgggtcccgtaactttccgaaccctagtacccgtacgaaggaacgtaacctaacgttaccaaaaggtacttaggtttacgtttaacttacgtttaaccgaaaagttcgaaatacggtcgtacgggtaccgggacccgtaggacccgtacgggtccccgttaacgttacccgtacggttcgggacggtaccggggaaggggtcgaccggttacgggttcggttaccggtttcgggtttaacccgtttttccgggttttacggggtttcccggaccgggggttaacccgaaccggggtttaccccgtcgggttaacccccg

SEQ ID NO: 293281 - DNA, 1118 bp, Homo sapiens
  misc_feature: GYAE6OF02H6YHF.4.27.C05.1.454.CMB.1.raw
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagcttgggttttccttgttgctactttaagaggagtccactggtggggtacagctgctggagtctgggaggaggcatgatccgagccggtggggggtccctggacgtacctctcctgtgcacgccttcgtcgggttccaccggtcctaaccttaacacgaccccaactagttggtaaggttcgggggtccccgccgacgggtacccgttacccgggaagggggggtaacggggggtcctaggggtaacgggttcggggttccgtacggttacgggtttcctaccgtaaacggtaaaccggtacgttacgggttaaaccttaacgtaacgttccgttaactaccgtaacggtacccgttaccgggtaacgggaaaccgggggtaccccgtaacgttttaacccgaaccttaacgttacccttaacccggaaaggtaaaccggtaaacccttaaaacgtttaaaccccgaaaacggttaaaaccgtttaacggtttttaacgggtttttaaactttaacccgtttttaaaactaaaaacggtttacggttaaaaacggttaccgggtaaaccgggttccgggggggaaccccggggggtaaaccccggggtaaccgggggtaaaccccgggttaaccccggggggttacccccggtttaaaccccgttttaaaccgggttaacccggttaacggggggttaccccgggggggaacgggggggtaaccggggggggggttaaacggtacccggggggtttaaacggggttttacccgggggttaaccgggttttttaaccggggggtttttttaaaccccggttttttttcccccggggggttttttttacggggggtttttttaacccccgggggggttaccccggggggggggtttttaacccccggggttaaaacccccggggggggtttttaaacccccccggtttcccggggggggtttaaacccccccccg

SEQ ID NO: 293282 - DNA, 624 bp, Homo sapiens
  misc_feature: GYAE6OF02HXAK4.4.27.C05.1.454.CMB.1.raw
  modified_base (243)..(243): a, c, t, g, unknown or other
  misc_feature (243)..(243): n is a, c, g, or t
  modified_base (260)..(260): a, c, t, g, unknown or other
  misc_feature (260)..(260): n is a, c, g, or t
  modified_base (286)..(286): a, c, t, g, unknown or other
  misc_feature (286)..(286): n is a, c, g, or t
  modified_base (361)..(361): a, c, t, g, unknown or other
  misc_feature (361)..(361): n is a, c, g, or t
  modified_base (391)..(391): a, c, t, g, unknown or other
  misc_feature (391)..(391): n is a, c, g, or t
  modified_base (471)..(471): a, c, t, g, unknown or other
  misc_feature (471)..(471): n is a, c, g, or t
tcagagcactgtagcacgaccggtgctcgatttagacgcgatcgaagggtttgggggggagaggagcccagcactgggattccgaggtgtttccattcggtgatcagcactgaacagagaggactcaccatggtagttttggctgagcttgggttttccttgttgctactttaagaggagtccacgtggtgggtacagctgctggagtctggaggaggcatgactccagccgtgggggtcccngacgactctcctgtgcngcctcgtcggttcaccgtctactacncaccacatggtagttcgggtccgaccgtaggccgtacggaaggggacggcgtgggacgtcggtctcgtagttcanataacgagtacgtactacgactcgtactanacgtactcgtagacggcctactcgactactcaccgaagacgtacaattaccgaaagaactagttagtttactacgttaanaatagtaacagacgtgaccgggacgaacgccgacggtactcgttaactcggtagcgacgggagggagtacggtagggtccgtaggtacggtttcttttaccggtttgggttacggtcccggggaccgtaacggggtaccccgtaggtaccccg

SEQ ID NO: 293283 - DNA, 868 bp, Homo sapiens
  misc_feature: GYAE6OF02IZTV3.4.27.C05.1.454.CMB.1.raw
tcagagcactgtagcacgaccggtgctcgatttagacgcgatcgaagggtttgggggggagaggagcccagcactgggattccgaggtgtttccattcggtgatcagcactgaacagagaggactcaccatggtagttttggctgagcttgggttttccttgtgctacttaagagagtccactggtgggtacagctgctggagtctggaggaggcatgatccgagccgtgggggtcctgacgtacctctccgtgtgcacgtccgttcgtagggttccaccgtctaaccttacgaacgacccaactagtcggttacgggtttccgggtccccgaccgtagggtccgtacccggaaggggggaacggggtccgtagggtagggttcgggtaccgtacggttacggtttacctacgtaaacgttaacggtacgttaccgggtaaccttaacgtaccgttcgttaacccgtacgtaacgtacccgttcccggggtaaggggaacccggggtaccctaacgtttacccgtaaacccgtacttaccccggtaaccggaacggtaaaccgtaacccttaaaccttaaccgggaaaaacgtaaaccggtttacgttacgggttttttaaaccttacgttaaaccgtaaaagttaccgttaaaagttacggtaccggttaacccgggacgggggttacccgtaacgggaacccgttaccggggtacccttaacgttaccgtacggttgggacgggaccgggggtaggggtacctaccgggtagggtccggttacgttacgggtttaacgttttcccggttttaggggtacccgggtcgggtaaccccggttacggggtaccccgttggttaaccccg

SEQ ID NO: 293284 - DNA, 759 bp, Homo sapiens
  misc_feature: GYAE6OF02HIA3H.4.27.C05.1.454.CMB.1.raw
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagcttgggttttccttgttgctactttaagaggagtccactgtggggtacagctgctggagtcgtgggaggaggcagtgatccgagccggtgggggtccctgacgactctcctgtcgcacgcctcgtcggttccaccgtcacttacacgccacatggtacggttcgggcccgccgacggccgtaccggaaggggagggcgtgggaggttcggtctacgtggttctacaacgtaacggatcggtaactactacgttacgtactcgacgtaccgtacggtaggaacgggccgtattccacctacttcccgacgagacgtaacctaacttacccgaaagtaaccttagtttacggtttaacttaccgttaacgaaacgttagaaaacttacggaaccggttaccggggaccggggacccgtaacgggaacccggtacccgggtcccgtttaaccgttaaccgtacggtcgggtaccggggacggggacgggggtacgtacggtacgggttcggggttaccgtttagggttttaccgtttttcccgggtttttacggggtttaccgggtacccgggggaccggttaaacccgggggttaccccgttcgggttacccccg

SEQ ID NO: 293285 - DNA, 716 bp, Homo sapiens
  misc_feature: GYAE6OF02G14XR.4.27.C05.1.454.CMB.1.raw
  modified_base (325)..(325): a, c, t, g, unknown or other
  misc_feature (325)..(325): n is a, c, g, or t
tcagagcactgtagcacgaccggtgctcgatttagacgcgatcgaagggtttggggggggagaggagcccagcactgggattccgaggtgtttccattcggtgatcagcactgaacagagaggacctcaccatgggtagttttggctgagtccgttgggtttttccttgttgccttaacttttaaggagggagtccacgtggtgggggtaacagcctgcgtgggagtcgtagggagggaggcatgactccaggtccggtcggggggtccctagacgccttctcgtgtcgcacgtccttcgtcggttaccaccgtactactacacnccactagtggtacggttccgggtcccgccgtacggccgtaccgggaggggagggtcgtgggtagggtcgggtctacgtaggttccagtaatacgtagttacgtacctacacgttaccgtaactcgaacggtaccgtaccgggtaacggaacggggtacccgttactaccgtaccactaccctccgaagactaaactaaccgttacaaacgtacctagtttacggtttattacgttataaataagagtacgcggtcgggacggaccggacggccgacggtccgttactcgtagtaggtcgtagggcggagtacggtcggtcggtacgttggtttacgtttggttacggttttcgggaccgggtaccgggtaacggttacccgtcggtacccg

SEQ ID NO: 293286 - DNA, 731 bp, Homo sapiens
  misc_feature: GYAE6OF02JK3EV.4.27.C05.1.454.CMB.1.raw
  modified_base (192)..(192): a, c, t, g, unknown or other
  misc_feature (192)..(192): n is a, c, g, or t
  modified_base (649)..(649): a, c, t, g, unknown or other
  misc_feature (649)..(649): n is a, c, g, or t
tcagagcactgtagcacgaccggtgctcgatttagacgcgatcgaagggtttgggggggagaggagcccagcactgggattccgaggtgttccattcggtgatcagcactgaacagagaggactcaccatggtagtttggctgagctgggtttccttgttgctactttacgaggtagtaccatgtgggtacnggctgctggagtcgtggaggacggcagtggatccgaggtccggtcgggggttccctggacgtaccttccgtccgttgtgaccgtacgtcccttggtcggttccgaccgttacctaccgttaccgaccgtcccaacgtagttcggtacggttcgggtaccccgccggtacggccggttacccgaagggggtacgggtctaggggtagttcgggttactcgtaggtttccactacgtaacggtagaggtaaccctagtccgtaccgttacgctaacggtactccggtagggaacggtcctactccgtaacctcgtcctacgaagtacgtaacctaattaccgaagtaactagttactttactacttactaaagtacgtaatcgtacgtcgggaccgtaccgggaagtaaccggccggtaccgttacctaacgtccggtggtcggacgggtaaggggtcnccggttaaggtcggtaggttcgttaaccgttttcgttacgggttcggtccgggtaccgtaaccggtaccgtccgggttaccc

SEQ ID NO: 293287 - DNA, 705 bp, Homo sapiens
  misc_feature: GYAE6OF02JSAJE.4.27.C05.1.454.CMB.1.raw
  modified_base (169)..(169): a, c, t, g, unknown or other
  misc_feature (169)..(169): n is a, c, g, or t
  modified_base (268)..(268): a, c, t, g, unknown or other
  misc_feature (268)..(268): n is a, c, g, or t
  modified_base (317)..(317): a, c, t, g, unknown or other
  misc_feature (317)..(317): n is a, c, g, or t
  modified_base (557)..(557): a, c, t, g, unknown or other
  misc_feature (557)..(557): n is a, c, g, or t
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagctggttttcctgtgctacttagnggagtccagtgtggggtacagctgcgtggactcgtggaggaggcatgatccgagtccggtcggggggtcctcggtacgtacgtcctccgtgtacgccgnggcccttacgtcgggttccgacccgtacctaccttacgacgcctaaccngtacggtaggtttccggggtcccgacccggtacgtcccgtaccgtagggggaacggggtccgtggggaggttccggggtcgtacgtaccggttgtaccgaagtaaccggtagtttaggtaaccctagtaactcggtttacacgtgtaaccgtcgtaggacggacccggtataccgactacttacaccgtagaacgtaactaacctaccgaaagtacctaacttggttactctataaacgngtaaatacgtccgaggccgggtacaccggacgtaccgtccggtaccttaacgtcgtgtacggaggggcggtagacgtacggtggtcgtaacggttcgtttcgttacgggttcggtaacgggtccggtaaccgggtaccgtacgtcccg

SEQ ID NO: 293288 - DNA, 658 bp, Homo sapiens
  misc_feature: GYAE6OF02HV1NZ.4.27.C05.1.454.CMB.1.raw
  modified_base (498)..(498): a, c, t, g, unknown or other
  misc_feature (498)..(498): n is a, c, g, or t
tcagagcactgtagcacgaccggtgctcgatttagacgcgatcgaagggtttgggggggagaggagcccagcactgggattccgaggtgtttccattcggtgatcagcactgaacagagaggactcaccatggagttttggctgagcttgggttttccttgttgcttactttaagaggagtccacgtggtgggtacagctgctggagtcgtgggaggaggcagtgactccgagccgtgggggtccctggacgactctcctgtcgcacgccttcgtgggttcaccgtctaacttacacgcacagtgaggttcgggtcccgccgaggcctccggaggggaacggggtcctagggacggttacgggtctcgtaggttccgtacgtaaacggatggtaacctacgtattcgtactacacgtacgtccgtagaacggccattcacctatctaccagtagaacctaacgttacaaaagaacaagttaggtttaactaccttaanaaatagaaattaagactggaccggaccgtaacggaccgacggtcccgtacgtactacgtgacggcgggaaggggcgtcgtaggtcggtcgttaggttacctttccggttttgggtttccgcgggggaccgttaccggggaacctttcggaccctacccgg

SEQ ID NO: 293289 - DNA, 986 bp, Homo sapiens
  misc_feature: GYAE6OF02JNXSH.4.27.C05.1.454.CMB.1.raw
  modified_base (477)..(477): a, c, t, g, unknown or other
  misc_feature (477)..(477): n is a, c, g, or t
  modified_base (605)..(605): a, c, t, g, unknown or other
  misc_feature (605)..(605): n is a, c, g, or t
tcagagcactgtagcacgaccggtgctcgatttagacgcgatcgaaggggtttggggggggagaggagccccagcacgtgggattccgaggttgtttccattcggtgatcagcactgaacagagaggactcaccatggtagttttggctggagtcgtttgggttttccttgttgacttaacgtttaagaggtagtcctcgtgggtaggggtacaggcttcggcgtaggtacgttcggtggggaacgggagggtacagttcgactacccgacgggtccccggggttacggggggtccccttagggacctaccgttcccttcccggtgttcgccgtacgttcccgtttacggtaccgggtttaccgtaacccgggttccttaaccgttacgtaaccgtaccgacgtacgttcgggttacggtttccggggaccccggccggtaccggtccggtacccggggaagggggttaaccggggnggttaacggggtcggtttgggtccgtaacgggtccggtttccgtacgtaaaagtacggtaaccgtttacgggtaaccttacgttacgttaccggttaccgttaacgtaccgtaccggggttaaccggnggttaaaccggggttaccctacgttaacctacccgaacgtttcccctaacggaaacgttaaccggtaaccttaaaccggttcctaaaacggtttaattaccgggttttacttttaaacgttaaaccccggtttaaagttaaaccgttaaagttaacgtaccgggtaaggtcccggggtacggtaaccggaccgggtaacggtacccgttacggttcgttaaaccgtaggttccggggtaggaccgggggacgggttacgacggggttacggtccgggttaaggttttaacccgggttttcgttttccccgggttttcgggggttacccgggttaccgggttaccggggttaccgggttaccccggtttcggtaaccccggg

SEQ ID NO: 293290 - DNA, 800 bp, Homo sapiens
  misc_feature: GYAE6OF02IWN2N.4.27.C05.1.454.CMB.1.raw
  modified_base (279)..(279): a, c, t, g, unknown or other
  misc_feature (279)..(279): n is a, c, g, or t
tcagagcactgtagcacgaccggtgctcgatttagacgcgatcgaaggggtttggggggggagaggagcccagcactgggattccgaggtgtttccattcggtgatcagcactgaacagagaggactcaccatggagttttggctgagcttgggttttccttgttgctactttaagaggagtccatggtggggtacagctgctggagtctgggaggaggcatgactccgacggtccggtcggggggtccctaggacgtacctcctccgtggtcgtaccncgtccctcggtgggttccaccgtactaccttaccagcccaatagtcggtaggtttcggggtaccccgccgaaccgggtccgtacgggaagggggaacgggtcgtgggtaggtcgggtctcgtaggttcctagtaacgtaagtgttacggtaactacgtacgtaccgttactaccgtaacggtaccgtaccggtaagggaaccgggtcccgtaatttcccaccgtacctcctacgaaagtacgtaaacctaacgttaaccgaaagtaaaccgttggttttagtttaaccgttaccttaaactaaagttaagtaaacgtacggtaccgttacggggccggaaccgggaaccggacccgtaaccgggtacccgtttacgttaaacctcggttaggggtccggagggggtacggggaacgtcggaagggtttccggtaagttccgggttacgttttttcccggtttaggggttccgggttaccggggaacccggtaaccgggttaccccggttcggtacccccgg

SEQ ID NO: 293291 - DNA, 825 bp, Homo sapiens
  misc_feature: GYAE6OF02F7CJK.4.27.C05.1.454.CMB.1.raw
  modified_base (305)..(305): a, c, t, g, unknown or other
  misc_feature (305)..(305): n is a, c, g, or t
  modified_base (370)..(370): a, c, t, g, unknown or other
  misc_feature (370)..(370): n is a, c, g, or t
tcagagcactgtagcacgaccggtgctcgatttagacgcgatcgaagggtttgggggggagaggagcccagcactgggattccgaggtgtttccattcggtgatcagcactgaacagagaggactcaccatggagtttggctgagctgggtttccttgttgctactttaagaggagtccactgtggggtacagctgctggagtctggaggaggcatgactccagccgtgggggtccctgacgactctcctgtgcagcctctgggttcaccgtcaccttacacgcccacatggacgttgggtcccnccgaggcctccgaggggaacgggcgtggtacggtggggtcctcggtaggtttcctcagtaaacgnttacgggtaactaacgtacgttcgtaactcacgtaccgtccgtacggaaacggggtcccgtaagtttcccgaacctacgttacctacccggtaacgaaaggtaaccctaaaacgtttaccccgaaaacgtaaaaccgttaacgtttacggggtttttaaacttaccgttttaaacccaaaaagtttacgtaaaacgtttaaacggaaaccgttcgggaccgggggtacccgaaggggaaacccgtaacccggggtccccgtttaaccgtaaacccgttaacgtttcgggttaacgggacccggggtaagggggggtaacggtaccggtaacgggtttcggggtaccggtttacggggtttaacgtttttcccggttttttacgggggttttccggttaccgggggggtaaccccggttaacgggggtaaacccccgtttcgggttaaccccccgg

SEQ ID NO: 293292 - DNA, 802 bp, Homo sapiens
  misc_feature: GYAE6OF02GPI3B.4.27.C05.1.454.CMB.1.raw
  modified_base (208)..(208): a, c, t, g, unknown or other
  misc_feature (208)..(208): n is a, c, g, or t
tcagagcactgtagcacgaccggtgctcgatttagacgcgatcgaagggtttgggggggagaggagcccagcactgggattccgaggtgtttccattcggtgatcagcactgaacagagaggactcaccatggtagtttggctgagtcttgggttttccttgttgctaatttaagaggagtccactggtggggtacagctgcgtaggntcggtggaggaggcagtgactccgcggtccggtcgggggtccctggaactccgtctccgtggtagcgacgtcccgtgttcggtccctaccggtactaacgttaccacgcctaacgtgtcggtacgggttccgggaccccgtcgacggtccgtaccgggagggggtaacggcggtaggtacggtgggtccttagtaccggtcctcgtaaagtaacgtacgttacggtaactaccacgttaccgttacctcggaacgttacccgtacggtacgggtaacccgggtacccgtaccgtttacccacccggtacctaacccgttaccggaaagtaaaccgtaacctaaacggtacaaaacgtaacgttacgtacgttttacctaactaacgtttaaagagtaaaacgtggtaaccgtcgggcccggtaacggaaccggtaccgtacccggtccgttaaccttacgtaccggttgggacggtaacgggggaggacgttacgcggggttcgtacggttacgttttacccgggttttaccgttttcgggttacccggggaacccgggtaccgggtaacccgggttccggttaccgtccccgg

SEQ ID NO: 293293 - DNA, 933 bp, Homo sapiens
  misc_feature: GYAE6OF02GQ4BH.4.27.C05.1.454.CMB.1.raw
tcagagcactgtagcacgaccggtgctcgatttagacgcgatcgaagggtttgggggggagaggagcccagcactgggattccgaggtgtttccattcggtgatcagcactgaacagagaggactcaccatggtagttttggctgagtcttgggttttccttgttgcttactttaagaggagtccacgtggtgggtacagctgcgtggagtcgtagggagggacggcagtcgacttaccgacggtcccggttacgggggggtccctaggacgaccgttcccttccgttggtacgcgtacgtccccttcggttccgggttcccaacccggttacctaacctttaaccgacgaccctaacgtacggttggtacgggtttccggggtaccccgacccggaaggtccccggtaccggggaaaggggggtaaacgggggtccggttagggggaacggtttcggggttcccgttaccggttaaggtttccctaacgtaaaacgttaaacggtacgtttacgggtaaacctttaacgtaacgttaccgtttaaccctacggaaccgttacccgttaccggggtaaacgggtaaccggggtacccttaactacccgacctacgttcccgtacgaaaccgtaccgtaaaccttaaacgttacccgaaaacgttaaacgttaggtttaaccgtttaacttaccgtttaaacgttaaaagttacgtaaactacgggtaccggtaccggtaccggggaacggtaaccgggaccggaaccccgggttaccgttaaaccgttaccgtaccggttcgggtacggggaacggggtacgggggtactacggggtaaggttcgggtacgtttcgggttttaccgttttccgggtttttgggttaccgggtccgggtaccgggtaaccggttacccggttcgggtaaccccg

SEQ ID NO: 293294 - DNA, 791 bp, Homo sapiens
  misc_feature: GYAE6OF02F58E0.4.27.C05.1.454.CMB.1.raw
  modified_base (711)..(711): a, c, t, g, unknown or other
  misc_feature (711)..(711): n is a, c, g, or t
tcagagcactgtagcacgaccggtgctcgatttagacgcgatcgaagggtttgggggggagaggagcccagcactgggattccgaggtgtttccattcggtgatcagcactgaacagagaggactcaccatggtagttttggctgagtcttgggtttttccttgttgcttactttaaggaggagtccactggtggggtacagctgctggatcgtggaggaggcattgactccgacggtccggtcggggggtccctggagtaccttccttcctggtcgaccgacgcccttcgttcgggttaccaccgttcctaaccttacgacgaccccaactagttggtacgggtttcgggtaccccgaccgacgggtcccgttacccgggaagggggacggggtcgtaggggtacggttcgggttcctacggttggttcctactaagtacgtagttaggtaccctaagtcgttaccgttacgacgtaacgtaccgtcccgggtaaggaaccgggtccgttacttacccgaccgtacttcccgtacgaagtaacgacctttaaactaacccgaaagttaacgttacggtttacttttaacgttaccttaagtaaattaacgtaaacttacgaccggttaccgggaccggggtacccgaacgggaacccgtaccggtaccgttaccgttaaccttaccggtgggaccgggtaggggacgggngtaggtcgggtagtcggtttcgtttcggttttccgtttgggtaccggttccgggaccggttaccggtcctacggtacccg

SEQ ID NO: 293295 - DNA, 558 bp, Homo sapiens
  misc_feature: GYAE6OF01BQZZX.45.60.F05.1.454.CMB.1.raw
  modified_base (191)..(191): a, c, t, g, unknown or other
  misc_feature (191)..(191): n is a, c, g, or t
  modified_base (390)..(390): a, c, t, g, unknown or other
  misc_feature (390)..(390): n is a, c, g, or t
  modified_base (429)..(429): a, c, t, g, unknown or other
  misc_feature (429)..(429): n is a, c, g, or t
tcagacgcgatcgacacgaccggtgctcgatttagtacgtcatcagggaaagggctggagtggtgggtctcattagaagcaaagcttctgggggacaacagactacgccgcgtctgtgaaaggcagattcaccatctcaagagatgattccaaaagtgtcgcccatctgcaaatgaacagcctgaaaccgnggacacagccatgtattacgtgtactagagggtaggtcgctgtccggtaactccatactgggccaggaaccctggtcaccgtctcctcagcctcacaagggcccatcggtctcccctggcgcctgctccaggacgcacctccgagacgcacacgcggcctgggctcgcctggtcaaggactactcctcgactcgcgtcngagtcgggctggctaacggcgacagtacggctagcgtcngtacgcgtgacgtcgtcgtaactcgtacgtctacgtacgtacgcgttacgtagtccgtacgacgttacgacgtacgtacgttcgacgtaacccgtgtacctacggtaacgtcgtcgggtacttaccggg

SEQ ID NO: 293296 - DNA, 440 bp, Homo sapiens
  misc_feature: GYAE6OF01EY07V.45.60.F05.1.454.CMB.1.raw
  modified_base (426)..(426): a, c, t, g, unknown or other
  misc_feature (426)..(426): n is a, c, g, or t
  modified_base (431)..(440): a, c, t, g, unknown or other
  misc_feature (431)..(440): n is a, c, g, or t
tcagacgcgatcgacacgaccggtgctcgatttagtacgtcatcagggaaaggggctggagtgggtgggtctcattagaagcaaagcttctggggggacaacagactacgccgcgtctgtgaaaggcagattcaccatctcaagagatgattccaaaagtgtcgcccatctgcaaatgaacagcctgaaaaccgaggacacagccatgtattactgtactagaggggtagggtcgctgtccggtaactcccactactgggggccagggaaccctggtcaccgtctcctcagcctccaccaagggcccatcggtcttccccctggccgccctgcctccaggacgcaccctccgagacgcacagccggccctgggctgcctggtcaaggactacttcctcgatcgcgtctgagcggctggcaaggcgnatagnnnnnnnnnn

SEQ ID NO: 293297 - DNA, 428 bp, Homo sapiens
  misc_feature: GYAE6OF01BVRSD.45.60.F05.1.454.CMB.1.raw
  modified_base (339)..(339): a, c, t, g, unknown or other
  misc_feature (339)..(339): n is a, c, g, or t
  modified_base (424)..(428): a, c, t, g, unknown or other
  misc_feature (424)..(428): n is a, c, g, or t
tcagacgcgatcgacacgaccggtgctcgatttagtacgtcatcagggaaaggggctggagtgggtgggtctcattagaagcaaagcttctggggggacaacagactacgccgcgtctgtgaaaggcagattcaccatctcaagagatgattccaaaagtgtcgcccatctgcaaatgaacagcctgaaaaccgaggacacagccatgtattactgtactagaggggtagggtcgctgtccggtaactcccactactggggccagggaaccctggtcaccgtctcctcagcctccaccaagggccccatcggtcttccccctggcgccctgctccaggngcacctccgagagcacagcggccctgggctgcctggtcaaggctactcctcgatcgcgtctgagcgggctggcaaggcgcatagnnnnn

SEQ ID NO: 293298 - DNA, 428 bp, Homo sapiens
  misc_feature: GYAE6OF01A1MKQ.45.60.F05.1.454.CMB.1.raw
  modified_base (422)..(428): a, c, t, g, unknown or other
  misc_feature (422)..(428): n is a, c, g, or t
tcagacgcgatcgacacgaccggtgctcgatttagtacgtcatcagggaaaggggctggagtgggtgggtctcattagaagcaaagcttctgggggacaacagactacgccgcgtctgtgaaaggcagattcaccatctcaagagatgattccaaaagtgtcgcccatctgcaaatgaacagcctgaaaaccgaggacacagccatgtattactgtactagaggggtagggtcgctgtccggtaactcccactactggggccagggaaccctggtcaccgtctcctcagcctccaccaagggcccatcggtcttcccctggcgccctgctccaggagcacctccgagagcacagcggcctgggctgcctggtcaaggactacttcctcgatcgcgtctgagcgggctggcaaggcgcatagnnnnnnn

SEQ ID NO: 293299 - DNA, 508 bp, Homo sapiens
  misc_feature: GYAE6OF01BYZ6G.45.60.F05.1.454.CMB.1.raw
  modified_base (254)..(254): a, c, t, g, unknown or other
  misc_feature (254)..(254): n is a, c, g, or t
  modified_base (480)..(480): a, c, t, g, unknown or other
  misc_feature (480)..(480): n is a, c, g, or t
  modified_base (497)..(497): a, c, t, g, unknown or other
  misc_feature (497)..(497): n is a, c, g, or t
tcagacgcgatcgacacgaccggtgctcgatttagtacgtcatcagggaaagggaaccatggaaaccccagcgcagcttctcttcctcctgctactctggctcccagataccaccggagaaattgtcttgacacagtctccagccattctgtctctctctccaggggagacagccaccctctcatgcagggccagtcgagagtattagaacatacttggcctggtatcaatacaagcctggccagggtccccgntcctcatctatgatgcttccagcagggccactggcatcccagccaggttccagtggcggtgggtttggcacagacttcactctcacaatcagcacgcctccaaaccctgaagattttgctagtctattactgtactaacagcgtacagattggccgctacacgtttcggcggaggaccgaaggtggagatacaaacgaactgtgctgacaccgagtctgtcttcgntcttcccgctactctanatcgagtccgg

SEQ ID NO: 293300 - DNA, 502 bp, Homo sapiens
  misc_feature: GYAE6OF01D30IP.45.60.F05.1.454.CMB.1.raw
  modified_base (409)..(409): a, c, t, g, unknown or other
  misc_feature (409)..(409): n is a, c, g, or t
tcagacgcgatcgacacgaccggtgctcgatttagtacgtcatcagggaaagggaaccatggaaaccccagcgcagcttctcttcctcctgctactctggctcccagataccaccggagaaattgtgttgacgcagtctccaggcaccctgtccttgtctccagggggaaagagccaccctctcctgcagggccagtcagactattactggcagctacttagcctggtaccagcagaacctggccagggtcccaggctcctcatctattatgcatccaacaggccactggcatccccagacaggttcagtggcagtgggtctgggacagacttcactctcacaatcagcagcctccaacctgaagtattttgcagtctattactgtacaacagcgtacagtatcggccnctctactttcggcggagggaccaagggtgagatacgaaacgtactgtggctgcacatctgtctcatcttcccgctatctgatcgatcgcgtcg

SEQ ID NO: 293301 - DNA, 437 bp, Homo sapiens
  misc_feature: GYAE6OF01DMRVW.45.60.F05.1.454.CMB.1.raw
  modified_base (430)..(437): a, c, t, g, unknown or other
  misc_feature (430)..(437): n is a, c, g, or t
tcagacgcgatcgacacgaccggtgctcgatttagtacgtcatcagggaaaggggctggagtgggtgggtctcattagaagcaaagcttctggggggacaacagactacgccgcgtctgtgaaaggcagattcaccatctcaagagatgattccaaaagtgtcgcccatctgcaaatgaacagcctgaaaaccgaggacacagccatgtattactgtactagaggggtaggtcgctgtccggtaactcccactactggggccagggaaccctggtcaccgtctcctcagcctccaccaaggcccatcggtccttccccctggccgccctgcctccaggacgccacctccgagacgcacagccggccctgggctgcctggtcaaggactacttcctcgatcgcgtctgagcgggctggcaaggcgcatagnnnnnnnn

SEQ ID NO: 293302 - DNA, 426 bp, Homo sapiens
  misc_feature: GYAE6OF01BPYF6.45.60.F05.1.454.CMB.1.raw
  modified_base (420)..(426): a, c, t, g, unknown or other
  misc_feature (420)..(426): n is a, c, g, or t
tcagacgcgatcgacacgaccggtgctcgatttagtacgtcatcagggaaaggggctggagtgggtgggtctcattagaagcaaagcttctggggggacaacagactacgccgcgtctgtgaaaggcagattcaccatctcaagagatgattccaaaagtgtcgcccatctgcaaatgaacagcctgaaaaccgaggacacagccatgtattactgtactagaggggtaggtcgctgtccggtaactcccactactggggccagggaaccctggtcaccgtctcctcagcctccaccaaggcccatcggtctcccctggcgccctgctccaggagcacctccgagagcacagcggccctgggctgcctggtcaaggctacttcctcgatcgcgtctgagcgggctggcaaggcgcatagnnnnnnn

SEQ ID NO: 293303 - DNA, 427 bp, Homo sapiens
  misc_feature: GYAE6OF01A518G.45.60.F05.1.454.CMB.1.raw
  modified_base (424)..(427): a, c, t, g, unknown or other
  misc_feature (424)..(427): n is a, c, g, or t
tcagacgcgatcgacacgaccggtgctcgatttagtacgtcatcagggaaaggggctggagtgggtgggtctcattagaagcaaagcttctggggggacaacagactacgccgcgtctgtgaaaggcagattcaccatctcaagagatgattccaaaagtgtcgcccatctgcaaatgaacagcctgaaaaccgaggacacagccatgtattactgtactagaggggtaggtcgctgtccggtaactcccactactggggccagggaaccctggtcaccgtctcctcagcctccaccaagggcccatcggtcttccccctggcgccctgctccaggagcacctccgagaacacagcggccctgggctgccctggtcaaggctacttcctcgatcgcgtctgagcgggctggcaaggcgcatagnnnn

SEQ ID NO: 293304 - DNA, 448 bp, Homo sapiens
  misc_feature: GYAE6OF01DZCQ5.45.60.F05.1.454.CMB.1.raw
  modified_base (438)..(448): a, c, t, g, unknown or other
  misc_feature (438)..(448): n is a, c, g, or t
tcagacgcgatcgacacgaccggtgctcgatttagtacgtcatcagggaaaggggctggagtgggtgggtctcattagaagcaaagcttctggggggacaacagactacgccgcgtctgtgaaaggcagattcaccatctcaagagatgattccaaaagtgtcgcccatctgcaaatgaacagcctgaaaaccgaggacacagccatgtattactgtactagaggggtaggtcgctgtccggtaactcccactactggggccagggaaccctggtcaccgtctcctcagcctccaccaagggccccatcggtcttccccctggccgccctgctccaggcgcacctcgagagcacacgccggcctgggctcgccgtggtacaaggacctacttcctcgactcgcgttctgacggcgggctgggacaaggcgacatacgnnnnnnnnnnn

SEQ ID NO: 293305 - DNA, 437 bp, Homo sapiens
  misc_feature: GYAE6OF01AIE9T.45.60.F05.1.454.CMB.1.raw
  modified_base (197)..(197): a, c, t, g, unknown or other
  misc_feature (197)..(197): n is a, c, g, or t
  modified_base (354)..(354): a, c, t, g, unknown or other
  misc_feature (354)..(354): n is a, c, g, or t
  modified_base (392)..(392): a, c, t, g, unknown or other
  misc_feature (392)..(392): n is a, c, g, or t
  modified_base (429)..(437): a, c, t, g, unknown or other
  misc_feature (429)..(437): n is a, c, g, or t
tcagacgcgatcgacacgaccggtgctcgatttagtacgtcatcagggaaaggggcgtggagtgggtgggtctcattagaagcaaagcttctggggggacaacagactacgccgcgtctgtgaaaggcagattcaccatctcaagagatgatttccaaaagtgtcgcccatctgcaaatgaacagcctgaaaaccgnggacacagccatgtattactgtactagaggggtagggtcgctgtccggtaactcccactactggggccagggaaccctggtcaccgtctcctcagcctccaccaagggccccatcggtcttccccctggccgccctgctccaggagcacctccgagngcacagcggcctgggctgcctggcaaggactacttccncgatcgcgtctgacggcgggctggcaaggcgcatagnnnnnnnnn

SEQ ID NO: 293306 - DNA, 593 bp, Homo sapiens
  misc_feature: GYAE6OF01A3J1R.45.60.F05.1.454.CMB.1.raw
  modified_base (197)..(197): a, c, t, g, unknown or other
  misc_feature (197)..(197): n is a, c, g, or t
  modified_base (537)..(537): a, c, t, g, unknown or other
  misc_feature (537)..(537): n is a, c, g, or t
  modified_base (539)..(539): a, c, t, g, unknown or other
  misc_feature (539)..(539): n is a, c, g, or t
  modified_base (541)..(546): a, c, t, g, unknown or other
  misc_feature (541)..(546): n is a, c, g, or t
  modified_base (549)..(550): a, c, t, g, unknown or other
  misc_feature (549)..(550): n is a, c, g, or t
  modified_base (555)..(555): a, c, t, g, unknown or other
  misc_feature (555)..(555): n is a, c, g, or t
  modified_base (558)..(558): a, c, t, g, unknown or other
  misc_feature (558)..(558): n is a, c, g, or t
  modified_base (560)..(560): a, c, t, g, unknown or other
  misc_feature (560)..(560): n is a, c, g, or t
  modified_base (562)..(562): a, c, t, g, unknown or other
  misc_feature (562)..(562): n is a, c, g, or t
  modified_base (564)..(564): a, c, t, g, unknown or other
  misc_feature (564)..(564): n is a, c, g, or t
  modified_base (566)..(566): a, c, t, g, unknown or other
  misc_feature (566)..(566): n is a, c, g, or t
  modified_base (568)..(569): a, c, t, g, unknown or other
  misc_feature (568)..(569): n is a, c, g, or t
  modified_base (571)..(571): a, c, t, g, unknown or other
  misc_feature (571)..(571): n is a, c, g, or t
  modified_base (573)..(574): a, c, t, g, unknown or other
  misc_feature (573)..(574): n is a, c, g, or t
  modified_base (578)..(578): a, c, t, g, unknown or other
  misc_feature (578)..(578): n is a, c, g, or t
  modified_base (581)..(581): a, c, t, g, unknown or other
  misc_feature (581)..(581): n is a, c, g, or t
  modified_base (583)..(583): a, c, t, g, unknown or other
  misc_feature (583)..(583): n is a, c, g, or t
  modified_base (585)..(587): a, c, t, g, unknown or other
  misc_feature (585)..(587): n is a, c, g, or t
  modified_base (589)..(590): a, c, t, g, unknown or other
  misc_feature (589)..(590): n is a, c, g, or t
tcagacgcgatcgacacgaccggtgctcgatttagtacgtcatcagggaaaggggctggggagtgggtgggtctcattagaagcaaaggcttctgggggacaacagactacgccgcgtctgtgaaaggcagattcaccatctcaagagatgattccaaaagtgtcgcccatctgcaaatgaacagcctgaaaaccgnggacacagccatgtattactgtactagaggggtaggtcgcgtgtccggtaactcccactactgggggcctagggaaccctgggtcaccggtctcctcagcctcaccaacgggccccaatcggtctttccccctggccgccccgtgcctccgaggacgccgaccgttccgagacgcctacacggccggcccctggggctcggccgtgggtaccaaacgggacccttaacctttcccgtaccggtaactttcccgggccggtttccgttacggaaccgggtcccggggtccgtttacggggaaccgaaaacggggccggtaccctaaagttaaggcagtcgngngnnnnnnganngtatntgngngngngngnngngnncgcncgncncnnncnncgc

SEQ ID NO: 293307 - DNA, 507 bp, Homo sapiens
  misc_feature: GYAE6OF01EV82A.45.60.F05.1.454.CMB.1.raw
  modified_base (351)..(351): a, c, t, g, unknown or other
  misc_feature (351)..(351): n is a, c, g, or t
  modified_base (450)..(451): a, c, t, g, unknown or other
  misc_feature (450)..(451): n is a, c, g, or t
  modified_base (453)..(454): a, c, t, g, unknown or other
  misc_feature (453)..(454): n is a, c, g, or t
  modified_base (456)..(457): a, c, t, g, unknown or other
  misc_feature (456)..(457): n is a, c, g, or t
  modified_base (459)..(459): a, c, t, g, unknown or other
  misc_feature (459)..(459): n is a, c, g, or t
  modified_base (462)..(464): a, c, t, g, unknown or other
  misc_feature (462)..(464): n is a, c, g, or t
  modified_base (470)..(470): a, c, t, g, unknown or other
  misc_feature (470)..(470): n is a, c, g, or t
  modified_base (472)..(473): a, c, t, g, unknown or other
  misc_feature (472)..(473): n is a, c, g, or t
  modified_base (476)..(476): a, c, t, g, unknown or other
  misc_feature (476)..(476): n is a, c, g, or t
  modified_base (479)..(479): a, c, t, g, unknown or other
  misc_feature (479)..(479): n is a, c, g, or t
  modified_base (481)..(481): a, c, t, g, unknown or other
  misc_feature (481)..(481): n is a, c, g, or t
  modified_base (484)..(487): a, c, t, g, unknown or other
  misc_feature (484)..(487): n is a, c, g, or t
  modified_base (489)..(490): a, c, t, g, unknown or other
  misc_feature (489)..(490): n is a, c, g, or t
  modified_base (492)..(492): a, c, t, g, unknown or other
  misc_feature (492)..(492): n is a, c, g, or t
  modified_base (494)..(497): a, c, t, g, unknown or other
  misc_feature (494)..(497): n is a, c, g, or t
  modified_base (499)..(502): a, c, t, g, unknown or other
  misc_feature (499)..(502): n is a, c, g, or t
  modified_base (504)..(504): a, c, t, g, unknown or other
  misc_feature (504)..(504): n is a, c, g, or t
  modified_base (506)..(506): a, c, t, g, unknown or other
  misc_feature (506)..(506): n is a, c, g, or t
tcagacgcgatcgacacgaccggtgctcgattttagtacgtcatcagggaaaggggacgtggagtgggtgggtctcattagaagcaaagccttctggggggacaacagactacgccgcgtctgtgaaaggcgagattcaccatctcaagagatgattcccaaaagtgttcgcccagtcctggcaaagtgaacagccttgaaaaccgaggacgacagccatgtattacgtgtactagaggggtaggttcgcgtgtccggtaactccactacgtggggccagggaaccctcggtcaccgtctcctcagcctcacaacggccatcggtctcccctgccgccctgctccaggacnccacgtccgagacgcacagccggcccctgggctgcctggtcaaggactaccgttcgcgatcgcgttctgagcgggactgggcgaaaggccagatacggnngnngnngngannngcgtgngnngcngcncncgnnnncnncncnnnncnnnngngng

SEQ ID NO: 293308 - DNA, 508 bp, Homo sapiens
  misc_feature: GYAE6OF01DV0YV.45.60.F05.1.454.CMB.1.raw
  modified_base (407)..(407): a, c, t, g, unknown or other
  misc_feature (407)..(407): n is a, c, g, or t
  modified_base (437)..(437): a, c, t, g, unknown or other
  misc_feature (437)..(437): n is a, c, g, or t
tcagacgcgatcgacacgaccggtgctcgatttagtacgtcatcagggaaagggaaccatggaaatcccagcgcagcttctcttcctcctgctactctggctcccagataccaccggagaaattgtgttgacgcagtctccaggcaccctgtctctgtctccaggggagacagccaccctctcctgcagggccagtaggagtgtcagtaagtacttaggctggtaccaacagaaacctggccaggctcccaggctcctcatccatgatgcatccaacagggtccctggccgtcccagacaggttccgtggcagtgggtctgggacagagttcactctcaccgtcagcagcctggacgcctgatgtattttgctagtttacttctgtcagcagcgttccgccacgccnctcacgtttcgggcggggaccagggtgagngtgagacgagtgtggctgcacatctgtccttcacttccttcccgctatctgactcgatcgcgtctggacgg

SEQ ID NO: 293309 - DNA, 466 bp, Homo sapiens
  misc_feature: GYAE6OF01A485Z.45.60.F05.1.454.CMB.1.raw
  modified_base (198)..(198): a, c, t, g, unknown or other
  misc_feature (198)..(198): n is a, c, g, or t
  modified_base (306)..(306): a, c, t, g, unknown or other
  misc_feature (306)..(306): n is a, c, g, or t
  modified_base (311)..(311): a, c, t, g, unknown or other
  misc_feature (311)..(311): n is a, c, g, or t
  modified_base (317)..(317): a, c, t, g, unknown or other
  misc_feature (317)..(317): n is a, c, g, or t
  modified_base (321)..(321): a, c, t, g, unknown or other
  misc_feature (321)..(321): n is a, c, g, or t
  modified_base (337)..(337): a, c, t, g, unknown or other
  misc_feature (337)..(337): n is a, c, g, or t
  modified_base (422)..(424): a, c, t, g, unknown or other
  misc_feature (422)..(424): n is a, c, g, or t
  modified_base (426)..(426): a, c, t, g, unknown or other
  misc_feature (426)..(426): n is a, c, g, or t
  modified_base (428)..(429): a, c, t, g, unknown or other
  misc_feature (428)..(429): n is a, c, g, or t
  modified_base (432)..(432): a, c, t, g, unknown or other
  misc_feature (432)..(432): n is a, c, g, or t
  modified_base (434)..(434): a, c, t, g, unknown or other
  misc_feature (434)..(434): n is a, c, g, or t
  modified_base (437)..(437): a, c, t, g, unknown or other
  misc_feature (437)..(437): n is a, c, g, or t
  modified_base (440)..(466): a, c, t, g, unknown or other
  misc_feature (440)..(466): n is a, c, g, or t
tcagacgcgatcgacacgaccggtgctcgatttagtacgtcatcagggaaaggggctgggagtgggtgggtctcattagaaggcaaagcttctggggggacaacagactacgccgcgtctgtgtaaaggcagattcaccatctcaagagatgattccaaaagtgtcgcccatctgcaaatgaacagcctgaaaaccgnggacacaggccatgtattactgtactagaggggtaggtcgctgtccggtaactccactactggggccagggaccctggtcaccgtctcctcagcctccacaggcccancggtntccccnggcnccctgctccaggtacncacctccgagagcacagccggccctgggctgcctggtcaaggctactctcgatcgcgtctgagcggctggcaacggcgcattagnnngntnntgnanctncgnnnnnnnnnnnnnnnnnnnnnnnnnnn

SEQ ID NO: 293310 - DNA, 815 bp, Homo sapiens
  misc_feature: GYAE6OF01BL7AK.45.60.F05.1.454.CMB.1.raw
  modified_base (172)..(172): a, c, t, g, unknown or other
  misc_feature (172)..(172): n is a, c, g, or t
  modified_base (275)..(275): a, c, t, g, unknown or other
  misc_feature (275)..(275): n is a, c, g, or t
tcagacgcgatcgacacgaccggtgctcgatttagtacgtcatcagggaaagggaaccatggaaaccccagcgcagcttctcttcctcctgctactctggctcccagataccaccggagaaattgtgttgacgcagtctccaggcaccctgtccttgtctccaggggaaagngccaccctctcctgcagggccagtcagactattactggcagctacttagcctggtaccagcagaaacctggccagggtcccaggcctccgtcatcgtattacngcatccaacgacgggccactggccactccccgagactaggttcaggtcggcaggtcgggtctacggggacagtacctttcaccgtcctacaccgaatccgacgaccaacggtaccgttacgggaacgtacccgtaggtaaaacgttacgtttttacgggaccttagggttacggtttaacgttttaaccgttacggttaacctaaaaccgttaggttaacgtttaccgggttaaccctttacccgttaaccccgttttttacccggtcccggtttttaccccgggtaccccggttacgggggtaaacccgtaaaacgggtttaccgggtaacctaacggttaacccgtaaaaccgggtaacgtttacgggtacccgggttactacggtacccttaacccgtaacgtttcccgttttacggttccctttttaaccgaaccgttttcccccgtttaacccccgtcccttaacgttttcccgttaacggttaccttttacgggtaaaccgtttcccggttaccggtttccggttaaccggggg

SEQ ID NO: 293311 - DNA, 504 bp, Homo sapiens
  misc_feature: GYAE6OF01E3GVF.45.60.F05.1.454.CMB.1.raw
  modified_base (357)..(357): a, c, t, g, unknown or other
  misc_feature (357)..(357): n is a, c, g, or t
  modified_base (365)..(365): a, c, t, g, unknown or other
  misc_feature (365)..(365): n is a, c, g, or t
  modified_base (458)..(458): a, c, t, g, unknown or other
  misc_feature (458)..(458): n is a, c, g, or t
tcagacgcgatcgacacgaccggtgctcgatttagtacgtcatcagggaaagggaaccatggaaaccccagcgcagcttctcttcctcctgctactctggctcccagataccaccggagaaattgtgttgacgcagtctccaggcaccctgtccttgtctccaggggaaagagccaccctctcctgcagggccagtcagactattactggcagctacttagcctggtaccagcagaaacctggccagggtcccaggctcctcatctattatgcatccaacagggccactggcatcccagacaggttcagtggcagtggtctgggacagacttcactctcaccatcagcagactggancctgaagnttttgctagtgtattactgtacaacagtatggtacctctacctttcgctttcggccctgggaccaagtgacatacaacgactgtggctgcacntctgtcttcattccttcccgcctatctgtatcgatcgcgtctacgg

SEQ ID NO: 293312 - DNA, 430 bp, Homo sapiens
  misc_feature: GYAE6OF01AB16R.45.60.F05.1.454.CMB.1.raw
  modified_base (234)..(234): a, c, t, g, unknown or other
  misc_feature (234)..(234): n is a, c, g, or t
  modified_base (425)..(430): a, c, t, g, unknown or other
  misc_feature (425)..(430): n is a, c, g, or t
tcagacgcgatcgacacgaccggtgctcgatttagtacgtcatcagggaaaggggctggagtgggtgggtctcattagaagcaaagcttctgggggacaacagactacgccgcgtctgtgaaaggcagattcaccatctcaagagatgattccaaaagtgtcgcccatctgcaaatgaacagcctgaaaaccgaggacacagccatgtattactgtactagaggggtagggtcnctgtccggtaactcccatactggggccagggaaccctggtcaccgtctcctcagcctccaccaagggccccatcggtcttccccctggcgccctgctccaggagcacctccgagagcacagcggccctgggctgcctggtcaaggactacttcctcgatcgcgtctgagcgggctggcaaggcgcatacgnnnnnn

SEQ ID NO: 293313 - DNA, 448 bp, Homo sapiens
  misc_feature: GYAE6OF01ARLW6.45.60.F05.1.454.CMB.1.raw
  modified_base (346)..(346): a, c, t, g, unknown or other
  misc_feature (346)..(346): n is a, c, g, or t
  modified_base (427)..(427): a, c, t, g, unknown or other
  misc_feature (427)..(427): n is a, c, g, or t
  modified_base (432)..(435): a, c, t, g, unknown or other
  misc_feature (432)..(435): n is a, c, g, or t
  modified_base (437)..(448): a, c, t, g, unknown or other
  misc_feature (437)..(448): n is a, c, g, or t
tcagacgcgatcgacacgaccggtgctcgatttagtacgtcatcagggaaaggggcgtggagtgggtgggtctcattagaagcaaagcttctggggggacaacagactacgccgcgtctgtgaaaggcagattcaccatcttcaagagatgatttccaaaagtgtcgcccatctgcaaatgaacagcctgaaaaccgaggacacagccatgtattactgtactagaggggtagggtcgctgtccggtaactcccatactggggccagggaaccctggtcaccgtctcctcagcctccaccaagggcccatcggtcttccccctggccgccctgcctccgagggacncacctccggagagcacagcggccctgggctgcctggtcaaggtactacttcctccctcgcgtctgagcgggctggcaggcncatgnnnncnnnnnnnnnnnn

SEQ ID NO: 293314 - DNA, 444 bp, Homo sapiens
  misc_feature: GYAE6OF01AXLS3.45.60.F05.1.454.CMB.1.raw
  modified_base (431)..(444): a, c, t, g, unknown or other
  misc_feature (431)..(444): n is a, c, g, or t
tcagacgcgatcgacacgaccggtgctcgatttagtacgtcatcagggaaaggggctggagtgggtgggtctcattagaagcaaagcttctggggggacaacagactacgccgcgtctgtgaaaggcagattcaccatctcaagagatgattccaaaagtgtcgcccatctgcaaatgaacagcctgaaaaccgaggacacagccatgtattactgtactagaggggtaggtcgctgtccggtaactcccactactggggccaggggaaccctggtcaccgtctcctcagcctccaccaagggcccatcggtcttcccctggccgccctgctccaggacgcacctccgagagcacagccggcctgggctgcctggtcaaggctacttcctcgatccgcgtctgaggccgggctgggcaagggcgcagtagnnnnnnnnnnnnnn

SEQ ID NO: 293315 - DNA, 553 bp, Homo sapiens
  misc_feature: GYAE6OF01B1EHQ.45.60.F05.1.454.CMB.1.raw
  modified_base (359)..(359): a, c, t, g, unknown or other
  misc_feature (359)..(359): n is a, c, g, or t
  modified_base (370)..(370): a, c, t, g, unknown or other
  misc_feature (370)..(370): n is a, c, g, or t
tcagacgcgatcgacacgaccggtgctcgatttagtacgtcatcagggaaagggaaccatggaaaccccagcgcagcttctcttcctcctgctactctggctcccagataccaccggagaaattgtgttgacgcagtctccaggcaccctgtccttgtctccaggggaaagagccaccctctcctgcagggccagtcagactattactggcagctacttagcctggtaccagcagaaacctggccagggtcccaggctcctcatctattatgcatccaacagggccactggcactcccagacaggttcagtgcagtgggtctgggacagtacttcactctcaccatcagcagactggancctagaacgtnttttgctagttgtacttactgtacaatagtagtcgtacctctacctttcgtcgtttccggcctagggaacctaaggtcgaactacgtaaccgaaacgtacgtgtacgctcgaccacctatctcgttccttacgtacttcccgttccctcctactctcgtactcgtactccggtcgtcgtcggg

SEQ ID NO: 293316 - DNA, 546 bp, Homo sapiens
  misc_feature: GYAE6OF01C13IN.45.60.F05.1.454.CMB.1.raw
  modified_base (197)..(197): a, c, t, g, unknown or other
  misc_feature (197)..(197): n is a, c, g, or t
  modified_base (238)..(238): a, c, t, g, unknown or other
  misc_feature (238)..(238): n is a, c, g, or t
  modified_base (510)..(510): a, c, t, g, unknown or other
  misc_feature (510)..(510): n is a, c, g, or t
  modified_base (513)..(546): a, c, t, g, unknown or other
  misc_feature (513)..(546): n is a, c, g, or t
tcagacgcgatcgacacgaccggtgctcgatttagtacgtcatcagggaaaggggctgggagtgggtgggtctcattagaagcaaagcttctggggggacaacagactacgccgcgtctgtgaaaggcagattcaccatctcaagagatgattccaaaagtgtcgcccatctgcaaatgaacagcctagaaaaccgnggacacagccatgtattactgtactaggaggggtggggtcnctgtccggtaactcccactacgtggggccagggaaccctggtcaccgtctcctcagcctccaccgaagggccccacttcggtcctttccccccgtggccgtccctgcctccgagggcgcctaccctccggagacgccacgacggccggccccgtggggcctcggcccgtttgggtaccaaacgggtacctaccgtttcccgtcgtactccggcgttcctgggacgggtccggggtacctggggaccgaaagggtccgactaagtaggctgancgnnnnnnnnnnnnnnnnnnnnnnnnnnnnnnnnnn

SEQ ID NO: 293317 - DNA, 460 bp, Homo sapiens
  misc_feature: GYAE6OF01DF5T3.45.60.F05.1.454.CMB.1.raw
  modified_base (196)..(196): a, c, t, g, unknown or other
  misc_feature (196)..(196): n is a, c, g, or t
  modified_base (216)..(216): a, c, t, g, unknown or other
  misc_feature (216)..(216): n is a, c, g, or t
  modified_base (346)..(346): a, c, t, g, unknown or other
  misc_feature (346)..(346): n is a, c, g, or t
  modified_base (443)..(443): a, c, t, g, unknown or other
  misc_feature (443)..(443): n is a, c, g, or t
  modified_base (449)..(460): a, c, t, g, unknown or other
  misc_feature (449)..(460): n is a, c, g, or t
tcagacgcgatcgacacgaccggtgctcgatttagtacgtcatcagggaaaggggctggagtgggtgggtctcattagaagcaaagcttctggggggacaacagactacgccgcgtctgtgaaaggcagattcaccatctcaagagatgattccaaaagtgtcgcccatctgcaaatgaacagcctagaaaaccgnggacacagccatgtattacngtactagaggggtaggtcgctgtccggtaactcccactacgtggggccagggaaccctggtccaccgtctcctcacgcctccaccaacgggcccatccggtccttccccctggccgccctgcctccaggngccacctccgagacgcacgacggccggccctggggctcggccctggcaaggacttacgttcctcgactcgcgttctgagcgggctggacaaggcganagtagnnnnnnnnnnnn

SEQ ID NO: 293318 - DNA, 805 bp, Homo sapiens
  misc_feature: GYAE6OF01ADIL3.45.60.F05.1.454.CMB.1.raw
  modified_base (172)..(172): a, c, t, g, unknown or other
  misc_feature (172)..(172): n is a, c, g, or t
  modified_base (209)..(209): a, c, t, g, unknown or other
  misc_feature (209)..(209): n is a, c, g, or t
tcagacgcgatcgacacgaccggtgctcgatttagtacgtcatcagggaaagggaaccatggaaacccaagcgcagcttctcttcctcctgctactctggctcccagataccaccggagaaattgtgttgacgcagtctccaggcaccctgtccttgtctccgaggggaaangcccaccctctcctgcagggccagtcagactattacnggcagctacttagcctggtaccagcagaacctggccagggtcccaggctcctcatctcgtggtgtatcctacgacgggccacgtggtcgtcccaggactaggttcaagggcaggtgggtcgtgggacaggtacgttcgaccttctacaaccgtatccgaaggccgggtcccttggacgtacggtttacgtaggtaaacgttagttttttacgggaaaccttttttagttaaccgtcggttaacgacgttaccgtaaaggtttaactaaacgttccgtaaaccggttccggggtacccggtttaaccgtttaaccgggtttttccggggggaacccccggggggttaaaccctaaacgggtccggttaacggggtaacggtaaaccgttaacccggaaaaaaccggttaccgtttacggggtacgggttacccgttacggtacccgtaaacccgtttaacgttccgtttaccggtttaccctttccgttaaacccgtttccccgtttacccccggtacctaacgttttccgtacggttaaccgttccgtaacgttcccggtacggttacccgtagggtacccgggtccggggtccgg

SEQ ID NO: 293319 - DNA, 457 bp, Homo sapiens
  misc_feature: GYAE6OF01CFOCF.45.60.F05.1.454.CMB.1.raw
  modified_base (444)..(457): a, c, t, g, unknown or other
  misc_feature (444)..(457): n is a, c, g, or t
tcagacgcgatcgacacgaccggtgctcgatttagtacgtcatcagggaaggggctggagtgggtgggtctcattagaagcaaagcttctggggggacaacagactacgccgcgtctgtgaaaggcagattcaccatctcaagagatgattccaaaagtgtcgcccatctgcaaatgaacagcctagaaaaccgaggacacagccatgtattactgtactaggaggggtagggtcgctgtccggtaactcccactacgtggggccagggaaccctggtcaccgtctcctcagcctccaccaagggccccatccggtccttccccctggccgccctcgcctcccgaggacgcacctccgagagcacaggcggccctggggctcgcctggtacaaggactacttcctcgactcgcgtctgacgcgggctggcaaggcgacatacgnnnnnnnnnnnnnn

SEQ ID NO: 293320 - DNA, 939 bp, Homo sapiens
  misc_feature: GYAE6OF01BCNQA.45.60.F05.1.454.CMB.1.raw
tcagacgcgatcgacacgaccggtgctcgatttagtacgtcatcagggaaagggaaccatggaaaccccagcgcagcttctcttcctcctggcactctggctcccagataccaccggagaaattgtgttgacacagtctccagccaccctgtctttgtttccaggggaaagagccaccctctcctgcgagggccagtcagggtgttaacagctacttagcctggtaaccaacaaaaactggccaggctccaggctcatcatctatgacgcatcgaacgacgggccaacgtcggcacgtccccgagccgtaagggtttcaaggttcgggaccgtagggttcgggtaccgttacggggaactaacggtacccgtttaccgaacccgttccttacccaaacccgtaacgttaccgaaacggtacccgtaaaccggtccccggttaaccggggtaacccccgttaggggtaaacgggtttaacgttttttacccgggaaccccttttaaacgttttttaaacccgttaaaccgtttcgggttaacccgtaacgggtacccggtaacgggttacccggggtttaccggggaaccccgggtaacccgggtaaccgggtcccggttaccccgtttacccgggttaacccgggtttttacccggggggaaccgggggtaaaccgggggtaaacccggttaaacgggggttaacgggaaacggttaaccggtaaaccgtaaaacgggttaacgttacggggttacggtacccgttacggtaacccgtaaccgttacgttaccggttaccggtttaccgtttaccgtacccgtttaccccgttacccccgtaccgttaccgtttccgttaaccgggtaccgttacccggttaacccgttcccgggtacccggtttaccggtacgggtaccggggtcccgggttaccggg

SEQ ID NO: 293321 - DNA, 551 bp, Homo sapiens
  misc_feature: GYAE6OF01A6W9Y.45.60.F05.1.454.CMB.1.raw
  modified_base (489)..(489): a, c, t, g, unknown or other
  misc_feature (489)..(489): n is a, c, g, or t
  modified_base (500)..(500): a, c, t, g, unknown or other
  misc_feature (500)..(500): n is a, c, g, or t
  modified_base (542)..(542): a, c, t, g, unknown or other
  misc_feature (542)..(542): n is a, c, g, or t
tcagacgcgatcgacacgaccggtgctcgatttagtacgtcatcagggaaagggaaccatggaaaccccagcgcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggctcccaggctcctcatccatgatgcatccaacgacgggtccctggccgtcccagacgaggttccgtggcaggtcgggtctcggggacaggtacgttcactctacgaccgtcagcagccgtggacgcctgagtgtattttgcttagtttactcgtgtcagctagtccgtccgcctacgccgtctctacggttcggggcgggggtaccgagggtggagagtggacgacgacgtgtcggctgcacgntcgtgtcttcnctccttcccgctactcgtgactcgtacgtcgcgtacgtcggnggcgggtcg

SEQ ID NO: 293322 - DNA, 583 bp, Homo sapiens
  misc_feature: GYAE6OF01A22AS.45.60.F05.1.454.CMB.1.raw
tcagacgcgatcgacacgaccggtgctcgatttagtacgtcatcagggaaagggaaccatggaaaccccagcgcagcttctcttcctcctgctactctggctcccagataccaccggagaaattgtgttgacgcagtctccaggcaccctgtccttgtctccaggggaaagagccaccctctcctgcagggccagtcagactattactggcagctacttagcctggtaccagcagaacctggccagggtcccaggctcctcatctattatgcatccaacagggccacgtggcactcccagacaggttcagtggcaggtgggtctgggacagacttcactctcaccatcagcagactggacgcctgtaagtattttgactagtgtattactgtacaactagttatcggtaccttctaccttttcgtcctttccggcccgttacgggtaaccgtaaggtcggtaactactaaccgaaaccgtaacgtggtacggtctcgaccacctacttccttgttccgttacgtactttcccgttaccccgtcctacgttcctacggtactcgtactcgtcggttcgtacggg

SEQ ID NO: 293323 - DNA, 664 bp, Homo sapiens
  misc_feature: GYAE6OF01D8XOF.45.60.F05.1.454.CMB.1.raw
  modified_base (173)..(173): a, c, t, g, unknown or other
  misc_feature (173)..(173): n is a, c, g, or t
tcagacgcgatcgacacgaccggtgctcgatttagtacgtcatcagggaaagggaaccatggaaaccccagcgcagcttctcttcctcctgctactctggctcccagataccaccggagaaattgtgttgacgcagtctccaggcaccctgtccttgtctccgagggggaaangccaccctctcctgcagggccagtcagactattactggcagctacttagcctggtaccagcaagaaacctggccagggtcccaggcctcctcatctattatgcactaccaacgacgggccacgtggccactcccagacaggttcaggtggcgtaggtgggtcgtgggaacaggtaccttcactctaccacctatcagcagtacgtcggacgtccgtagtaacgttattttcggacgttaggttagttaacgtttacgttagttactaaacgttagttacgttacggttacccttaccgttacccgtttcgttccgtttcccggtacccgttacgggtaacctaacggttcggaactaacgttaccgaaaacggtacgttcgttacggctacgacctacctacgttacgttcgttacctttacgtaccgtttcccttaccccggtcctacttccgtacgtacgttaccgtacgttccggtcgttcggtacgg

SEQ ID NO: 293324 - DNA, 559 bp, Homo sapiens
  misc_feature: GYAE6OF01CF2XA.45.60.F05.1.454.CMB.1.raw
  modified_base (329)..(329): a, c, t, g, unknown or other
  misc_feature (329)..(329): n is a, c, g, or t
  modified_base (335)..(335): a, c, t, g, unknown or other
  misc_feature (335)..(335): n is a, c, g, or t
  modified_base (520)..(520): a, c, t, g, unknown or other
  misc_feature (520)..(520): n is a, c, g, or t
  modified_base (523)..(524): a, c, t, g, unknown or other
  misc_feature (523)..(524): n is a, c, g, or t
  modified_base (526)..(559): a, c, t, g, unknown or other
  misc_feature (526)..(559): n is a, c, g, or t
tcagacgcgatcgacacgaccggtgctcgatttagtacgtcatcagggaaaggggctggagtgggtgggtctcattagaagcaaagcttctgggggacaacagactacgccgcgtctgtgaaaggcagattcaccatctcaagagatgattccaaaagtgtcgcccatctgcaaatgaacagcctagaaaaccgaggacacagccatgtattactgtactaggaggggtaggtcgctgtccggtaactcccactacgtggggccagggaaccctggtccaccggtctcctcacgcctccaccaacgggccccatccggtccttcccccnggtccncccctgcctccgaggacgcaccctccgagacgaccacgacggccggcccgtggggccctcgcccgtcgggtaccgaaacgggtaccttaacccgtttccccgtaccggaacttcccggaccggttcctagggacgggccgggggtccttggggacccgaaaggggcccgtaacgtaagttaaggncgnngnnnnnnnnnnnnnnnnnnnnnnnnnnnnnnnnnn

SEQ ID NO: 293325 - DNA, 498 bp, Homo sapiens
  misc_feature: GYAE6OF01D8ADB.45.60.F05.1.454.CMB.1.raw
  modified_base (486)..(498): a, c, t, g, unknown or other
  misc_feature (486)..(498): n is a, c, g, or t
tcagacgcgatcgacacgaccggtgctcgatttagtacgtcatcagggaaaggggctggagtgggtgggtctcattagaagcaaagcttctggggggacaacagactacgccgcgtctgtgaaaggcagattcaccatctcaagagatgattccaaaagtgtcgcccatctgcaaatgaacagcctagaaaaccgaggacacagccatgtattactgtactaggaggggtaggtcgctgtccggtaactcccactacgtggggccagggaaccctggtcaccgtctcctcacgcctccaccaacgggcccatccggtccttcccccgtggccgcccctggcctccgaggacgccacccgtccgagacgcacgacggccggcccgtggggcctcgccgtgggtaccaacgggtaccttaccgttccctacggacttccggccgttcgtggacgggccggggctcgggaccgaagggccgacgatagnnnnnnnnnnnnn

SEQ ID NO: 293326 - DNA, 680 bp, Homo sapiens
  misc_feature: GYAE6OF01C2YO2.45.60.F05.1.454.CMB.1.raw
  modified_base (641)..(641): a, c, t, g, unknown or other
  misc_feature (641)..(641): n is a, c, g, or t
  modified_base (643)..(649): a, c, t, g, unknown or other
  misc_feature (643)..(649): n is a, c, g, or t
  modified_base (651)..(680): a, c, t, g, unknown or other
  misc_feature (651)..(680): n is a, c, g, or t
tcagacgcgatcgacacgaccggtgctcgatttagtacgtcatcagggaaaggggctggagtgggtgggtctcattagaagcaaagcttctggggggacaacagactacgccgcgtctgtgaaaggcagattcaccatctcaagagatgattccaaaaagtgtcgcccatctgcaaatgaacagcctagaaaaccgaggacacagccatgtacttactgtaacgtaggaggggtagggtcgcgttcggtaccggtaacctccccgtactacggtcgggggacccgaacgggtaaccccgttggtacctacccgttcctcccctcgacgtccctacccaacccgaaacggggccccctaacggttcccggttacccctttcccccccgtgggccccgtccccgtcggtaccctccggaagggaccgtacccctaccccgttaccggaacggaccggacccaacggaccgggtcccgggtcccccggtaggggtcccgttccggtcccgtttaacgggtaaccgaaaaccgggtaccctttaccccgtttcccgtacggtaaccgttcccggaccggtttcgtaccgggaacgggtcccggggtacttacggggaaccgaaaggggcccgacgtaaagcggangnnnnnnngnnnnnnnnnnnnnnnnnnnnnnnnnnnnnn

SEQ ID NO: 293327 - DNA, 752 bp, Homo sapiens
  misc_feature: GYAE6OF01C6KZH.45.60.F05.1.454.CMB.1.raw
  modified_base (172)..(172): a, c, t, g, unknown or other
  misc_feature (172)..(172): n is a, c, g, or t
tcagacgcgatcgacacgaccggtgctcgatttagtacgtcatcagggaaagggaaccatggaaaccccagcgcagcttctcttcctcctgctactctggctcccagataccaaccggaaaaattgtgttgacacagtctccaggcaccctgtctctgtctccgaggggganacacgccaccctctcctgcgacgggccaggtaggagtgtcaagtaagtacttaggctggtaaccaaacagaaacctggaccaaggcctacccgaggtcctcctacactccatgatgacataccaacgtacggtccctggccgtaccagtacgtacgggttccgcggacgaggtcggtcgtaggggaccaggtacgttaccacgttccgtacgtaccggtacaacggcaacggtccgtagggacgtaccgtaggtacgtaggttacttttcgacgtttaacggttttaaccttcgtacggttaccaacggtaccgtaaccggttcccggtttaccccgacccgaccccggtccccggtaccttcccggttaacccggggttttaccgggggggacccgggggggtaacccgtaagggggttacgggaagtaaggttacgggaaacggtaacggtaacgttgggtacgggccgtacggacctaacgtacgttacgttcgttaccttaccgtaccttcccggttccccgtacgtattcgacgtacgtaccgtacgtccgtacgttcgacggtcggcgggtcgg

SEQ ID NO: 293328 - DNA, 695 bp, Homo sapiens
  misc_feature: GYAE6OF01CSMIG.45.60.F05.1.454.CMB.1.raw
  modified_base (180)..(180): a, c, t, g, unknown or other
  misc_feature (180)..(180): n is a, c, g, or t
  modified_base (224)..(224): a, c, t, g, unknown or other
  misc_feature (224)..(224): n is a, c, g, or t
  modified_base (656)..(656): a, c, t, g, unknown or other
  misc_feature (656)..(656): n is a, c, g, or t
tcagacgcgatcgacacgaccggtgctcgatttagtacgtcatcagggaaagggaaccatggaaaccccagcgcagcttctcttcctcctgctactctggcctcccagactaccgaccggaagtaaattgtgttgacgcagtctcgaggccaccctgtccttgtctaccgaaggggaaanacgcccaccctctccgtgcgacgggccagtcagtactattacgnggacagtctacgtacgccgtaggaccagacaacgaaccgtcggaccgacgggtcccgacggtcctacctactacttactaattacgcgacctaacaacccgaaacggcggaccctacgtcggacctaccgtacccgagtacgtacggtacgagtcggacgtaggtcggtacgacgggacacgtcttcacttcgacacatcacgcgacctccctaacgtaacgtagtaacgtttgttcagttattacttaactacgtacgtacaacgtacgtactaacgtagtacgtacggaccttacgtacgttacgggtcggaaccgggaaggaaccgtaagggtacgtaacgtaactaaccggaaacgttcggtaggtacaccgtacgaccgtactgttccgttagtacccgttacgtacccttaccccgtctaaccgtnttcgttacggacttaccggtacgtccggtacgtaccggg

SEQ ID NO: 293329 - DNA, 554 bp, Homo sapiens
  misc_feature: GYAE6OF01DDBC3.45.60.F05.1.454.CMB.1.raw
  modified_base (196)..(196): a, c, t, g, unknown or other
  misc_feature (196)..(196): n is a, c, g, or t
  modified_base (524)..(554): a, c, t, g, unknown or other
  misc_feature (524)..(554): n is a, c, g, or t
tcagacgcgatcgacacgaccggtgctcgatttagtacgtcatcagggaaaggggctggagtgggtgggtctcattagaagcaaagcttctggggggacaacagactacgccgcgtctgtgaaaggcagattcaccatctcaagagatgattccaaaagtgtcgcccatctgcaaatgaacagcctagaaaaccgnggacatagccatgtattactgtactaggaggggtaggtcgctgtccggtaactcccatacgtggggccagggaaccctggtcaccgtctccctcacgcctccaccgaagggccccagttccgggtccctttccccccgtgggcccgtccccgtcgcctcccgagggaccgcctaccctaccggacgacgccaccgacggcccggaccccgtggggccttcggccgttagggtaccgaacgggtacccttaccgtttacccgtcggtacgttccgccggttcgtagggacgggcccggggtctgggaccgaacgggccgacgtaatggnnnnnnnnnnnnnnnnnnnnnnnnnnnnnnn

SEQ ID NO: 293330 - DNA, 535 bp, Homo sapiens
  misc_feature: GYAE6OF01ETQM0.45.60.F05.1.454.CMB.1.raw
  modified_base (502)..(535): a, c, t, g, unknown or other
  misc_feature (502)..(535): n is a, c, g, or t
tcagacgcgatcgacacgaccggtgctcgatttagtacgtcatcagggaaaggggctggagtgggtgggtctcattagaagcaaagcttctggggggacaacagactacgccgcgtctgtgaaaggcagattcaccatctcaagagatgattccaaaagtgtcgcccatctgcaaatgaaacagccctagaaaaccgaggacacagccatgtaattactgtacaggaggggtagggtcgctgtcccggtaactcccactacgtggggccagggaccctggtccaccgtctcctcacgcctccaccaacgggccccagtccggtaccttcccccgtgggccgtccccgtcgcctcccgaggacgcctaccctccggagacgcaaccacggccggccccgtcggggcctcggcccgtgggtaccgaaggaccttaccttacctacgtcgtacttacggtctggacggtccgggtctcgggaccgaacgggccgacaagtagcgnnnnnnnnnnnnnnnnnnnnnnnnnnnnnnnnnn

SEQ ID NO: 293331 - DNA, 533 bp, Homo sapiens
  misc_feature: GYAE6OF01EKJZ5.45.60.F05.1.454.CMB.1.raw
  modified_base (249)..(249): a, c, t, g, unknown or other
  misc_feature (249)..(249): n is a, c, g, or t
  modified_base (292)..(292): a, c, t, g, unknown or other
  misc_feature (292)..(292): n is a, c, g, or t
  modified_base (294)..(294): a, c, t, g, unknown or other
  misc_feature (294)..(294): n is a, c, g, or t
  modified_base (297)..(297): a, c, t, g, unknown or other
  misc_feature (297)..(297): n is a, c, g, or t
  modified_base (483)..(483): a, c, t, g, unknown or other
  misc_feature (483)..(483): n is a, c, g, or t
  modified_base (485)..(485): a, c, t, g, unknown or other
  misc_feature (485)..(485): n is a, c, g, or t
  modified_base (491)..(491): a, c, t, g, unknown or other
  misc_feature (491)..(491): n is a, c, g, or t
  modified_base (495)..(496): a, c, t, g, unknown or other
  misc_feature (495)..(496): n is a, c, g, or t
  modified_base (498)..(498): a, c, t, g, unknown or other
  misc_feature (498)..(498): n is a, c, g, or t
  modified_base (501)..(502): a, c, t, g, unknown or other
  misc_feature (501)..(502): n is a, c, g, or t
  modified_base (504)..(504): a, c, t, g, unknown or other
  misc_feature (504)..(504): n is a, c, g, or t
  modified_base (506)..(510): a, c, t, g, unknown or other
  misc_feature (506)..(510): n is a, c, g, or t
  modified_base (512)..(514): a, c, t, g, unknown or other
  misc_feature (512)..(514): n is a, c, g, or t
  modified_base (517)..(531): a, c, t, g, unknown or other
  misc_feature (517)..(531): n is a, c, g, or t
  modified_base (533)..(533): a, c, t, g, unknown or other
  misc_feature (533)..(533): n is a, c, g, or t
tcagacgcgatcgacacgaccggtgctcgatttagtacgtcatcagggaaaggggctggagtgggtgggtctcattagaagcaaagcttctggggggacaacagactacgccgcgtctgtgaaaggcagattcaccatctcaagagatgattccaaaagtgtcgcccatctgcaaatgaacagcctagaaaaccgaggacacagccatgtattactgtactaggagggtaggtcgctcgtccggtaacncccactacgtcgggcgacggaccgtcgtcgaccgtcctcctcncnccnccaccgaaccggccacgtccgttcctccccgtccggccgcccctcgcgtcccgacggacgccaccgtcgacgacgcacgacgccgccgtcggctcgcgtcggacgtacgtactacctcgtaccgtcgtcgtcgtacgtgcgggtcggccgtagggtaccgaaggggaccgcgtaagtacgagcgtnancggtancgannancgnngngnnnnncnnncgnnnnnnnnnnnnnnngn

SEQ ID NO: 293332 - DNA, 565 bp, Homo sapiens
  misc_feature: GYAE6OF01DTHB7.45.60.F05.1.454.CMB.1.raw
  modified_base (196)..(196): a, c, t, g, unknown or other
  misc_feature (196)..(196): n is a, c, g, or t
  modified_base (527)..(527): a, c, t, g, unknown or other
  misc_feature (527)..(527): n is a, c, g, or t
  modified_base (529)..(565): a, c, t, g, unknown or other
  misc_feature (529)..(565): n is a, c, g, or t
tcagacgcgatcgacacgaccggtgctcgatttagtacgtcatcagggaaaggggctggagtgggtgggtctcattagaagcaaagcttctggggggacaacagactacgccgcgtctgtgaaaggcagattcaccatctcaagagatgattccaaaagtgtcgcccatctgcaaatgaacagcctagaaaaccgnggacacagccatgtattactgtactagaggggtagggtcgctgtccggtaactcccactacgtggggccagggaaccctggtcaccgtctccctcacgccctaccaaccgaacgggccccacgttccggttcccctttcccccgtggcccgcccgtcggcctcccgagggcaccctacccgtaccggagacgccaaccgacggcccggccccgtgggcctcggtcccgtgggtaaccgaacggtaccttacccgtttcccgtacgacgtccggtcgttcgtaggacgggcccggggtcgtcgggaccgaaagggtccgacgtaagtacggngnnnnnnnnnnnnnnnnnnnnnnnnnnnnnnnnnnnnn

SEQ ID NO: 293333 - DNA, 620 bp, Homo sapiens
  misc_feature: GYAE6OF01B50Q0.45.60.F05.1.454.CMB.1.raw
  modified_base (172)..(172): a, c, t, g, unknown or other
  misc_feature (172)..(172): n is a, c, g, or t
  modified_base (182)..(182): a, c, t, g, unknown or other
  misc_feature (182)..(182): n is a, c, g, or t
  modified_base (209)..(209): a, c, t, g, unknown or other
  misc_feature (209)..(209): n is a, c, g, or t
  modified_base (286)..(286): a, c, t, g, unknown or other
  misc_feature (286)..(286): n is a, c, g, or t
  modified_base (355)..(355): a, c, t, g, unknown or other
  misc_feature (355)..(355): n is a, c, g, or t
tcagacgcgatcgacacgaccggtgctcgatttagtacgtcatcagggaaagggaaccatggaaaccccagcgcagcttctcttcctcctgctactctggcctcccagataccaccggagaaattgtgttgacgcagtctccaggcaccctgtccttgtctccaggggaaangcccaccctntcctgcagggccagtcagactattacnggcagctacttagcctggtaccagcaagaacctggccagggtcccaggcctcctcatctatatcgcatcccaaacgngggccactggccactcccgagacgtgtcagtcggctaggtcggtctggacagacttcgaactctcactntcgagcagacgtggacgtcctagaagtctttcgacgttagtgttacgttactgtactaagtacgtaagttcggtaaccttcgttacccgtttcgttccgtttccggtcccgtagggaacccgtaaagtcgggaacctaagtaccgtaaacggtaacgttggacgtacctacggacctaacctggtccttacggtccttaccgtacttcccgttaccccggtctacgttcctaggtaccttaccgtaatccgtccgttgtaacggg

SEQ ID NO: 293334 - DNA, 688 bp, Homo sapiens
  misc_feature: GYAE6OF01AX4VO.45.60.F05.1.454.CMB.1.raw
  modified_base (170)..(170): a, c, t, g, unknown or other
  misc_feature (170)..(170): n is a, c, g, or t
  modified_base (265)..(265): a, c, t, g, unknown or other
  misc_feature (265)..(265): n is a, c, g, or t
  modified_base (334)..(334): a, c, t, g, unknown or other
  misc_feature (334)..(334): n is a, c, g, or t
tcagacgcgatcgacacgaccggtgctcgatttagtacgtcatcagggaaagggaaccatggaaaccccagcgcagcttctcttcctcctgctactctggctcccagataccaccggagaaattgtgttgacgcagtctccaggcaccctgtctctgtctccgagggganacagcccaccctctcctgccagggccagtaggagtgtcagtaagtacttaggctggtaccaacagaaacctggccaggcctcccgaggcctcctnactccatgatgcatcccgaacgtacgggtcccctagggccgtaccccgaaggaccgtacgggttcccgnggactagggttgggtccgtaggggactaggtcgttacccacccgtcgaccgtacagccacgtccgtggacgtccgtgtaagtgttacttttcggctttacgtttactcgtgtacagtcgtacgtccgtccgccgtacccgccgtcctaccggttaccggttccgggggaccgggggtacggtacggggtacggaggtacggtacggaacgggtaacggtacgtacgggtcggtacgtaccggaccgtaccgtagttaccgttcgttaccttccgtaccgttcccgttcccgaccttagttccgtacgtaccgtccgtaccgtcggtacccgttgaccgggtcggtccgggtcgg

SEQ ID NO: 293335 - DNA, 786 bp, Homo sapiens
  misc_feature: GYAE6OF01C3WOP.45.60.F05.1.454.CMB.1.raw
tcagacgcgatcgacacgaccggtgctcgatttagtacgtcatcagggaaagggaaccatggaaaccccagcgcagcttctcttcctcctgctactctggctcccagataccaccggagaaattgtgtgacgcagtctccaggcaccctgtccttgtctccgaggggaaagagcccaccctctcctgcagggccagtcagactattacgtggcagctacttacgcctggtaccagacaacgaaacctggaccgacgggtcccaggccttcctacacttctattactcgactactaccaacgacgggaccacgtcggacactacccgagacgtcggttacgaggtcggcgtagggtcgggtacgtggggaacttacgtaccgtttacaccttccgtacctaccgaactaccgacggaccgaacggtccggtagggaccgtccgttaaggtaaacggtttacgttttacggacgttaggttacgtttaacgttaacgttcggtaacctaaacgttaaggttacgttacggttaaccctttccgttacccgttttccggtcccgttttaccccgggcccggttaacgggtaacccttaaacgggtacggtaaccgtaaacgttaaccgaaaacggttacgttgggtacggtaccgttacgacccgttaaccgtaccgttaccgttacggtttacccttaccgttaccgtttaccccgttacccccgtacgttaccgttaccgttaggtacccgttaccggtacgttcccggtcccgggttgtaccgggg

SEQ ID NO: 293336 - DNA, 780 bp, Homo sapiens
  misc_feature: GYAE6OF01D2U30.45.60.F05.1.454.CMB.1.raw
  modified_base (331)..(331): a, c, t, g, unknown or other
  misc_feature (331)..(331): n is a, c, g, or t
  modified_base (767)..(767): a, c, t, g, unknown or other
  misc_feature (767)..(767): n is a, c, g, or t
tcagacgcgatcgacacgaccggtgctcgatttagtacgtcatcagggaaagggaaccatggaaaccccagcgcagcttctcttcctcctgctactctggctccagataccaccggaaaaattgtgttgacacagtctccaggcaccctgtctctgtctccgaggggagacagccaccctctcctgcagggccaggtaggagtgtcagtaagtacttaggctggtaaccaacacgaaacctggaccaggcctcccaggcctcctcactccatgactgacactccgaaacgtcgggttccctggccgtaccccaggacgtacgggtttccgngggcgtagggttcgggtcgtgggaactaggtacgtttccaaccttccgtaccgacccgtcgaacgccgtacggtcccggttgggaccgtccttagggtaacttcggtttaacgtttttcggaccgtttaacggttttttaaccgttccgttaggttacgtacggtaccgtaaccggttccccggtttaccccgacccgtaccccggtcccgtaccgttacccggttaacccgggtttcccgggggggacccggggggttaacccgtacggggggttacgggtacgtacggtacggaacggtaacccggtaacggttgggtacggtcgtcggacccgtaccgtacgttccgttcggttaccctttaccgtaccgttcccgttaccccgcttaccttcggttacgtacgtcggtacgtccggttaccgtgtaccgggngggtcccgggtcg

SEQ ID NO: 293337 - DNA, 441 bp, Homo sapiens
  misc_feature: GYAE6OF01AP125.45.60.F05.1.454.CMB.1.raw
  modified_base (194)..(194): a, c, t, g, unknown or other
  misc_feature (194)..(194): n is a, c, g, or t
  modified_base (323)..(323): a, c, t, g, unknown or other
  misc_feature (323)..(323): n is a, c, g, or t
  modified_base (424)..(441): a, c, t, g, unknown or other
  misc_feature (424)..(441): n is a, c, g, or t
tcagacgcgatcgacacgaccggtgctcgatttagtacgtcatcagggaaggggctggagtgggtgggtctcattagaagcaaagcttctggggggacaacagactacgccgcgtctgtgaaaggcagattcaccatctcaagagatgattccaaaagtgtcgcccatctgcaaatgaacagcctgaaaaccgnggacacagccatgtattacctgtactagaggggtaggtcgctgtccggtaactcccactactggggccagggaaccctggtcaccgtctcctcacgcctccaccaacgggccccatcggtcttcccccnggcgccctgctccaggcgcacctcgagagcacagcgcccgtgggctgcctggtcaaggctactcctcgatcgcgtctgacgcgggctggcaggcacatagnnnnnnnnnnnnnnnnnn

SEQ ID NO: 293338 - DNA, 593 bp, Homo sapiens
  misc_feature: GYAE6OF01AO7ZP.45.60.F05.1.454.CMB.1.raw
  modified_base (145)..(145): a, c, t, g, unknown or other
  misc_feature (145)..(145): n is a, c, g, or t
  modified_base (557)..(557): a, c, t, g, unknown or other
  misc_feature (557)..(557): n is a, c, g, or t
  modified_base (561)..(561): a, c, t, g, unknown or other
  misc_feature (561)..(561): n is a, c, g, or t
  modified_base (564)..(566): a, c, t, g, unknown or other
  misc_feature (564)..(566): n is a, c, g, or t
  modified_base (568)..(593): a, c, t, g, unknown or other
  misc_feature (568)..(593): n is a, c, g, or t
tcagacgcgatcgacacgaccggtgctcgatttagtacgtcatcagggaaaggggctggagtgggtgggtctcattagaagcaaagcttctggggggacaacagactacgccgcgtctgtgaaaggcagattcaccatctcaagngatgattccaaaagtgtcgcccatctgacaaatgaacagcctagaaaccgaggacacagccatgtacttactgtactaggaggggtaggtcgctgtaccggtaactcccgataccgtggggacctacggggaacccttcgggtacctaccgtcctcctcgacgccctacccgaccaacggggccccctagtcccggttccccttcccccgtacgggcccgtcccctcggcctcccgagggtccgccaccctccggacgtacgccacgacggccggccccttggggctccggccgtacggtccgaaaggacccttacccgttcctaccggacttccccggcggttaccgtggtacccgggtcggggtacccgttggggaccccgttaagggccgtacggtaaacgtggcacgngtcngcnnngnnnnnnnnnnnnnnnnnnnnnnnnnn

SEQ ID NO: 293339 - DNA, 813 bp, Homo sapiens
  misc_feature: GYAE6OF01CDRR5.45.60.F05.1.454.CMB.1.raw
  modified_base (172)..(172): a, c, t, g, unknown or other
  misc_feature (172)..(172): n is a, c, g, or t
tcagacgcgatcgacacgaccggtgctcgatttagtacgtcatcagggaaagggaaccatggaaaccccagcgcagcttctcttcctcctgctactctggctcccagataccaccggagaaattgtgttgacgcagtctccaggcaccctgtccttgtctccgaggggaaangcccaccctctcctgcagggccagtcagactattactggcagctactagcctggtaccagcaagaacctggccacgggtcccaggcctcctcatctattatcgacactaccaacgacgggcctacgtcggacacgtcccgaggaccgtacggtttcgaggtcggacgtagggttcgggtccgtacggggaactacggtaccttaccgaaccttccgtaccaacccgtaactaccgaacggtccgaacggtaccggttacgggtacgtacccgttaagggtaaacgtttacgtttttacggacgttaagggtttacgtttaacgtttaaccgttacgttaaccgtaaaacgttaacggtttaaacggtttacccgggtttaaccctttacccgtttaaccccgtttttccgggtttacccggttttaccccgggtaccccggtttaaccgggggtaaaacccgttaaacgggttaccgggtaaacccgttaaacgttaaacccggtaaaaccggttaccggttacgggtaccggtaccgttaccgtaccgtaaccccttagttccgttacgttacctttacccgtaccttcccgttacccgtccgtacttcgtacgtacgtccgtatccgtcgtcgtacggg

SEQ ID NO: 293340 - DNA, 521 bp, Homo sapiens
  misc_feature: GYAE6OF01AWQEL.45.60.F05.1.454.CMB.1.raw
  modified_base (195)..(195): a, c, t, g, unknown or other
  misc_feature (195)..(195): n is a, c, g, or t
  modified_base (332)..(332): a, c, t, g, unknown or other
  misc_feature (332)..(332): n is a, c, g, or t
  modified_base (355)..(355): a, c, t, g, unknown or other
  misc_feature (355)..(355): n is a, c, g, or t
  modified_base (358)..(358): a, c, t, g, unknown or other
  misc_feature (358)..(358): n is a, c, g, or t
  modified_base (483)..(484): a, c, t, g, unknown or other
  misc_feature (483)..(484): n is a, c, g, or t
  modified_base (486)..(521): a, c, t, g, unknown or other
  misc_feature (486)..(521): n is a, c, g, or t
tcagacgcgatcgacacgaccggtgctcgatttagtacgtcatcagggaagggggctggagtgggtgggtctcattagaagcaaagcttctggggggacaacagactacgccgcgtctgtgaaaggcagattcaccatctcaagagatgattccaaaagtgtcgcccatctgcaaatgaacagcctgaaaaccgnggacacagccatgtattactgtactagaggggtaggtcgctgtccggtaacctcccacgtacgtggggccaggggaaccctggtccaccgttcctcctcacgcctccaccgaagggcccatccggtccttcccccgnggtccgccctgcctccgaggacnccncctccgagacgcaccgagcccggccctggggcctcgcccgtggtacaagggtccttacgttcccgtcgatcccggcgttcgtcggaggtccgggcttagggaccaaagggtcgactaagtacggnngnnnnnnnnnnnnnnnnnnnnnnnnnnnnnnnnnnnn

SEQ ID NO: 293341 - DNA, 531 bp, Homo sapiens
  misc_feature: GYAE6OF01BBBBL.45.60.F05.1.454.CMB.1.raw
  modified_base (492)..(492): a, c, t, g, unknown or other
  misc_feature (492)..(492): n is a, c, g, or t
  modified_base (499)..(507): a, c, t, g, unknown or other
  misc_feature (499)..(507): n is a, c, g, or t
  modified_base (509)..(510): a, c, t, g, unknown or other
  misc_feature (509)..(510): n is a, c, g, or t
  modified_base (512)..(531): a, c, t, g, unknown or other
  misc_feature (512)..(531): n is a, c, g, or t
tcagacgcgatcgacacgaccggtgctcgatttagtacgtcatcagggaaggggctggagtgggtgggtctcattagaagcaaagcttctgggggggacaacagactacgccgcgtctgtgaaaggcagattcaccatctcaagagatgattccaaaagtgtcgcccatctgcaaatgaacagcctgaaaaccgaggacacagccatgtattactgtactagaggggtagggtcgctgtccggtaactcccactacgtggggccagggaaccctggtcaccgtctcctcagcctccacaagggccatcggtcctccccctggccgccctgctccaggacgccaccgtccgagagccacacggccggccccgtggggcctcggcccgtgggtccgaaggtaccttaccttcccgtacggacttcccggtcggttccgttggacgggacccggggtcttcggggaccgtaaacggggccgccgtaaagtacggncgcagtnnnnnnnnngnngnnnnnnnnnnnnnnnnnnnn

SEQ ID NO: 293342 - DNA, 497 bp, Homo sapiens
  misc_feature: GYAE6OF01BF497.45.60.F05.1.454.CMB.1.raw
  modified_base (348)..(348): a, c, t, g, unknown or other
  misc_feature (348)..(348): n is a, c, g, or t
  modified_base (470)..(470): a, c, t, g, unknown or other
  misc_feature (470)..(470): n is a, c, g, or t
  modified_base (472)..(497): a, c, t, g, unknown or other
  misc_feature (472)..(497): n is a, c, g, or t
tcagacgcgatcgacacgaccggtgctcgatttagtacgtcatcagggaaaggggctggagtgggtgggtctcattagaagcaaagcttctggggggacaacagactacgccgcgtctgtgaaaggcagattcaccatctcaagagatgattccaaaagtgtcgcccatctgcaaatgaacagcctgaaaaccgaggacacagccatgtattactgtactaggaggggtaggtcgctgtccggtaactcccactacgtggggccacgggaccctggtcaccgtctcctcacgcctccaccacgggcccagtccggtccttcccccgtggccgccctgcctccgaggcnccacctccgagacgacaccgagccggtcccgtgggcctcggccctggtacgaaacggtcctaccgttccgtcgtacgtccgacggtctaggacggcgggtcgtggactagggccgcagtagnannnnnnnnnnnnnnnnnnnnnnnnnn

SEQ ID NO: 293343 - DNA, 781 bp, Homo sapiens
  misc_feature: GYAE6OF01BU5TU.45.60.F05.1.454.CMB.1.raw
  modified_base (210)..(210): a, c, t, g, unknown or other
  misc_feature (210)..(210): n is a, c, g, or t
tcagacgcgatcgacacgaccggtgctcgatttagtacgtcatcagggaaagggaaccatggaaaccccagcgcagcttctcttcctcctgctactctggctcccagataccaccggagaaattgtgttgacgcagtctccaggcaccctgtccttgtctccgaggggaaagcgccaccctctcctgcgagggccagtcagactattacnggacagtctacttacgcctaggtaccagcaacgaaccgtggaccgacgggtcccaggtcctacctcattctattagtcgctactaccaacgtacgggacctacgtcggaccacgtccccgaagtaccgtaggttacagggtcggacgtacgggttcgggtacgttacgggggaacctaacgtacctttccgacctttaccgtacccaacctaacgtaccgaacgtaccgaacggtaacgtacgggtaccggtaccgttacggtaaacggtttacttttaccggacggttaacggttaggtttaacctttaacgttacgttaacctaacggttaacggttaacggttacccgggttaaccctttacccgttaccccgttttcgggttacccggttttcccgggtacccggttaacgggtaaccgtaacgggtacggtaacgtaacgtaacccgaaacgtacgttcgggtacggtcctacgaccactacgttcgttaccttccgttctaccgttcccgttacccgtccttacgtcccgttacgtaacgtcgtacgttcgtccggtgtacgggg

SEQ ID NO: 293344 - DNA, 683 bp, Homo sapiens
  misc_feature: GYAE6OF01DOX7S.45.60.F05.1.454.CMB.1.raw
  modified_base (204)..(204): a, c, t, g, unknown or other
  misc_feature (204)..(204): n is a, c, g, or t
  modified_base (603)..(603): a, c, t, g, unknown or other
  misc_feature (603)..(603): n is a, c, g, or t
  modified_base (610)..(610): a, c, t, g, unknown or other
  misc_feature (610)..(610): n is a, c, g, or t
  modified_base (619)..(619): a, c, t, g, unknown or other
  misc_feature (619)..(619): n is a, c, g, or t
  modified_base (622)..(622): a, c, t, g, unknown or other
  misc_feature (622)..(622): n is a, c, g, or t
  modified_base (627)..(627): a, c, t, g, unknown or other
  misc_feature (627)..(627): n is a, c, g, or t
  modified_base (634)..(634): a, c, t, g, unknown or other
  misc_feature (634)..(634): n is a, c, g, or t
  modified_base (640)..(640): a, c, t, g, unknown or other
  misc_feature (640)..(640): n is a, c, g, or t
  modified_base (650)..(650): a, c, t, g, unknown or other
  misc_feature (650)..(650): n is a, c, g, or t
  modified_base (654)..(654): a, c, t, g, unknown or other
  misc_feature (654)..(654): n is a, c, g, or t
  modified_base (674)..(674): a, c, t, g, unknown or other
  misc_feature (674)..(674): n is a, c, g, or t
  modified_base (676)..(676): a, c, t, g, unknown or other
  misc_feature (676)..(676): n is a, c, g, or t
tcagacgcgatcgacacgaccggtgctcgatttagtacgtcatcagggaaaaggggctggagtgggtgggtctcattagaagcaaagcttcgtgggggacaacagactacgccgcgtctgtgaaaggcagattcaccatctcaagagatgattaccaaaagtgtccgcccatctgacaaatgaacagcctaacggaaaaaccgnggaacacgacgcctagttgttaacttacttggtaacgttaggggaaggggtcgggtcgcgtttcggtacccggtaacctcccgacgtacggtacggggaccgtaacgggtaaccctcggtccgtaccggttcctcccgtactaccgccctaccgaaccggaaccggccctacgttcccggtcccttccccgtcggtccgtcccgtcgtccgtccgtacggccgaccgtacccgtccggaagaccgccaacgaccggtcccggaccggtcgggtacccgtcggtaccggtcgtaaccgtaacggtacctttaccggttccaccggttacgtccggtcggtacgtcgggaccgggtccgggtacggtaccgggacggtaacggaccgtacgtacgtacgcncgtgcgngcgcgcgancgngcgcngtgtgcncgcgcngtcgcgtagncgcncgcggggtagtacgctcgcngntgtcgcg

SEQ ID NO: 293345 - DNA, 728 bp, Homo sapiens
  misc_feature: GYAE6OF01ESI5D.45.60.F05.1.454.CMB.1.raw
  modified_base (183)..(183): a, c, t, g, unknown or other
  misc_feature (183)..(183): n is a, c, g, or t
  modified_base (241)..(241): a, c, t, g, unknown or other
  misc_feature (241)..(241): n is a, c, g, or t
tcagacgcgatcgacacgaccggtgctcgatttagtacgtcatcagggaaaggggctggagtgggtgggtctcattagaagcaaagcttctgggggacaacagactacgccgcgtctgtgaaaggcagattcaccatctcaagagatgattccaaaagtgtccgcccatctgacaaatgaacngcctagaaacccgaggacacagcctaagtgtatacctgtaacgtaggagggtaggtcncgttagtccggtaactcccgagtacgcggaccgaggtaccctggaccaccgtcgtcctacacgtcctacccgaacgaacggggtcccccaagttccccggttcccgtttacccccccggtgggaccccgtaccccgtacgtccgtaccccggaagggtaccgtaccctaccccgttacgggactacggacccgtaacgacgggacccggtacccgttggggaccctaccgtcggttacgactaacggtaccttaaccgtcccgtacgtaacgtccgacggttcgtaggaccggtaccgggtacgtccggtaccggaacggtaccgtaaccgtacgttaaccgtgtacgacgttaccgaggtcctagacggttctaacgcgaccgagtcgtacgtacgcgtacgacgtcgtaacttcggaatccggtgttaccggtacacggtaccgtacgtacgtcgtaacgttaccgtagtacctagtcggttacg

SEQ ID NO: 293346 - DNA, 832 bp, Homo sapiens
  misc_feature: GYAE6OF01CKQ7Z.45.60.F05.1.454.CMB.1.raw
  modified_base (419)..(419): a, c, t, g, unknown or other
  misc_feature (419)..(419): n is a, c, g, or t
tcagacgcgatcgacacgaccggtgctcgatttagtacgtcatcagggaaagggaaccatggaaaccccagcgcagcttctcttcctcctgctactctggctcccagataccaccggagaattgtgttgacgcagtctccaggcaccctgtccttgtctaccgaggggaaagacgcccaccctctcctgcagggccagtcagactattactggcagtctacttacgcctacggtaccagacaagaaaccgtgggacccgtacgggtcccgacggtccttacctacgtacttaccgttaattacgtcgacctaacgtacccgaaaccgaccggggtacctaacgtcggacctaccgtaccccgacgaaccgttaggtaccgtaggtacggcgtaggggttacgggtcgtaggggtaaccncggttaccttactaccgtaccgtaccaaccgtatacgacgtacgacggtacgtacggacgtaccgttaagtaagttacggttttacgacggttaacggtttacgtttaacggtttaaccgtaggttaaacctaacgttaacggttaaccgtttaaccggtttaaccctttacccgttttaccggttttccccggtttacccgggttttacccgggtaacccgttaacggggtaaacccgttaacgggttaccggtaaaccgttaaaccggttaaacccgtaaacgggttaccgggttaggtcccggttaacctaccggtacctaacgttcgttaccgttaccgtttacctaccggttaccctacccgttacccgtctacgttctacgtactacgttagtacgtgtcggtcggg

SEQ ID NO: 293347 - DNA, 559 bp, Homo sapiens
  misc_feature: GYAE6OF01DPD78.45.60.F05.1.454.CMB.1.raw
  modified_base (512)..(512): a, c, t, g, unknown or other
  misc_feature (512)..(512): n is a, c, g, or t
  modified_base (518)..(518): a, c, t, g, unknown or other
  misc_feature (518)..(518): n is a, c, g, or t
  modified_base (522)..(522): a, c, t, g, unknown or other
  misc_feature (522)..(522): n is a, c, g, or t
  modified_base (524)..(527): a, c, t, g, unknown or other
  misc_feature (524)..(527): n is a, c, g, or t
  modified_base (530)..(535): a, c, t, g, unknown or other
  misc_feature (530)..(535): n is a, c, g, or t
  modified_base (537)..(543): a, c, t, g, unknown or other
  misc_feature (537)..(543): n is a, c, g, or t
  modified_base (545)..(551): a, c, t, g, unknown or other
  misc_feature (545)..(551): n is a, c, g, or t
  modified_base (553)..(558): a, c, t, g, unknown or other
  misc_feature (553)..(558): n is a, c, g, or t
tcagacgcgatcgacacgaccggtgctcgatttagtacgtcatcagggaaagggggctggagtgggtgggtctcattagaagcaaagcttctggggggacaacagactacgcccgcgtctgtgaaaggcagattcaccatctcaagagatgattccaaaagtgtcgcccatctgcaaatgaacagcctagaaaaccgaggacacagccatgtattactgtactaggaggggtagggtcgcgtgtccggtaactcccactacgtcggggccagggaccctggtcaccgtctcctcagcctccaccacggcccagtccgtccttcccctggccgccccgtcgcctccgaggacgcctacccgtcgacgacgccacacggccggcccgtggggtccctcgccgtacggtaccgaacggtacccttaccgtttcccctccccgtccggtccgttccgtacgggcggccggggtacgtcggggtaccggaaacgggtccgaccgaagtacggatcgngcagtncgcncnnnngcnnnnnncnnnnnnncnnnnnnncnnnnnng

SEQ ID NO: 293348 - DNA, 850 bp, Homo sapiens
  misc_feature: GYAE6OF01DTQBR.45.60.F05.1.454.CMB.1.raw
tcagacgcgatcgacacgaccggtgctcgatttagtacgtcatcagggaaaggggggagaggagccccagccgtgagattcccaggagtttccacttggtgatcagcactgaacacagaccaccaaccatggagttgggcttagcgttgggttttccttgttgtacttaagttttaaaaggtgtaccaatgtagaagtgcagcgtggtggtagtcgtggggacgtacgttggtacacgccgagggccggtccctggagtacgtcctccgtagtactacgtctttcgtaggtactttccgtaccgttttgggttagtaattttaacttaacgttagttaccggtaccggttcggggtcccgccgaagggtccgtaccggaagggggaacggggtccggtaggggtagggttgggggttcggttccgtacgtaagttaggaaagtaacgtaaaaggttccgttacgggtacgggggtaaacaaacgtacgtaaccgtaccggccgtccggtcgtaggtaacggtaaaggcgtaagttaactactaacccgtaacgtacgtaacgtaaacggtaacgtaattaacggtaacttaaaccgtaaagttccgtacccgtaccctacgttctaacgtaactaaagtacgtaaaccgaaccggaccttaaaccggaaaacggtaacgaaccgaacgtaacgacgttaacttacgttaacgttacgtacgttaacggtagggtaacggggttacggtaccgtacgttacccgggttacccgttaaccccgtacccgtaacgttacccgggttacggggaaccccgtaccggggttacccttccgggtccttaaccccgg

SEQ ID NO: 293349 - DNA, 582 bp, Homo sapiens
  misc_feature: GYAE6OF01DQ82X.45.60.F05.1.454.CMB.1.raw
  modified_base (182)..(182): a, c, t, g, unknown or other
  misc_feature (182)..(182): n is a, c, g, or t
  modified_base (538)..(538): a, c, t, g, unknown or other
  misc_feature (538)..(538): n is a, c, g, or t
  modified_base (541)..(542): a, c, t, g, unknown or other
  misc_feature (541)..(542): n is a, c, g, or t
  modified_base (544)..(544): a, c, t, g, unknown or other
  misc_feature (544)..(544): n is a, c, g, or t
  modified_base (548)..(548): a, c, t, g, unknown or other
  misc_feature (548)..(548): n is a, c, g, or t
  modified_base (550)..(556): a, c, t, g, unknown or other
  misc_feature (550)..(556): n is a, c, g, or t
  modified_base (558)..(582): a, c, t, g, unknown or other
  misc_feature (558)..(582): n is a, c, g, or t
tcagacgcgatcgacacgaccggtgctcgatttagtacgtcatcagggaaaggggctggagtgggtgggtctcattagaagcaaagcttctggggggacaacagactacgccgcgtctgtgaaaggcagattcaccatctcaagagatgattccaaaagtgtcgcccatctgcaaatgaacngccctaggaaaacccgaggaccacagccatgttacttactgtacgtaggaggggtagggtcgctgtccggtaacctcccactacggtggggaccacgggaacccgtggtccaccgtctccctcacgtccctaccacccgaacggcccctacgtccggttcccctttccccccgtcgggccctccccgtgcccctaccgagggtaccgcccaccgtccggaagcgacacggaccggccggccccgtggggcctcgggtcctcgggtacaaggtcccttaccgtttcccgccggtacgtccggaccgttcgtggaccgggccgggtaccgttgggaccgaacgggcgtacgaacggtncgnngntcgncnnnnnnngnnnnnnnnnnnnnnnnnnnnnnnnn

SEQ ID NO: 293350 - DNA, 754 bp, Homo sapiens
  misc_feature: GYAE6OF01ALZHW.45.60.F05.1.454.CMB.1.raw
  modified_base (172)..(172): a, c, t, g, unknown or other
  misc_feature (172)..(172): n is a, c, g, or t
  modified_base (666)..(666): a, c, t, g, unknown or other
  misc_feature (666)..(666): n is a, c, g, or t
tcagacgcgatcgacacgaccggtgctcgatttagtacgtcatcagggaaagggaaccatggaagccccagcgcagcttctcttcctcctgctactctggctcccagacgacctccggagaaattgtcttgacacagtctccagcctattctgtctctctctaccgaggganacacgccacctctcatcgcgacgggacctagtcaagtagttaattaacgaactattacgttcggcctaggtactacaactaacgacgtccgtcggaccgtaccggggtccccgcttaccgtactacttaccgttaatcggtaacttcggtaccttccgacgccggacgggaccctacgtcggacctacctacccgtcggtaccgtacggttccgtagggttcgggttacggggtttggggtttaccgaccgtaacggtacgttaacccgtttccgtaaaccgttcccgtaactaaaccgacgtaccgacgtacccgtaccgtacctacccctaaagtggttaaacgttaacgtttcgacgttacgttacttacgtttacgtacgtaactaacggacgtaactacggaacgttcggtccgtaccgtacttacggttcccggttcgggaacggtaacggaacggtacgtacggaacgtactaacgaacgttaccgnggtacgtccgtactacccgacgttactcgttagtccgttaaccttcgtcccgttacccgcgttactaccggtagttcccgtgtacccg

SEQ ID NO: 293351 - DNA, 825 bp, Homo sapiens
  misc_feature: GYAE6OF01CURMR.45.60.F05.1.454.CMB.1.raw
  modified_base (757)..(757): a, c, t, g, unknown or other
  misc_feature (757)..(757): n is a, c, g, or t
  modified_base (765)..(765): a, c, t, g, unknown or other
  misc_feature (765)..(765): n is a, c, g, or t
tcagacgcgatcgacacgaccggtgctcgatttagtacgtcatcagggaaaggggctggagtgggtgggtctcattagaagcaaagcttcgtgggggacaacagactacgccgcgtctgtgaaaggctgattcaccatctcaagagatgtacttaccaaaagtcgtccgcccatctagacaaatcgaacacgaccctaaggaaaacccgaggaccacgacgcctagttagttattacgtgtaacgtagggtaggggtacggtcgtcgttcggtaccggtacctcccgagtacggtcggggaccgacgggtaacccgtcggtaccgtacccgtctaccctcgaccgtacccgttacccgaaacccgggaccggacccccgttacgttcccgggtttaccccctttccccccggtagggtcccctccccggtacgtcccggtaacccgaggtaccgtacccgtaaccccgttaccgggaacgaccggaccgtaacggacccggggtccccggtcccgggttacgggtccggttacccggtcccggtttaacggggttaacccgtaaacccggggtttaccctttaccccgggttttacccgtacccgggtttaacccgttcccgggtaccggtttaccgggtaacgggtccgggggtccgggtaccgggtttaccggggaaacccgtaccggggtaacccggttacggtaaaccggtttacggccgtacgttccgaggactccgagctaagcctagtcncgctacgnctcgcgacgcgagtcgtacgcgtcgtgacgtcgacgtctactactcgagcgtcgtcgtcg

SEQ ID NO: 293352 - DNA, 668 bp, Homo sapiens
  misc_feature: GYAE6OF01C5C4O.45.60.F05.1.454.CMB.1.raw
  modified_base (602)..(602): a, c, t, g, unknown or other
  misc_feature (602)..(602): n is a, c, g, or t
  modified_base (610)..(610): a, c, t, g, unknown or other
  misc_feature (610)..(610): n is a, c, g, or t
  modified_base (616)..(616): a, c, t, g, unknown or other
  misc_feature (616)..(616): n is a, c, g, or t
  modified_base (620)..(620): a, c, t, g, unknown or other
  misc_feature (620)..(620): n is a, c, g, or t
  modified_base (622)..(622): a, c, t, g, unknown or other
  misc_feature (622)..(622): n is a, c, g, or t
  modified_base (624)..(625): a, c, t, g, unknown or other
  misc_feature (624)..(625): n is a, c, g, or t
  modified_base (627)..(627): a, c, t, g, unknown or other
  misc_feature (627)..(627): n is a, c, g, or t
  modified_base (629)..(629): a, c, t, g, unknown or other
  misc_feature (629)..(629): n is a, c, g, or t
  modified_base (631)..(631): a, c, t, g, unknown or other
  misc_feature (631)..(631): n is a, c, g, or t
  modified_base (633)..(633): a, c, t, g, unknown or other
  misc_feature (633)..(633): n is a, c, g, or t
  modified_base (635)..(637): a, c, t, g, unknown or other
  misc_feature (635)..(637): n is a, c, g, or t
  modified_base (639)..(640): a, c, t, g, unknown or other
  misc_feature (639)..(640): n is a, c, g, or t
  modified_base (642)..(646): a, c, t, g, unknown or other
  misc_feature (642)..(646): n is a, c, g, or t
  modified_base (648)..(648): a, c, t, g, unknown or other
  misc_feature (648)..(648): n is a, c, g, or t
  modified_base (650)..(652): a, c, t, g, unknown or other
  misc_feature (650)..(652): n is a, c, g, or t
  modified_base (654)..(656): a, c, t, g, unknown or other
  misc_feature (654)..(656): n is a, c, g, or t
  modified_base (658)..(658): a, c, t, g, unknown or other
  misc_feature (658)..(658): n is a, c, g, or t
  modified_base (661)..(661): a, c, t, g, unknown or other
  misc_feature (661)..(661): n is a, c, g, or t
  modified_base (663)..(663): a, c, t, g, unknown or other
  misc_feature (663)..(663): n is a, c, g, or t
  modified_base (665)..(665): a, c, t, g, unknown or other
  misc_feature (665)..(665): n is a, c, g, or t
  modified_base (667)..(667): a, c, t, g, unknown or other
  misc_feature (667)..(667): n is a, c, g, or t
tcagacgcgatcgacacgaccggtgctcgatttagtacgtcatcagggaaaggggctggagtgggtgggtctcattagaagcaaagtcgttcgtgggggacaacagactacgccgcgtctgtagaaaggcagtattccaccatcctagaagagatgtaacttaaccgaaaagtgtaccgacctatcgtacgacaaagtacgaaacaccgtaccgtaaacggaaaaccggacggaacaccgacgtacctaagttacgttacgttacgtacggtaagtaaggggtacggggttacggtcgttacgtacggtaccgtaaccgtcctacgtacggtcgggaccgtaacggtaccgtcggtaccgtaccgtcctaccgtacgacccgtacctacccgaaccggtaccgtaccgtaccggttccccgttccccgtcccgtcggtcccgtccgtacgtaccgacggtaccgaccgtacccgaccgtacgacgacgaccgacgccggtccggtcggtcgtccgtcgtacgtaacggtacgtaccgttactccgtcgacgtcgtaccgtcggtcgacggacggtcgtacggtaacggaccgacgtaccgtntaagtcgntacgtncgtntngnncncncngngnnngnncnnnnncncnnngnnntngancngngng

SEQ ID NO: 293353 - DNA, 813 bp, Homo sapiens
  misc_feature: GYAE6OF01AV9ZU.45.60.F05.1.454.CMB.1.raw
tcagacgcgatcgacacgaccggtgctcgatttagtacgtcatcagggaaagggaaccatggaaaccccagcgcagcttctcttcctcctgctactctggctcccagagacctccggagaaattgtcttgacacagtctccagccattctgtctctctctccaggggagacagcccaccctctcatgcagggccagtcaggagtatagaacatacgtggcctggtatacaatacgaacgccgtggaccgacggggtccccggctcctcgactcttacgtggactgtccttaccgacggaccgacggggtaccccaccgttccgggacacccgttaccccgaacggcccgtaaggttccggaagggttcgggttcggggtttacgggggttttacggaccgtaacgtagggtaccctttaccgtaccttcgtacctaaaccgaactaccgaagtacccgaaccgtaccccgttaacccctaaaacccgttaggtaaaaccgtttagtttttaccggaaccggtttactttaccgtttaacgttttaaccgttacgttaaccgaaacccggtaagtacccgggtaaactacgggttaacgttcccgggtaccgttaccttaccggttaaccgggttttcccggggaacggggttaacggggtaacccggtaaggggttacgggaaacggtaccgttaaacggaaaaccgggtacgttacggaggttacccgtacgtacctacgtacgtttacgtacgttcttacgtaccttacccgtcccgtaccttactacgtagtacttccggtgttacccgg

SEQ ID NO: 293354 - DNA, 840 bp, Homo sapiens
  misc_feature: GYAE6OF01BWYZM.45.60.F05.1.454.CMB.1.raw
  modified_base (211)..(211): a, c, t, g, unknown or other
  misc_feature (211)..(211): n is a, c, g, or t
  modified_base (241)..(241): a, c, t, g, unknown or other
  misc_feature (241)..(241): n is a, c, g, or t
tcagacgcgatcgacacgaccggtgctcgatttagtacgtcatcagggaaagggggggagaggagccccagccgtgagattcccaggagtttccacttggtgatcagcactgaacacagaccaccaaccagtggagtttgggcttagcttgggttttccttgttgacttaattttaaaaggtgtacctaatgtagaagtcgcagtcgtggnggtagtcgtgggggtagtacgttggtaacnggccgagggccgtaccgtgagacgtctcctagtatacgtcttcgtggtacttccgtaccgtttggtcgtattaatacgtagtacgtaccgtcggggtcccgaccggaacggtccgtaccggaacggggggtaaacgggggtccggttaggggttaaggggttcgggggttacggggttaccgttacgtaagttttaacggaaacggtaaccgtaaaaggtccggtttacggttaacggggggaactaaacgtacggtaaccgtacggccccggtacggtacgtacgggtaaggtaaacgggacctaaggtacgtttaacccgacctaacgtccgtaaacgaagtacggtaacgttagtaaccttaaaccgtaaaaggttacgtaccggtacctacgttacgtacgtaacgtaaagtaacgaaccgtaacgtaaccgtaacggaaacgtacggaaccgaacgtacgacccgtaagttaccgtaagttacctaacgtaacggttaagggacgggttacggtaccgtggttaacggtaccccggtactacccgtaccgtacggtacgggacccggtaggtaacccgttggtcccgtaacccg

SEQ ID NO: 293355 - DNA, 428 bp, Homo sapiens
  misc_feature: GYAE6OF02IAQ5P.45.60.F05.1.454.CMB.1.raw
  modified_base (424)..(428): a, c, t, g, unknown or other
  misc_feature (424)..(428): n is a, c, g, or t
tcagacgcgatcgacacgaccggtgctcgatttagtacgtcatcagggaaaggggctggagtgggtgggtctcattagaagcaaagcttctgggggacaacagactacgccgcgtctgtgaaaggcagattcaccatctcaagagatgattccaaaagtgtcgcccatctgcaaatgaacagcctgaaaaccgaggacacagccatgtattactgtactagaggggtagggtcgctgtccggtaactcccactactggggccagggaaccctggtcaccgtctcctcagcctccaccaagggcccatcggtcttccccctggcgcccctgctccaggagcacctccgagagcacagcggccctgggctgcctggtcaaggctacttcctcgatcgcgtctgagcgggctggcaaggcgcatagnnnnn

SEQ ID NO: 293356 - DNA, 430 bp, Homo sapiens
  misc_feature: GYAE6OF02I2CTL.45.60.F05.1.454.CMB.1.raw
  modified_base (424)..(430): a, c, t, g, unknown or other
  misc_feature (424)..(430): n is a, c, g, or t
tcagacgcgatcgacacgaccggtgctcgatttagtacgtcatcagggaaaggggctggagtgggtgggtctcattagaagcaaagcttctggggggacaacagactacgccgcgtctgtgaaaggcagattcaccatctcaagagatgattccaaaagtgtcgcccatctgcaaatgaacagcctgaaaaccgaggacacagccatgtattactgtactagaggggtaggtcgctgtccggtaactcccactactggggccagggaaccctggtcaccgtctcctcagcctccaccaagggcccatcggtcttccccctggcgccctgctccaggagcacctccgagagcacagcggccctgggctgcctggtcaaggactacttcctactgctagtctgagcgggctggcaaggcgcatagnnnnnnn

SEQ ID NO: 293357 - DNA, 425 bp, Homo sapiens
  misc_feature: GYAE6OF02GGIK4.45.60.F05.1.454.CMB.1.raw
  modified_base (193)..(193): a, c, t, g, unknown or other
  misc_feature (193)..(193): n is a, c, g, or t
  modified_base (421)..(425): a, c, t, g, unknown or other
  misc_feature (421)..(425): n is a, c, g, or t
tcagacgcgatcgacacgaccggtgctcgatttagtacgtcatcagggaaagggctggagtgggtgggtctcattagaagcaaagcttctgggggacaacagactacgccgcgtctgtgaaaggcagattcaccatctcaagagatgattccaaaagtgtcgcccatctgcaaatgaacagcctgaaaaccgnggacacagccatgtattactgtactagaggggtaggtcgctgtccggtaactcccactactggggccagggaacccctggtcaccgtctcctcagcctccaccaagggcccatcggtcttccccctggcgccctgctccaggagcacctccgagagcacagcggccctgggctgcctggtcaaggctacttccactgctagtctgagcgggctggcaaggcgcatagnnnnn

SEQ ID NO: 293358 - DNA, 475 bp, Homo sapiens
  misc_feature: GYAE6OF02I2LMB.45.60.F05.1.454.CMB.1.raw
  modified_base (213)..(213): a, c, t, g, unknown or other
  misc_feature (213)..(213): n is a, c, g, or t
  modified_base (232)..(232): a, c, t, g, unknown or other
  misc_feature (232)..(232): n is a, c, g, or t
  modified_base (319)..(319): a, c, t, g, unknown or other
  misc_feature (319)..(319): n is a, c, g, or t
  modified_base (339)..(339): a, c, t, g, unknown or other
  misc_feature (339)..(339): n is a, c, g, or t
  modified_base (453)..(453): a, c, t, g, unknown or other
  misc_feature (453)..(453): n is a, c, g, or t
  modified_base (455)..(475): a, c, t, g, unknown or other
  misc_feature (455)..(475): n is a, c, g, or t
tcagacgcgatcgacacgaccggtgctcgatttagtacgtcatcagggaaaggggctggagtgggtgggtctcattagaagcaaagcttctgggggacaacagactacgccgcgtctgtgaaaggcagattcaccatctcaagagatgattccaaaagtgtcgcccatctgcaaatgaacagcctgaaaaccgaggacacagccatgattacngtactagagggtagggtcnctgtccggtaactcccatactggggccagggaaccctggtcaccgtctcctcagcctccaccaacgggcccatccggtcttcccccnggccgccctgctccaggacncacctccgagacgcacacgccggtcccctggggctcgcctgggtccaaagggacctacgttccctacgactcgcgttcctgacgccgggctcgggcaaagggccgacaagtagngnnnnnnnnnnnnnnnnnnnnn

SEQ ID NO: 293359 - DNA, 523 bp, Homo sapiens
  misc_feature: GYAE6OF02HU2Z6.45.60.F05.1.454.CMB.1.raw
  modified_base (281)..(281): a, c, t, g, unknown or other
  misc_feature (281)..(281): n is a, c, g, or t
  modified_base (358)..(358): a, c, t, g, unknown or other
  misc_feature (358)..(358): n is a, c, g, or t
  modified_base (368)..(368): a, c, t, g, unknown or other
  misc_feature (368)..(368): n is a, c, g, or t
  modified_base (476)..(476): a, c, t, g, unknown or other
  misc_feature (476)..(476): n is a, c, g, or t
  modified_base (519)..(519): a, c, t, g, unknown or other
  misc_feature (519)..(519): n is a, c, g, or t
tcagacgcgatcgacacgaccggtgctcgatttagtacgtcatcagggaaagggaaccatggaaaccccagcgcagcttctcttcctcctgctactctggctcccagataccaccggagaaattgtgttgacgcagtctccaggcaccctgtccttgtctccaggggaaagagccaccctctcctgcagggccagtcagactattactggcagctacttagcctggtaccagcagaaacctggccagggtcccaggctcctcatctattatgcatccaacngggccactggcatcccagacaggttcagtggcagtgggtctgggacagacttcactctcaccatcagcagactggancctagaagtntttgctagttgtattactgtacaactagtagtcggtacctctacctttcgtcgtttccggccgtaggaacctaaggtcgactatacaaacgtactgtcgctgacactntctcgtctctcttcctccgctactctagactcgtatcgtcgtntcgg

SEQ ID NO: 293360 - DNA, 432 bp, Homo sapiens
  misc_feature: GYAE6OF02HIU6L.45.60.F05.1.454.CMB.1.raw
  modified_base (390)..(390): a, c, t, g, unknown or other
  misc_feature (390)..(390): n is a, c, g, or t
  modified_base (425)..(432): a, c, t, g, unknown or other
  misc_feature (425)..(432): n is a, c, g, or t
tcagacgcgatcgacacgaccggtgctcgatttagtacgtcatcagggaaaggggctggagtgggtgggtctcattagaagcaaagcttctggggggacaacagactacgccgcgtctgtgaaaggcagattcaccatctcaagagatgattccaaaagtgtcgcccatctgcaaatgaacagcctgaaaaccgaggacacagccatgtattactgtactagaggggtagggtcgctgtccggtaactcccactactggggccagggaaccctggtcaccgtctcctcagcctcaccaagggcccatcggtcttccccctggccgccctgctccaggacgcacctccgagagcacagcggccctgggctgcctggtcaaggctacttccncgatcgcgtctgagcgggctggcaaggcgcatagnnnnnnnn

SEQ ID NO: 293361 - DNA, 758 bp, Homo sapiens
  misc_feature: GYAE6OF02GPLDV.45.60.F05.1.454.CMB.1.raw
  modified_base (236)..(236): a, c, t, g, unknown or other
  misc_feature (236)..(236): n is a, c, g, or t
tcagacgcgatcgacacgaccggtgctcgatttagtacgtcatcagggaaagggaaccatggaaaccccagcgcagcttctcttcctcctgctactctggctcccagataccaccggagaaattgtcttgacacagtctccaggcaccctgtctctgtctccaggggagacagccaccctctcctgcagggccagtaggagtgtcagtaagtacttaggctggtaccaacagaacncgtcgacgacgcctccgagcctcctacactaccagtgagtcgactactacccaaacggtaccgggtcccgtcgggtcccctacccgaagtaccggttaccgggtttccggcggacgtaggggtcgggttcggtacgggaacgtaaggttacgttaccaccttccgtaccgtaccgtacgacgccgacgtccggtagggaccgtccgtagtacgttacgtttagttttcggacgttttaacgtttttaccttcgttacgtaccgacgtacggtaccggttccccggttcccgaccgtacccggtcccgtccttacccggttaccggggtttccgggggggaaccccgggggtaacgtgggggtacggaggtacggtacgggaacggtaaccgtacggttgggtacgtcgtacgaccctaacgttacgttccgttacgtttccttacgaccgttttccccggtacccgtacttacgttcgtacgtacgttccggtacgtccggtacgttccggaggtaccgggg

SEQ ID NO: 293362 - DNA, 430 bp, Homo sapiens
  misc_feature: GYAE6OF02GNUFW.45.60.F05.1.454.CMB.1.raw
  modified_base (425)..(430): a, c, t, g, unknown or other
  misc_feature (425)..(430): n is a, c, g, or t
tcagacgcgatcgacacgaccggtgctcgatttagtacgtcatcagggaaaggggctggagtgggtgggtctcattagaagcaaagcttctggggggacaacagactacgccgcgtctgtgaaaggcagattcaccatctcaagagatgattccaaaagtgtcgcccatctgcaaatgaacagcctgaaaaccgaggacacagccatgtattactgtactagaggggtagggtcgctgtccggtaactcccactactggggccagggaacccctggtcaccgtctcctcagcctccaccaagggcccatcggtcttccccctggcgccctgctccaggagcacctccgagagcacagcggccctgggctgcctggtcaaggctacttcctcgatcgcgtctgagcgggctggcaaggcgcatagnnnnnn

SEQ ID NO: 293363 - DNA, 434 bp, Homo sapiens
  misc_feature: GYAE6OF02F1M9J.45.60.F05.1.454.CMB.1.raw
  modified_base (424)..(434): a, c, t, g, unknown or other
  misc_feature (424)..(434): n is a, c, g, or t
tcagacgcgatcgacacgaccggtgctcgatttagtacgtcatcagggaaaggggctggagtgggtgggtctcattagaagcaaagcttctggggggacaacagactacgccgcgtctgtgaaaggcagattcaccatctcaagagatgattccaaaagtgtcgcccatctgcaaatgaacagcctgaaaaccgaggacacagccatgtattactgtactagaggggtaggtcgctgtccggtaactcccactactggggccagggaacccctggtcaccgtctcctcagcctccaccaagggcccatcggtcttccccctggcgcctgctccaggagcacctccgagagcacagcggccctgggctgcctggtcaaggactacttcctcgatcgcgtctgagcgggctggcaaggcgcatagnnnnnnnnnnn

SEQ ID NO: 293364 - DNA, 475 bp, Homo sapiens
  misc_feature: GYAE6OF02J1Q4J.45.60.F05.1.454.CMB.1.raw
  modified_base (238)..(238): a, c, t, g, unknown or other
  misc_feature (238)..(238): n is a, c, g, or t
  modified_base (333)..(333): a, c, t, g, unknown or other
  misc_feature (333)..(333): n is a, c, g, or t
  modified_base (460)..(475): a, c, t, g, unknown or other
  misc_feature (460)..(475): n is a, c, g, or t
tcagacgcgatcgacacgaccggtgctcgatttagtacgtcatcagggaaagggctggagtgggtgggtctcattagaagcaaagcttctggggggacaacagactacgccgcgtctgtgaaaggcagattcaccatctcaagagatgattccaaaagtgtcgcccatctgcaaatgaacagcctagaaaaccgaggacacagccaatgtattactgtactaggaggggttagggtcnctggtccggtaactccccactacgtggggccagggaacccctggtcaccgtctcctcagcctccacaacgggcccatccggtctccccctggccnccctgcctccaggacgccaccctcccggagacggccaccgaggccggcccctggggctcgcccgtggtcaacggaccttacttccctactgccttagtcctgacgcgggctggcaaggcgcatagcnnnnnnnnnnnnnnnn

SEQ ID NO: 293365 - DNA, 503 bp, Homo sapiens
  misc_feature: GYAE6OF02FOPV5.45.60.F05.1.454.CMB.1.raw
  modified_base (462)..(462): a, c, t, g, unknown or other
  misc_feature (462)..(462): n is a, c, g, or t
  modified_base (497)..(497): a, c, t, g, unknown or other
  misc_feature (497)..(497): n is a, c, g, or t
tcagacgcgatcgacacgaccggtgctcgatttagtacgtcatcagggaaagggaaccatggaaaccccagcgcagcttctcttcctcctgctactctggctcccagataccaccggagaaattgtgttgacgcagtctccaggcaccctgtccttgtctccaggggaaagagccaccctctcctgcagggccagtaggagtgtcagtaagtacttaggctggtaccaacagaaacctggccaggctcccaggctcctcatccatgatgcatccaacagggtccctggcgtcccagacaggttccgtggcagtgggtctgggacagagtcactctcacatcagcagcctgcagtctgaagtattttgctagtttatttctgtcagctagtatcataactgtctgtactgtttggcgagggaccagctaggaatcaaagactgtagctgacacatctgtcttnactcgtcccgctatctgactcgactccgcgtctgngtcggg

SEQ ID NO: 293366 - DNA, 513 bp, Homo sapiens
  misc_feature: GYAE6OF02GGAUI.45.60.F05.1.454.CMB.1.raw
  modified_base (172)..(172): a, c, t, g, unknown or other
  misc_feature (172)..(172): n is a, c, g, or t
  modified_base (348)..(348): a, c, t, g, unknown or other
  misc_feature (348)..(348): n is a, c, g, or t
  modified_base (361)..(361): a, c, t, g, unknown or other
  misc_feature (361)..(361): n is a, c, g, or t
  modified_base (460)..(460): a, c, t, g, unknown or other
  misc_feature (460)..(460): n is a, c, g, or t
tcagacgcgatcgacacgaccggtgctcgatttagtacgtcatcagggaaagggaaccatggaaaccccagcgcagcttctcttcctcctgctactctggctcccagataccaccggagaaattgtgttgacgcagtctccaggcaccctgtccttgtctccaggggaaagngccaccctctcctgcagggccagtcagactattactggcagctacttagcctggtaccagcagaaacctggccagggtcccaggctcctcatctattatgcatccaacaggaccactggcatcccagacaggttcagtgcagtgggtctgggacagacttcactctcaccatcagnacccccgatggancctgaagtattttgctagtgtattactgtacaacagtatcggtacctctacctttcgctttcggccctggactaagtggacatacaaacgactgtgctncacatctgtcttcacttccttcccgctattctgactccgatcgtcgtcgtcgg

SEQ ID NO: 293367 - DNA, 437 bp, Homo sapiens
  misc_feature: GYAE6OF02HQORT.45.60.F05.1.454.CMB.1.raw
  modified_base (429)..(437): a, c, t, g, unknown or other
  misc_feature (429)..(437): n is a, c, g, or t
tcagacgcgatcgacacgaccggtgctcgatttagtacgtcatcagggaaaggggctggagtgggtgggtctcattagaagcaaagcttctggggggacaacagactacgccgcgtctgtgaaaggcagattcaccatctcaagagatgattccaaaagtgtcgcccatctgcaaatgaacagcctgaaaaccgaggacacagccatgtattactgtactagaggggtagggtcgctgtccggtaactcccactactggggccagggaaccctggtcaccgtctcctcagcctccaccaagggcccatccggtcttccccctggccgccctgctccaggagccacctccgagagcacagcggccctgggctgcctggtcaaggctacttcctcgatcgcgtctgacggcgggctggcaaggcgcatagnnnnnnnnn

SEQ ID NO: 293368 - DNA, 429 bp, Homo sapiens
  misc_feature: GYAE6OF02GXN6N.45.60.F05.1.454.CMB.1.raw
  modified_base (417)..(417): a, c, t, g, unknown or other
  misc_feature (417)..(417): n is a, c, g, or t
  modified_base (423)..(429): a, c, t, g, unknown or other
  misc_feature (423)..(429): n is a, c, g, or t
tcagacgcgatcgacacgaccggtgctcgatttagtacgtcatcagggaaaggggctggagtgggtgggtctcattagaagcaaagcttctggggggacaacagactacgccgcgtctgtgaaaggcagattcaccatctcaagagatgattccaaaagtgtcgcccatctgcaaatgaacagcctgaaaaccgaggacacagccatgtattactgtactagaggggtagggtcgctgtccggtaactcccactactggggccagggaaccctggtcaccgtctcctcagcctccaccaagggcccatcggtctccccctggcgccctgctccaggcgcacctcgagagcacagccgcccgtgggttcgcctggtcaaggctacttcctcgatcgcgtctgagcgggctggcaggcncatagnnnnnnn

SEQ ID NO: 293369 - DNA, 623 bp, Homo sapiens
  misc_feature: GYAE6OF02GVR5Y.45.60.F05.1.454.CMB.1.raw
  modified_base (351)..(351): a, c, t, g, unknown or other
  misc_feature (351)..(351): n is a, c, g, or t
tcagacgcgatcgacacgaccggtgctcgatttagtacgtcatcagggaaagggaaccatggaaaccccagcgcagcttctcttcctcctgctactctggctcccagataccaccggagaaattgtgttgacacaggtctccaggcaccctgtctctgtctccgaggggagactagcccaccctctccgtgcagggccagtaggagtgtcagtaagtacttaggctggtaccaactagaaacctggaccaggctacccaggctcctcatccatgatgacatccaacacggtcctggcctaccagacgacggtccgtgccgaggtcgggtctgggacagtacgttcacgtcncgaccgtcagcagtccgtggacgtcctgatgtaacttttcgacttagtttactcgtagtacgagtcgtagtccggttacccgacgtaccgtccgtccgtacgtaccgtttccgggaccgggggtacctggggtacgtagtacgtaggacgacggtacgtggtacggcgtagaccgtacgtataccgtgttaccgttcgacgttcccgttacccgacctaacgttccgtagtaccgttacgtacttccggccgttcgtaccggtaggtcccgg

SEQ ID NO: 293370 - DNA, 440 bp, Homo sapiens
  misc_feature: GYAE6OF02G51Q5.45.60.F05.1.454.CMB.1.raw
  modified_base (347)..(347): a, c, t, g, unknown or other
  misc_feature (347)..(347): n is a, c, g, or t
  modified_base (365)..(365): a, c, t, g, unknown or other
  misc_feature (365)..(365): n is a, c, g, or t
  modified_base (401)..(401): a, c, t, g, unknown or other
  misc_feature (401)..(401): n is a, c, g, or t
  modified_base (435)..(440): a, c, t, g, unknown or other
  misc_feature (435)..(440): n is a, c, g, or t
tcagacgcgatcgacacgaccggtgctcgatttagtacgtcatcagggaaaggggctggagtgggtgggtctcattagaagcaaagcttctggggggacaacagactacgccgcgtctgtgaaaggcagattcaccatctcaagagatgattccaaaagtgtcgcccatctgcaaatgaacagcctagaaaaccgaggacacagccatgtattactgtactagaggggtaggtcgctgtccggtaactcccactactggggccagggaaccctggtcaccgtctcctcagcctccaccaagggccccatccggtccttcccccctggccgcccctgcctccaggacnccacctccgagagccacngccggccctgggctgcctggtcaaggactacttccncgatcgcgtctgacgcggctggcaggcgcatagnnnnnn

SEQ ID NO: 293371 - DNA, 450 bp, Homo sapiens
  misc_feature: GYAE6OF02I5DVV.45.60.F05.1.454.CMB.1.raw
  modified_base (433)..(433): a, c, t, g, unknown or other
  misc_feature (433)..(433): n is a, c, g, or t
  modified_base (439)..(450): a, c, t, g, unknown or other
  misc_feature (439)..(450): n is a, c, g, or t
tcagacgcgatcgacacgaccggtgctcgatttagtacgtcatcagggaaaggggctggagtgggtgggtctcattagaagcaaagcttctggggggacaacagactacgccgcgtctgtgaaaggcagattcaccatctcaagagatgattccaaaagtgtcgcccatctgcaaatgaacagcctagaaaaccgaggacacagccatgtattactgtactagaggggtagggtcgctgtccggtaactcccactacgtggggccagggaaccctggtcaccgtctcctcagcctccaccaatcggcccatcggtccttccccctggccgccctgcctccaggacgccacctccgagacgcacacgccggccctgggctgccctggtcaacggactacttcctcgactcgcgtctgagcgggctggcaaggcncatagnnnnnnnnnnnn

SEQ ID NO: 293372 - DNA, 755 bp, Homo sapiens
  misc_feature: GYAE6OF02JNULC.45.60.F05.1.454.CMB.1.raw
  modified_base (170)..(170): a, c, t, g, unknown or other
  misc_feature (170)..(170): n is a, c, g, or t
tcagacgcgatcgacacgaccggtgctcgatttagtacgtcatcagggaaagggaaccatggaaaccccagcgcagcttctcttcctcctgctactctggctcccagataccaccggagaaattgtgttgacacagtctccaggcaccctgtctctgtctccgagggganacagccaccctctcctgcagggccagtaggagtgtcagtaagtacttaggctaggtaccaacagaaacctggccaggcctcccaggcctcctacactccatgatcgcactccaacgcggtccctaggccgtacccaaggtaccgtacgggttcccgtggacctaggtcgggtcgtaggggactaggacgtttcacgttcctacgtaaccgtcaaacgcgtaccgtgggacgtaccttggaacttgttactttttcggaccgtttaacgttttaccgttcgttaggttaccgacgtcgtaacggtccgttacccgtacccgtacccggtcccgtcgttaccgtaccgggtttcccggggaccgggggtaccgtacggggtacgggtaacggacgttacggtaacggtaaccggtaacgttcgggtacggtacggttaccggacccgtaaccgtacgttccgttacggttcctttaccgtaccgtttccccgttacccggtcccttaacggttcccgttacgtaccgttaccggttacggtacccggttccggttacggttacgggtaccgggtcccgggttacggg

SEQ ID NO: 293373 - DNA, 434 bp, Homo sapiens
  misc_feature: GYAE6OF02HAYLX.45.60.F05.1.454.CMB.1.raw
  modified_base (349)..(349): a, c, t, g, unknown or other
  misc_feature (349)..(349): n is a, c, g, or t
  modified_base (386)..(386): a, c, t, g, unknown or other
  misc_feature (386)..(386): n is a, c, g, or t
  modified_base (421)..(434): a, c, t, g, unknown or other
  misc_feature (421)..(434): n is a, c, g, or t
tcagacgcgatcgacacgaccggtgctcgatttagtacgtcatcagggaaaggggctggagtgggtgggtctcattagaagcaaagcttctggggggacaacagactacgccgcgtctgtgaaaggcagattcaccatctcaagagatgattccaaaagtgtcgcccatctgcaaatgaacagcctgaaaaccgaggacacagccatgtattactgtactagaggggtagggtcgctgtccggtaactcccactactggggccagggaaccctggtcaccgtctcctcagcctccaccaagggcccatcggtcttccccctggcgccctgctccaggacgcacctcgangcacagcgccctgggctgcctggtcaaggctacttcngactcgcgtctgagcgggctggcaaggcgcatagnnnnnnnnnnnnnn

SEQ ID NO: 293374 - DNA, 441 bp, Homo sapiens
  misc_feature: GYAE6OF02F760B.45.60.F05.1.454.CMB.1.raw
  modified_base (397)..(397): a, c, t, g, unknown or other
  misc_feature (397)..(397): n is a, c, g, or t
  modified_base (434)..(441): a, c, t, g, unknown or other
  misc_feature (434)..(441): n is a, c, g, or t
tcagacgcgatcgacacgaccggtgctcgatttagtacgtcatcagggaaaggggctggagtgggtgggtctcattagaagcaaagcttctggggggacaacagactacgccgcgtctgtgaaaggcagattcaccatctcaagagatgattccaaaagtgtcgcccatctgcaaatgaacagcctagaaaaccgaggacacagccatgtattactgtactagaggggtagggtcgctgtccggtaactcccactactggggccagggaaccctggtcaccgtctcctcagcctccaccaaggccccatccggtccttcccccgtggccgcccctgcctccaggcgcacctccgagacgcacagccgccctgggctgcctggtcaaggactactccncgatcgcgtctgagcgggctggcaaggcgacagtagnnnnnnnn

SEQ ID NO: 293375 - DNA, 563 bp, Homo sapiens
  misc_feature: GYAE6OF02JMCTQ.45.60.F05.1.454.CMB.1.raw
  modified_base (172)..(172): a, c, t, g, unknown or other
  misc_feature (172)..(172): n is a, c, g, or t
  modified_base (285)..(285): a, c, t, g, unknown or other
  misc_feature (285)..(285): n is a, c, g, or t
  modified_base (350)..(350): a, c, t, g, unknown or other
  misc_feature (350)..(350): n is a, c, g, or t
  modified_base (382)..(382): a, c, t, g, unknown or other
  misc_feature (382)..(382): n is a, c, g, or t
tcagacgcgatcgacacgaccggtgctcgatttagtacgtcatcagggaaagggaaccatggaaaccccagcgcagcttctcttcctcctgctactctggctcccagataccaccggagaaattgtgttgacgcagtctccaggcaccctgtccttgtctccaggggaaagngccaccctctcctgcagggccagtcagactattactggcagctacttagcctggtaccagcagaaacctggccagggtcccaggcctcctcatctattagtgcataccaacgngggccactggccatcccgagacaggttccaggtcggctaggtggtcgtggacagtacttcactcnccacatcacgcagactggacgcctagtaagtntttgactagtagtattactgtacaacgtagtacttacgtacctactaccttcgtcgtttccgccgtacggaactaaggtcggactagtacaacgtacgtgtacgctcgactaccattacgtcgtccttctacgttccttaccgtcttactcgtacgtacgtacgactcgtccgtcgtacgg

SEQ ID NO: 293376 - DNA, 454 bp, Homo sapiens
  misc_feature: GYAE6OF02GKNB8.45.60.F05.1.454.CMB.1.raw
  modified_base (448)..(454): a, c, t, g, unknown or other
  misc_feature (448)..(454): n is a, c, g, or t
tcagacgcgatcgacacgaccggtgctcgatttagtacgtcatcagggaaaggggctggagtgggtgggtctcattagaagcaaagcttctggggggacaacagactacgccgcgtctgtgaaaggcagattcaccatctcaagagatgattccaaaagtgtcgcccatctgcaaatgaacagcctgaaaaccgaggacacagccatgtattactgtactagaggggtagggtcgctgtccggtaactcccactactggggccagggaaccctggtcaccgtctcctcacgcctccaccaagggccccatccggtccttcccccgtggccgccctcgcctccgacggacgccaccctccgagacgcacacgccggccctggggctcgcctggtcaacggtactacttcctcgatcgcgtcgtgacggcgggctcggcaggcgacatgnnnnnnn

SEQ ID NO: 293377 - DNA, 789 bp, Homo sapiens
  misc_feature: GYAE6OF02GU8VE.45.60.F05.1.454.CMB.1.raw
tcagacgcgatcgacacgaccggtgctcgatttagtacgtcatcagggaaagggaaccatggaaaccccagcgcagcttctcttcctcctgctactctggctcccagataccaccggaaaaattgtgttgacacagtctccaggcaccctgtctctgtctccaggggagacagccaccctctcctgcgaggccaggtaggagtgtcaagtaagtacttaggctggtaaccaacagaaacctggccaggcctacccgaggcctcctcactccatgatgcatccaacgacggtccctggccgtccccaagaccgtacggttccggtgggtcgggttcgggtttggccaacgtaggtacctttccaaccgttcttaccaacgtaaacttccgaacggtactaacgtcccttacccgaaaccttaggtaaacgtttaacttttttcggaacctaacggtttactttaaacgtttaccgttacggttaacctaaaaccgtaggtaacccgttaaacgtaacggttaacgtttaccggggaccccttaccgttaccgttaacccggtttttcccggggaccggggtaacggggtaaccccggtaaaggggttacgggaacgtacgtaaaccgtaaaaccgggtaacgttacgggtacggtaccgttacgaccgtaacccgtacgtttaccgttcgttaccctttaccgtaccgttttacccgttcccccggtaccgtacgttccgtagtaccgtccgtacgtccgtcgtaccgtcggacggtccggtcgtacggg

SEQ ID NO: 293378 - DNA, 790 bp, Homo sapiens
  misc_feature: GYAE6OF02J27P3.45.60.F05.1.454.CMB.1.raw
  modified_base (171)..(171): a, c, t, g, unknown or other
  misc_feature (171)..(171): n is a, c, g, or t
  modified_base (212)..(212): a, c, t, g, unknown or other
  misc_feature (212)..(212): n is a, c, g, or t
  modified_base (649)..(649): a, c, t, g, unknown or other
  misc_feature (649)..(649): n is a, c, g, or t
  modified_base (669)..(669): a, c, t, g, unknown or other
  misc_feature (669)..(669): n is a, c, g, or t
tcagacgcgatcgacacgaccggtgctcgatttagtacgtcatcagggaagggaaccatggaacccagcgcagcttctcttcctcctgctactctggctccagactaccaccggagaaattgtgttgacgcagtcctccgaggccacctgtccttgtctaccgagggaaanacgccaccctctcctgcgacggccagtcagtactattacgnggacacgtctactacgccgtaggtaccagacgaacgtaaaccgtcggaccgaacgggtcccacggtcctacctctacttacttattacgtcgacctaactacccgaacggtacgggacccctaaggtcgacctaccgtacccgaggtaccgtacggtacgtaggtacggtcgtagggttccgggtacgttacgggaaccctaacggttacccttaccgtaccgttacctacccgaaccgttacgtaaccgacggtacgtaacggtacgtacgggtaccgtaccgttaaggtaacgttatttacggactagtttaacgtctaacgtcgtaactaacgttacgtaccgttacgttacccttacgttcccggtttcacggtttacccgggacgttaacgaacgtaacggtccgtaaacgtacctaaacggtaaccgggtntaccggtacgaccgttaacncccgtacgttccttacgttaccttaccgttccgtaacccgtttccggaaccccttaccgtaaggttccccgtaagtttcccgggtaacgttcccttacccgggtagttaccggggtaccgg

SEQ ID NO: 293379 - DNA, 426 bp, Homo sapiens
  misc_feature: GYAE6OF02IJPHP.45.60.F05.1.454.CMB.1.raw
  modified_base (290)..(290): a, c, t, g, unknown or other
  misc_feature (290)..(290): n is a, c, g, or t
  modified_base (332)..(332): a, c, t, g, unknown or other
  misc_feature (332)..(332): n is a, c, g, or t
  modified_base (342)..(342): a, c, t, g, unknown or other
  misc_feature (342)..(342): n is a, c, g, or t
  modified_base (355)..(355): a, c, t, g, unknown or other
  misc_feature (355)..(355): n is a, c, g, or t
  modified_base (360)..(360): a, c, t, g, unknown or other
  misc_feature (360)..(360): n is a, c, g, or t
  modified_base (380)..(380): a, c, t, g, unknown or other
  misc_feature (380)..(380): n is a, c, g, or t
  modified_base (400)..(400): a, c, t, g, unknown or other
  misc_feature (400)..(400): n is a, c, g, or t
  modified_base (415)..(426): a, c, t, g, unknown or other
  misc_feature (415)..(426): n is a, c, g, or t
tcagacgcgatcgacacgaccggtgctcgatttagtacgtcatcagggaaggggctggagtgggtgggtctcattagaagcaaagcttctggggggacaacagactacgccgcgtctgtgaaaggcagattcaccatctcaagagatgattccaaaagtgtcgcccatctgcaaatgaacagcctgaaaaccgaggacacagccatgtattactgtactagaggggtagggtcgctggtccggtaactcccactactggggccagggaaccctggtcaccgtctcctcancctccaccaagggcccatcgtctcccctggcgcctgctcagngcacctcganagcacagcggccngggcngcctgtcaaggctacttccncatcgcgtctgacgcgggcnggcaaggcgcatagnnnnnnnnnnnn

SEQ ID NO: 293380 - DNA, 743 bp, Homo sapiens
  misc_feature: GYAE6OF02JD009.45.60.F05.1.454.CMB.1.raw
tcagacgcgatcgacacgaccggtgctcgatttagtacgtcatcagggaaagggaaccatggaaaccccagcgcagcttctcttcctcctgctactctggctcccagataccaccggagaaattgtgttgacgcagtctccaggcaccctgtccttgtctccaggggaaagagccaccctctcctgcagggccagtcagactattactggcagctactagcctggtaccagcagaaacctggccagggtcccaggcctcctcatctattatcgcactccaacgagggtcccaacgtggcctactccccaagacctaggttccaggttcggcctaggtcggggtcctaggggacaaggtaccgtttcaaccgttccaccgtaacccaattaccgacgtacgaacggtaacgtgggaaccgtcccgttagggaaaacggttacgtttttggacccgttaaggtttagtttaacgtttaaccgttacggttaaccaaacgttaaggttaacgttcgggttaacccttacccgttaaccctttccggttaccgttttcccgggtacccccggtttacggggaacccttaaacgggtccgggtaaactaaccgttaaccgaaaccggtaactcgggttacggtccgttacgacctaacccgtaattccgttagttcccgtacgttacctcccgtttacccggtacctacgttccctagtacgttccgagtacccggtcgttacgtcgg

SEQ ID NO: 293381 - DNA, 455 bp, Homo sapiens
  misc_feature: GYAE6OF02HRVD3.45.60.F05.1.454.CMB.1.raw
  modified_base (397)..(397): a, c, t, g, unknown or other
  misc_feature (397)..(397): n is a, c, g, or t
  modified_base (438)..(455): a, c, t, g, unknown or other
  misc_feature (438)..(455): n is a, c, g, or t
tcagacgcgatcgacacgaccggtgctcgatttagtacgtcatcagggaaaggggctggagtgggtgggtctcattagaagcaaagcttctggggggacaacagactacgccgcgtctgtgaaaggcagattcaccatctcaagagatgattccaaaagtgtcgcccatctgcaaatgaacagcctgaaaaccgaggacacagccatgtattactgtactagaggggtaggtcgctgtccggtaactcccactactggggccaggaaccctggtcaccgtctcctcagcctccaccaagggccccatccggtccttcccccctggccgccctgcctccaggagccaccctccgagagcacagcggcccgtgggctgcctggtcaaggactacttccncgactcgcgtctgacggcgggctggaaacaggcgcagtagnnnnnnnnnnnnnnnnnn

SEQ ID NO: 293382 - DNA, 437 bp, Homo sapiens
  misc_feature: GYAE6OF02JDU9L.45.60.F05.1.454.CMB.1.raw
  modified_base (335)..(335): a, c, t, g, unknown or other
  misc_feature (335)..(335): n is a, c, g, or t
  modified_base (427)..(437): a, c, t, g, unknown or other
  misc_feature (427)..(437): n is a, c, g, or t
tcagacgcgatcgacacgaccggtgctcgatttagtacgtcatcagggaaaggggctggagtgggtgggtctcattagaagcaaagcttctggggggacaacagactacgccgcgtctgtgaaaggcagattcaccatctcaagagatgattccaaaagtgtcgcccatctgcaaatgaacagcctgaaaaccgaggacacagccatgtattactgtactagaggggtaggtcgctgtccggtaactcccactactggggccagggaaccctggtcaccgtctcctcagcctccaccaaggccatcgtcttccccctgccgccctgctccaggcncacctccgagagcacagccggccctgggctcgcctggtcaaggtcctacttcctcgatccgcgtctgacgcgggctggcgaaggcgcatagnnnnnnnnnnn

SEQ ID NO: 293383 - DNA, 606 bp, Homo sapiens
  misc_feature: GYAE6OF02GKLL8.45.60.F05.1.454.CMB.1.raw
  modified_base (246)..(246): a, c, t, g, unknown or other
  misc_feature (246)..(246): n is a, c, g, or t
  modified_base (512)..(512): a, c, t, g, unknown or other
  misc_feature (512)..(512): n is a, c, g, or t
  modified_base (522)..(522): a, c, t, g, unknown or other
  misc_feature (522)..(522): n is a, c, g, or t
  modified_base (527)..(527): a, c, t, g, unknown or other
  misc_feature (527)..(527): n is a, c, g, or t
  modified_base (538)..(538): a, c, t, g, unknown or other
  misc_feature (538)..(538): n is a, c, g, or t
  modified_base (542)..(542): a, c, t, g, unknown or other
  misc_feature (542)..(542): n is a, c, g, or t
tcagacgcgatcgacacgaccggtgctcgattttagtacgtcatcagggaaaggggctggagtcggtgggtctcattagaagcgaaagtcttctggggggacaacagactacgccgcgtctgtgaaaggcagattcaccatcgtcaagagatgtattccaaaagtgtcgtcccatctgcaaatgaacagcctagaaaaccgaggacacgagggccatgtattactggtactacgaggggtaggtcnctcgtccggtaactcccactacgtgggccaggaaccctggtcaccgtctcctcagcctccaccaagggccccatcggtctccccgtggcgccctgctccgaggacgcaccgtccgagacgcaacgagccggtacccgtgggaccttcgaccgttcggtacaaacgggtaccttaaccgttcccgtccgtaacgttccgacgttcgttcggaacggccggggtcttacgggaccgtaaacgggccgacgtaacgttacggctgtacncgacacgagngtacncgtaagcgagngcgngtatcgtagtagagtagagagagtcgagcgcgacgtacgtactacgtactcgtacgtcgagtcg

SEQ ID NO: 293384 - DNA, 432 bp, Homo sapiens
  misc_feature: GYAE6OF02G2V7T.45.60.F05.1.454.CMB.1.raw
  modified_base (338)..(338): a, c, t, g, unknown or other
  misc_feature (338)..(338): n is a, c, g, or t
  modified_base (427)..(432): a, c, t, g, unknown or other
  misc_feature (427)..(432): n is a, c, g, or t
tcagacgcgatcgacacgaccggtgctcgatttagtacgtcatcagggaaaggggctggagtgggtgggtctcattagaagcaaagcttctggggggacaacagactacgccgcgtctgtgaaaggcagattcaccatctcaagagatgattccaaaagtgtcgcccatctgcaaatgaacagcctgaaaaccgaggacacagccatgtattactgtactagaggggtaggtcgctgtccggtaactcccactactggggccagggaaccctggtcaccgtctcctcagcctccaccaagggcccatcggtcttccccctggccgccctgctccaggngcacctccgagagcacagccggccctgggctcgcctggtcaaggactacttcctcgatcgcgtctgacgcgggctggcaggcgcatagnnnnnn

SEQ ID NO: 293385 - DNA, 597 bp, Homo sapiens
  misc_feature: GYAE6OF02JW71Y.45.60.F05.1.454.CMB.1.raw
  modified_base (144)..(144): a, c, t, g, unknown or other
  misc_feature (144)..(144): n is a, c, g, or t
  modified_base (197)..(197): a, c, t, g, unknown or other
  misc_feature (197)..(197): n is a, c, g, or t
  modified_base (205)..(205): a, c, t, g, unknown or other
  misc_feature (205)..(205): n is a, c, g, or t
  modified_base (237)..(237): a, c, t, g, unknown or other
  misc_feature (237)..(237): n is a, c, g, or t
  modified_base (339)..(339): a, c, t, g, unknown or other
  misc_feature (339)..(339): n is a, c, g, or t
  modified_base (364)..(364): a, c, t, g, unknown or other
  misc_feature (364)..(364): n is a, c, g, or t
  modified_base (521)..(521): a, c, t, g, unknown or other
  misc_feature (521)..(521): n is a, c, g, or t
  modified_base (527)..(527): a, c, t, g, unknown or other
  misc_feature (527)..(527): n is a, c, g, or t
  modified_base (530)..(530): a, c, t, g, unknown or other
  misc_feature (530)..(530): n is a, c, g, or t
  modified_base (536)..(536): a, c, t, g, unknown or other
  misc_feature (536)..(536): n is a, c, g, or t
  modified_base (548)..(548): a, c, t, g, unknown or other
  misc_feature (548)..(548): n is a, c, g, or t
  modified_base (553)..(553): a, c, t, g, unknown or other
  misc_feature (553)..(553): n is a, c, g, or t
  modified_base (564)..(564): a, c, t, g, unknown or other
  misc_feature (564)..(564): n is a, c, g, or t
  modified_base (590)..(590): a, c, t, g, unknown or other
  misc_feature (590)..(590): n is a, c, g, or t
  modified_base (595)..(596): a, c, t, g, unknown or other
  misc_feature (595)..(596): n is a, c, g, or t
tcagacgcgatcgacacgaccggtgctcgatttagtacgtcatcagggaaagggcgtggagtgggtgggtctcattagaagcaaagcttctgggggacaacagactacgccgcgtctgtgaaaggcagattcaccatctcaagngatgattccaaaagtgtcgcccatctgacaaatgaacagcctagaaaaaccgnggacaacngccatgtattactgtacagaggggtaggtcgntacggtcccggtaaactcccgaactacggtggggcccagggaaccctggtccaccgtctcctcacgcctccgaccagggcccactccgggttccttccccgnggccgtccctcgcctccgagggacnccgaccctccgagacggacctacgacggcccggtcccgtgggactcggtccctagggttaccaaacgggtacctttccgttcccgtaccggagtcccgggtaccgttcgtacggtacgccgggacgttcggacgacggtaccggccgtacgtacgcngcgagngcncgcacngtcgagtcactncgcgngcgcgcgcgcncgcgcgcgcgcgtcgcgcgacgacgncgtcnnc

SEQ ID NO: 293386 - DNA, 612 bp, Homo sapiens
  misc_feature: GYAE6OF02F82N5.45.60.F05.1.454.CMB.1.raw
  modified_base (171)..(171): a, c, t, g, unknown or other
  misc_feature (171)..(171): n is a, c, g, or t
  modified_base (260)..(260): a, c, t, g, unknown or other
  misc_feature (260)..(260): n is a, c, g, or t
  modified_base (376)..(376): a, c, t, g, unknown or other
  misc_feature (376)..(376): n is a, c, g, or t
tcagacgcgatcgacacgaccggtgctcgatttagtacgtcatcagggaaagggaaccatggaaaccccagcgcagcttctcttcctcctgctactctggctcccagataccaccggagaaattgtgttgacgcagtctccaggcaccctgtccttgtctccaggggaaangccaccctctcctgcagggccagtcagactattactggcagctacttagcctggtaccagcagaaacctggccagggtcccaggctccncatctattatgcatccaacgacgggccacgtggcactcccagacaggttcagtggcaggtcgggtcgtgggacagacttcactctcaccatcagcagacgtggacgcctagaagtnttttgctagttagtattacgtcgtacaacgtagttactcggtaccttcgtaccctttccgtcgtttcccggtacccgtacgggtaacctaaacggtcggaactaacgtaaccgtaaacggtaactggtcggtaccgtcgacctaacctacttacgttcgttaccttactacctttcccttccccgtaccttaccttcgtacgtacgttaccgtacgttccggtccgttcgtacggg

SEQ ID NO: 293387 - DNA, 697 bp, Homo sapiens
  misc_feature: GYAE6OF02I5B2Q.45.60.F05.1.454.CMB.1.raw
  modified_base (170)..(170): a, c, t, g, unknown or other
  misc_feature (170)..(170): n is a, c, g, or t
  modified_base (196)..(196): a, c, t, g, unknown or other
  misc_feature (196)..(196): n is a, c, g, or t
  modified_base (216)..(216): a, c, t, g, unknown or other
  misc_feature (216)..(216): n is a, c, g, or t
  modified_base (657)..(657): a, c, t, g, unknown or other
  misc_feature (657)..(657): n is a, c, g, or t
  modified_base (660)..(660): a, c, t, g, unknown or other
  misc_feature (660)..(660): n is a, c, g, or t
  modified_base (664)..(664): a, c, t, g, unknown or other
  misc_feature (664)..(664): n is a, c, g, or t
  modified_base (666)..(666): a, c, t, g, unknown or other
  misc_feature (666)..(666): n is a, c, g, or t
  modified_base (682)..(682): a, c, t, g, unknown or other
  misc_feature (682)..(682): n is a, c, g, or t
  modified_base (684)..(685): a, c, t, g, unknown or other
  misc_feature (684)..(685): n is a, c, g, or t
  modified_base (689)..(693): a, c, t, g, unknown or other
  misc_feature (689)..(693): n is a, c, g, or t
  modified_base (695)..(696): a, c, t, g, unknown or other
  misc_feature (695)..(696): n is a, c, g, or t
tcagacgcgatcgacacgaccggtgctcgatttagtacgtcatcagggaaaggggctggagtgggtgggtctcattagaagcaaagcttcgtgggggacaacagactacgccgcgtctgtgaaaggcagattcaccatctcaagagatgattccaaaagtgtcgccatcngcaaatgaacagcctagaaaaaccgngacacagccatgtattactntactagaggggtaggtctctgtccggtaactccactacgtggggaccacggggaaaccctggtaccaccgtctcctgacgccctcaaccgaacgggtccctacttccggtaccctttcccccctagggccgtcccccttggacccttccggtaaccgggacgtaccgaccccttacccgggacggtaacggcccaaaccgaccgggtcccgggtacccccgttcgggggtaccctccggtacccgttttaggggtaccccaaaacggggtaacccctttaaccccgttttcccccgggtaccgggtaatttccccgggggtaccccgttcggtttaccgggaaccgggtccggggtacccgtcggggtaccgtaaaccgggccggtaccgtaacggtacggctacgtcgacgtccgaagcgccgagcgcgcgcgtgcgtcncgngacncncgcgcgtgcgcgcgcncnncgcnnnnncnnc

SEQ ID NO: 293388 - DNA, 876 bp, Homo sapiens
  misc_feature: GYAE6OF02H0FWL.45.60.F05.1.454.CMB.1.raw
  modified_base (171)..(171): a, c, t, g, unknown or other
  misc_feature (171)..(171): n is a, c, g, or t
tcagacgcgatcgacacgaccggtgctcgatttagtacgtcatcagggaaagggaaccatggaaaccccagcgcagcttctcttcctcctgctactctggctcccagataccaccggagaaattgtgttgacgcagtctccaggcaccctgtccttgtctccaggggaaanagccaccctctcctgcagggccagtcagactattactggcagctacttagcctggtaccagcagaaacctggccagggtcccaggcctcctcatctattatgctataccaacagggcccacgtcggccactccccgaagaccgtagggttccaggtcgggacctagggttcggggtccttaggggactacggtacctttccaacgtcctaccaacctatcgaacgtcaacggacgttagggacgtcccgtaggtaacgttagtttttcggaaccgttaaggtttacgtttaacgtttaaccgttacgttaaccgtaaacgttaacggttaacggtttacggtttaaccccgtttacccgttttaaccccggttttttaccggttacccgggtttttttaccccgggtacccccggtttaaacggggggttaaaaccccgtaaaaggggttacccgggtaaacgttaaccgtttaaacccggtaaaaacccgggttaaccgtttacggggtacgggttaacccgttacggtaacccgttaacccgttaacgtttaccgttttacccggtttaacccttttccggttaaaccccgttttaccccgtttacccccggtaaccccgttaaccgttttacccggttacggttaacccggtttacccggttaacccgtttcccgggttacccggtttaccggtaccggggg

SEQ ID NO: 293389 - DNA, 630 bp, Homo sapiens
  misc_feature: GYAE6OF02GEADW.45.60.F05.1.454.CMB.1.raw
  modified_base (331)..(331): a, c, t, g, unknown or other
  misc_feature (331)..(331): n is a, c, g, or t
tcagacgcgatcgacacgaccggtgctcgatttagtacgtcatcagggaaagggaaccatggaaaccccagcgcagcttctcttcctcctgctactctggctcccagataccaccggagaaattgtgttgacgcagtctccaggcaccctgtccttgtctccagggggaaagagccaccctctcctgcagggccagtcagactattactggcagctacttagcctggtaccagcagaaaccgtggccagggtcccaggctcctcatctattatgcatccaacagggccacgtggcatcccagacaggttcagtggcagtgggtctgggacngacttcactctcacatcagcagactggacgccgtagaagtagttttgcgtagtgttaattactgtacaaacgtagttaatcggttacccttctacccttttcggtcctttccgggccccgttaggggaacctaaacggtcggtaacctaacgtaacgtaaaacccgtaacgtcggttacgggtaccttcggaccctaaccctagttaccgttcggttaccttaccgttaactttcccgttaccccgaccgttacttccttacgtaccttccgtacgttcccggtaccggttcgtacggg

SEQ ID NO: 293390 - DNA, 522 bp, Homo sapiens
  misc_feature: GYAE6OF02G3J97.45.60.F05.1.454.CMB.1.raw
  modified_base (447)..(447): a, c, t, g, unknown or other
  misc_feature (447)..(447): n is a, c, g, or t
  modified_base (455)..(455): a, c, t, g, unknown or other
  misc_feature (455)..(455): n is a, c, g, or t
  modified_base (479)..(479): a, c, t, g, unknown or other
  misc_feature (479)..(479): n is a, c, g, or t
tcagacgcgatcgacacgaccggtgctcgatttagtacgtcatcagggaaagggaaccatggaaaccccagcgcagcttctcttcctcctgctactctggctcccagataccaccggagaaattgtgttgacgcagtctccaggcaccctgtccttgtctccaggggaaagagccaccctctcctgcagggccagtcagactattactggcagctacttagcctggtaccagcagaaacctggccagggtcccaggctcctcatctattatgcactccaacgacggccacgtggcactcccagacaggttcagtggcaggtgggtctgggacagtagttcactctcaccgtcagcagccgtggacgcctagatgtattttgacttacgtttacttctgtcagctagtccgttccgcctccgccgcttcgtacgttcgggcggggacngggtgagntggagacgacgtgtgctgcacctntcgtgtctctcttcctcccgctctctcgctcgcgtcgtcgtcg

SEQ ID NO: 293391 - DNA, 737 bp, Homo sapiens
  misc_feature: GYAE6OF02H9KSU.45.60.F05.1.454.CMB.1.raw
  modified_base (170)..(170): a, c, t, g, unknown or other
  misc_feature (170)..(170): n is a, c, g, or t
tcagacgcgatcgacacgaccggtgctcgattttagtacgtcatcagggaaagggaaccatggaaaccccagcgcagcttctcttcctcctgctactctggctcccagataccaccggagaaattgtcttgacacagtctccagccattctgtctctctctccagggganacagccaccctctcatgcgaggccagtcagatatagaacatactggccttggtatacaaatacaagcctggaccgacgggtccccgctcctcatctatgatgcttcagcgacgggcctacgtcggactacgtccccgagtaccgtacggtttcgagggttcggggtacgggtttggggtttacggacctaacgtacggtacctttcgaaccttcgtacaacgtaactcgaagccaacgtcccctaacaaaccgtagtaacgttactttttacggacgtacgtttactttaacttttaacgtacgtaaccaacgtagtaccgtaaacgtaggtacgttaccgggtacccgttaccttacgttaccggttttacggggacgggtaaccggggtaacgtaaggggttacgggacgtaacgttaaccggaaaccggttaacgttacgggtacgtaccgttacggacccgtaaccgtaacgtttcccgttaggttacccttacgttaacccgtttcccgttaccccggtacttaaccgttaccgttacgtacggttacccgtagtttcccgg

SEQ ID NO: 293392 - DNA, 639 bp, Homo sapiens
  misc_feature: GYAE6OF02GOPUT.45.60.F05.1.454.CMB.1.raw
tcagacgcgatcgacacgaccggtgctcgatttagtacgtcatcagggaaagggaaccatggaaaccccagcgcagcttctcttcctcctgctactctggctcccagataccaccggagaaattgtcttgacacagtctccaggcaccctgtctctgtctccaggggagacagccaccctctcctgcagggccagtaggagtgtcagtaagtacttaggctggtaaccaacagaaacctggccaggcctcccaggctcctcactccatgatgcataccaacgtacgggtccctggccgtcccagacgtacggttccgtggcgaggtcgggtctgggacaggtagttcactctcaccgtcagcacgccgtggactccgtgatggtattttcgcttacgttttactcgttgtcgacgcgtacgtccgtttccgccgtaccggcccgtcttccgtacggtttccggggcgggggtaccgtaggggttcgggaacggtagtggaacggtaacggtaacgttggtacggtcgtcggacctaaccgtacgttccgttcggttccttcgtaacctttccgttccccgccttacgtccgttcgtacgttaccgacgttccggtacgttcggtacggtcggtaccggg

SEQ ID NO: 293393 - DNA, 628 bp, Homo sapiens
  misc_feature: GYAE6OF02H94KP.45.60.F05.1.454.CMB.1.raw
  modified_base (329)..(329): a, c, t, g, unknown or other
  misc_feature (329)..(329): n is a, c, g, or t
tcagacgcgatcgacacgaccggtgctcgatttagtacgtcatcagggaaagggaaccatggaaaccccagcgcagcttctcttcctcctgctactctggctcccagataccaccggagaaattgtgttgacgcagtctccaggcaccctgtccttgtctccaggggaaagagccaccctctcctgcagggccagtcagggtgttaacagctacttagcctggtaccaacaaaaacctggaccaggctcccaggctcatcatctatgacgcatcgaacagggtccctggcgtcccagactaggttcgtaggcaggtgggtactgggacngacgttcactctcaccgtcagctacgcctgggacgcctgatgtattttgctatttactctgtcagctaggccgtttcccgccgtaccggccgactccgtacgtttccggggcgggggtaccgtaggggttggagtacgtggacgaacggtaacctgggtagggccttaggacctaaccgtatccgttcgttccttaccgtaacttcccgtttaccccgtacgtaccgttcctaacggtacgtaccggtactccggttccgttaccgttgggaccggtcggggtccgtacgggtaaccgg

SEQ ID NO: 293394 - DNA, 691 bp, Homo sapiens
  misc_feature: GYAE6OF02GXODT.45.60.F05.1.454.CMB.1.raw
tcagacgcgatcgacacgaccggtgctcgatttagtacgtcatcagggaaagggaaccatggaaaccccagcgcagcttctcttcctcctgctactctggctcccagataccaccggagaaattgtgttgacgcagtctccaggcaccctgtccttgtctccaggggaaagagccaccctctcctgcagggccagtcagactattactggcagctacttagcctggtaccagcagaaacctggccagggtcccaggctcctcatctattatgcactccaacgacgggccacgtcggacacgtcccagacctaggttcaggtggcaggtcgggtcgtgggacacggtaccttcgacttccgtaccaccgtactcgaacgcaacggtacgtagggacgaccgttagaaaggttacgtttttcgacgtaggttagttaactttacgttagttacctaaacgtaggttacgttacggttaccttaccgttaccgttttccggtaccttttcccgggaccccgttacgggtaaaccctaaagggtccggtaacctacgttaacccgaaacggtaaccgttgggtaccggtaccttacgacctaacctacgttaccgttcgttacccgttaccgttaccttaccctttcccgacctacttcgtacgtacgttccgtacgtccggtacgtcgtacggg

SEQ ID NO: 293395 - DNA, 676 bp, Homo sapiens
  misc_feature: GYAE6OF02IX4VY.45.60.F05.1.454.CMB.1.raw
tcagacgcgatcgacacgaccggtgctcgatttagtacgtcatcagggaaagggggggagaggagccccagccgtgagattcccaggagtttccacttggtgatcagcactgaacacagaccaccaaccatggagtttgggcttagctgggttttccttgttgctattttaaaggtgtccaatgtgaagtgcagctggtggagtcgtgggggagacgttggtacaggccgaggggcggtccctggagagtctcctgtatagcttcgtggattctacctttggtgattatactatgaccgtggtccgccaggctcgagggagggcgtggagtgggtggtctcagtagagcaaagcgttcgtggggacacgagacgtaccgccgcgtctgtaggaagacgagtattaccacctactactcgaagagatacgtaagttacccaaaagttcgtaccgtaccctacttaccgttagaaccgtaaatacgaaccgtaacgtaccgtaaaccgaaaaccggaacggaaccaaccgacgaacccgtagttacgttaactttacgttaacgtaaccgttagggtacggggtagggtaccggtacggtaccggttaccggtaaccgtacccgtaaccgtaccggtcgggtacccgacggtaacccccggttggacccgttaccccg

SEQ ID NO: 293396 - DNA, 491 bp, Homo sapiens
  misc_feature: GYAE6OF02HCEPX.45.60.F05.1.454.CMB.1.raw
  modified_base (474)..(491): a, c, t, g, unknown or other
  misc_feature (474)..(491): n is a, c, g, or t
tcagacgcgatcgacacgaccggtgctcgatttagtacgtcatcagggaaaggggctggagtgggtgggtctcattagaagcaaagcttctggggggacaacagactacgccgcgtctgtgaaaggcagattcaccatctcaagagatgattccaaaagtgtcgcccatctgcaaatgaacagcctagaaaaccgaggacacagccatgtattactgtactagaggggtagggtcgctgtccggtaactcccatacgtgggccaggaaccctggtcaccgtctcctcagccctccaccgaagggccccatccggtccttcccccgtggccgccccgtgcctccgaggacgccaccctccggagacgccacacggtccggcccgttggggcctcggcctcggtacaacgggtacttaccttccctcggattccgcgttcgtcggacggccgggctcggcgaacggcgacagtagnnnnnnnnnnnnnnnnnn

SEQ ID NO: 293397 - DNA, 574 bp, Homo sapiens
  misc_feature: GYAE6OF02IKSO5.45.60.F05.1.454.CMB.1.raw
  modified_base (374)..(374): a, c, t, g, unknown or other
  misc_feature (374)..(374): n is a, c, g, or t
tcagacgcgatcgacacgaccggtgctcgatttagtacgtcatcagggaaagggaaccatggaaaccccagcgcagcttctcttcctcctgctactctggctcccagataccaccggagaaattgtgttgacgcagtctccaggcaccctgtccttgtctccaggggaaagagccaccctctcctgcagggccagtcagactattactggcagctacttagcctggtaccagcagaaacctggccagggtcccaggcctcctcatctattatgcatccaacagggccactggcactcccagacaggttcaggtggcaggtgggtctgggacagtacttcactctcaccatcagcagacgtggagcctagaagtnttttgcgtagtgttattactgtacaacgtagttactggtacctctacctttcgtccgttttccggcccgttacgggtacctaaaggtcggtactacgtaccaaacgtacgttgtacggtcctcgaccaccgtactctcgttccttctacttcccttcccgtcctactcgtcgtacgtcgtacgtcgtccgttcgtacggg

SEQ ID NO: 293398 - DNA, 762 bp, Homo sapiens
  misc_feature: GYAE6OF02JJD5N.45.60.F05.1.454.CMB.1.raw
  modified_base (228)..(228): a, c, t, g, unknown or other
  misc_feature (228)..(228): n is a, c, g, or t
  modified_base (520)..(520): a, c, t, g, unknown or other
  misc_feature (520)..(520): n is a, c, g, or t
  modified_base (737)..(737): a, c, t, g, unknown or other
  misc_feature (737)..(737): n is a, c, g, or t
tcagacgcgatcgacacgaccggtgctcgatttagtacgtcatcagggaaagggaaccatggaaaccccagcgcagcttctcttcctcctgctactctggctcccagataccaccggagaaattgtgttgacgcaggtctccaggcaccctcgtccttgtctccagggaaaggagccaccctctcctgcgagggccagtcgacgactattactggcagctacgttacncctagggttaccagacacgtaaaaccgtcggaccgacgggtcccaggtctacctctactcgttatggactcgtccttaccgacgcgtacggggtccacgtcggactaaccgttcccaacggtacccgtacggttccgtaacgggtcggggtaccggggtttcggggtttaaggcccgtaaaacgaccgttaacgttcccgtaacgttccgtaccgtaacctaaacgtttccgaacggtacctaacggccccctttaaccgtaaacccgtaggttaaaccgttattttccggntaaccgtttacgtacgtttacctacgtaccgtaactacggtacgtacgtaagtcgttaccgtccgtaccgttcgttaccggttaccgggacgggtaacgggaaccggtaagggttacggacggtaactaaccggtaaacgtacgtacggtagtccgtacgacgacctagtaccgttagtccgttacgtattccctaccggtaccctagtacgttacncggtaccgtacgtcgtccggtccgg

SEQ ID NO: 293399 - DNA, 727 bp, Homo sapiens
  misc_feature: GYAE6OF02JRMQV.45.60.F05.1.454.CMB.1.raw
  modified_base (349)..(349): a, c, t, g, unknown or other
  misc_feature (349)..(349): n is a, c, g, or t
  modified_base (406)..(406): a, c, t, g, unknown or other
  misc_feature (406)..(406): n is a, c, g, or t
  modified_base (416)..(416): a, c, t, g, unknown or other
  misc_feature (416)..(416): n is a, c, g, or t
tcagacgcgatcgacacgaccggtgctcgatttagtacgtcatcagggaaagggaaccatggaaaccccagcgcagcttctcttcctcctgctactctggctcccagataccaccggaaaaattgtgttgacacagtctccaggcaccctgtctctgtctccaggggagacagccaccctctcctgcacgggccaggtaggagtgtccgagtaagtacttaggctggtacacgaagaacgtacgcgacgcgacctacgacgtccacactccagtgtactctcactaccacgacggtcccgtcgacgcctacgactcggtacgtcgcgtaggtcggtcgtacggacggcnggttacctgtacctcgaccgtcgaacggtccacgacgtcggactccggtcgttaagngtttaccgtntttccgaacggttttaccgttttacgcgttcgtacgtaccgtcgtaccggttccgtcccgtaccgtacccggtcgttacctaccggttccggggttcccggggaccgggtaccgggtagggtaaccggtacggtacgggtacggtaaccggacgtacggtacgggtcgtaccggtaccgtaaccgttccgtaacgttccgttacgttaaccgttcccgttaccggttacccgtaaccgttccgttacttccggtaaccgtcggttaccgtacggtcccgttccggttacggtacgggtccgggttaccggg

SEQ ID NO: 293400 - DNA, 506 bp, Homo sapiens
  misc_feature: GYAE6OF02GB9J8.45.60.F05.1.454.CMB.1.raw
  modified_base (360)..(360): a, c, t, g, unknown or other
  misc_feature (360)..(360): n is a, c, g, or t
  modified_base (502)..(502): a, c, t, g, unknown or other
  misc_feature (502)..(502): n is a, c, g, or t
tcagacgcgatcgacacgaccggtgctcgatttagtacgtcatcagggaaagggaaccatggaaaccccagcgcagcttctcttcctcctgctactctggctcccagataccaccggagaaattgtgttgacgcagtctccaggcaccctgtccttgtctccaggggaaagagccaccctctcctgcagggccagtcagactattactggcagctacttagcctggtaccagcagaaacctggccagggtcccaggctcctcatctattatgcatccaacagggccactggcatcccagacaggttcagtggcagtgggtctgggacaggacttcgactctcaccatcagcagactggancctagaagtattttgctagtgttattacgtgtcaactacgtatggtacctcgacctttcgctttcgcctggacctaaagtcgacatacaacgactgtggctgcacatctgtcttcatctcccgcatctgactcgatcgcgtntcgg

SEQ ID NO: 293401 - DNA, 661 bp, Homo sapiens
  misc_feature: GYAE6OF02JE7NA.45.60.F05.1.454.CMB.1.raw
  modified_base (171)..(171): a, c, t, g, unknown or other
  misc_feature (171)..(171): n is a, c, g, or t
tcagacgcgatcgacacgaccggtgctcgatttagtacgtcatcagggaaagggaaccatggaaaccccagcgcagcttctcttcctcctgctactctggctcccagataccaccggagaaattgtgttgacgcagtctccaggcaccctgtccttgtctccaggggaaangccaccctctcctgcaggccagtcagactattactggcagctattagcctggtaccagcagaaacctggaccagggtcccaggctcctcatctattatcgcactccaacgagggcccagtcggcactcccgaagacgtaggttccaggtcgaccgaggttcgggtcttagggactaggtaccttacacttctacacctatccagacagtacgtggacgtcctagaagtatttcgactagttcgtaactttacgtagttaaccaaacgtacgttaacgttacgggttaacccttaccgttaccgtttccgtacgttttcccggaccgttacgggaaaccctaaaggttcgaaccgtaagttaccgaaaacgtacttcggtacggacgttacgtaccgtaacctacgttacgttcgttacttaccgtacttacccgttcccgaccttacgttccgtacgtaccgtacgtacgtccggtacgttacgtacggg

SEQ ID NO: 293402 - DNA, 686 bp, Homo sapiens
  misc_feature: GYAE6OF02ILM2S.45.60.F05.1.454.CMB.1.raw
  modified_base (283)..(283): a, c, t, g, unknown or other
  misc_feature (283)..(283): n is a, c, g, or t
  modified_base (291)..(291): a, c, t, g, unknown or other
  misc_feature (291)..(291): n is a, c, g, or t
tcagacgcgatcgacacgaccggtgctcgatttagtacgtcatcagggaaagggaaccatggaaaccccagcgcagcttctcttcctcctgctactctggctcccagataccaccggagaaattgtgttgacgcagtctccaggcaccctgtccttgtctccaggggaaagagccaaccctctcctgcagggccagtcagactattactggcagctacttagcctggtaccagcagaaacctggccagggtcccaggctcctcatctattatgcactccaacngggccacncggcatcccagacaggttcaggtgcagtgggtctagggcagtactcgactctcaaccatacgagacagtacgtggagcccgttaggaaacgtatttttacggacttacggttagttagtttaacgtagttaccaacgtaaggtttattacgggtacccttacgtacccgttttccgtacgttttccgggtcccgtacgggtaacccgtaaaggttacggtaccgtaacgtaaccggtaaaccgtaaaccgttcggttacgggtaccgttacggacctaaccgtacttaccggttcgttacctttacggaccttttacccttccccggtaacccttacgttccgttaccggttacgttacccgggtaccttacccggtaccggttacgtaccgggg

SEQ ID NO: 293403 - DNA, 490 bp, Homo sapiens
  misc_feature: GYAE6OF02GLDBK.45.60.F05.1.454.CMB.1.raw
  modified_base (471)..(472): a, c, t, g, unknown or other
  misc_feature (471)..(472): n is a, c, g, or t
  modified_base (474)..(490): a, c, t, g, unknown or other
  misc_feature (474)..(490): n is a, c, g, or t
tcagacgcgatcgacacgaccggtgctcgatttagtacgtcatcagggaaaggggctggagtgggtgggtctcattagaagcaaagcttctggggggacaacagactacgccgcgtctgtgaaaggcagattcaccatctcaagagatgattccaaaagtgtcgcccatctgcaaatgaacagcctagaaaaccgaggacacagccatgtattactgtactaggaggggtagggtcgctgtccggtaactcccactacgtggggccagggaaccctggtccaccgtctcctcagcctccaccaacgggccccatccggtccttccccccgtggccgcccctgcctccaggcgccaccgtccgagagcacacgccggccctggggcctcggccgtggtacaagggaccttaccgttccctcgactccggtcgtcgtgacggcgggctcgggacgaagggccgacgtagtagnngnnnnnnnnnnnnnnnnn

SEQ ID NO: 293404 - DNA, 545 bp, Homo sapiens
  misc_feature: GYAE6OF02I78BX.45.60.F05.1.454.CMB.1.raw
  modified_base (352)..(352): a, c, t, g, unknown or other
  misc_feature (352)..(352): n is a, c, g, or t
  modified_base (503)..(503): a, c, t, g, unknown or other
  misc_feature (503)..(503): n is a, c, g, or t
  modified_base (506)..(507): a, c, t, g, unknown or other
  misc_feature (506)..(507): n is a, c, g, or t
  modified_base (513)..(513): a, c, t, g, unknown or other
  misc_feature (513)..(513): n is a, c, g, or t
  modified_base (515)..(522): a, c, t, g, unknown or other
  misc_feature (515)..(522): n is a, c, g, or t
  modified_base (524)..(524): a, c, t, g, unknown or other
  misc_feature (524)..(524): n is a, c, g, or t
  modified_base (526)..(545): a, c, t, g, unknown or other
  misc_feature (526)..(545): n is a, c, g, or t
tcagacgcgatcgacacgaccggtgctcgatttagtacgtcatcagggaaaggggctggagtgggtgggtctcattagaagcaaagcttctggggggacaacagactacgccgcgtctgtgaaaggcagattcaccatctcaagagatgattccaaaagtgtcgcccatctgcaaatgaacagcctgaaaaccgaggacacagccatgtattactgtactagaggggtaggtcgctgtccggtaactcccactacgtggggccaggggaaccctggtaccaccgtctcctcacgcctccacaacggcccagtccggtccttcccccgtggccgccctggcctccgagggacnccacccgtcgaacgaaccacgaggcccggcccgtcgggctcgccgttcggtacgaaacgggtccttaccgtttcccacgtactccggtccgttacgtcgggacggcccgggtcgtcgggaccgtaaaggggccgtaccgagtacggatgcngcnncgcgcngnnnnnnnncncnnnnnnnnnnnnnnnnnnnn

SEQ ID NO: 293405 - DNA, 734 bp, Homo sapiens
  misc_feature: GYAE6OF02H882A.45.60.F05.1.454.CMB.1.raw
  modified_base (273)..(273): a, c, t, g, unknown or other
  misc_feature (273)..(273): n is a, c, g, or t
tcagacgcgatcgacacgaccggtgctcgatttagtacgtcatcagggaaagggaaccatggaaaccccagcgcagcttctcttcctcctgctactctggctcccagataccaccggagaaattgtgttgacgcagtctccaggcaccctgtccttgtctccaggggaaagagcccaccctctcctgcagggccagtcagactattactggcagctacgttagccgtggtaccctagcagaaaaccctggccgtagggtcccgaggcctcctnactctattagtgtaccatccaacgaggggaccctagtcggcactcccaagacgtacggttcaggtggcaggtcgggtcgtaggggacagacgttccactcctcgaacctataccgagacctaaggtaccgtagggtacgtaccgtaggtaaacggttcgttttaccgacggtaaggtttaggttaactttaccgttacggttaaccgtaaacgttaaggttacgttaccggttaccctaccgtttacccgttttccgtccggttttacccgggaccccgtttaacggggaaacccgttaaggtaacggtaccgtaaacgtaaccgaaaccgtaacgttgggtacgtcgtaccggaccgttaaccagttccttacggttaccttaccgtacgttttaccctccccggttaccttagttcccgtaagtacgtttccggaacgttcccggtacgttgtaccggg

SEQ ID NO: 293406 - DNA, 545 bp, Homo sapiens
  misc_feature: GYAE6OF02IQPE8.45.60.F05.1.454.CMB.1.raw
  modified_base (145)..(145): a, c, t, g, unknown or other
  misc_feature (145)..(145): n is a, c, g, or t
  modified_base (195)..(195): a, c, t, g, unknown or other
  misc_feature (195)..(195): n is a, c, g, or t
  modified_base (235)..(235): a, c, t, g, unknown or other
  misc_feature (235)..(235): n is a, c, g, or t
  modified_base (349)..(349): a, c, t, g, unknown or other
  misc_feature (349)..(349): n is a, c, g, or t
  modified_base (508)..(508): a, c, t, g, unknown or other
  misc_feature (508)..(508): n is a, c, g, or t
  modified_base (512)..(545): a, c, t, g, unknown or other
  misc_feature (512)..(545): n is a, c, g, or t
tcagacgcgatcgacacgaccggtgctcgatttagtacgtcatcagggaaaggggctggagtgggtgggtctcattagaagcaaagcttctggggggacaacagactacgccgcgtctgtgaaaggcagattcaccatctcaagngatgattccaaaagtgtcgcccatctgcaaatgaacagcctgaaaaccgnggacacagccatgtattactgtactagagggggtagggcnctgtccggtaactcccactacgtcggggccagggaaccctggtcaccgtctcctcagcctccacaacggcccatccggtccttcccccgtggccgccctcgcctccgagggacnccacccgtccgagacgccacgacgccggccccgtggggcctcggcccgttgggtaccaaaacggggtccttaacccgtttcccgtacggaacgttccggtccgttacgtcggacgggccggggtcgtcgggacgaaacgggcgaaccaagtacggcagnagcnnnnnnnnnnnnnnnnnnnnnnnnnnnnnnnnnn

SEQ ID NO: 293407 - DNA, 553 bp, Homo sapiens
  misc_feature: GYAE6OF02JE8XY.45.60.F05.1.454.CMB.1.raw
  modified_base (163)..(163): a, c, t, g, unknown or other
  misc_feature (163)..(163): n is a, c, g, or t
  modified_base (519)..(519): a, c, t, g, unknown or other
  misc_feature (519)..(519): n is a, c, g, or t
  modified_base (524)..(524): a, c, t, g, unknown or other
  misc_feature (524)..(524): n is a, c, g, or t
  modified_base (530)..(553): a, c, t, g, unknown or other
  misc_feature (530)..(553): n is a, c, g, or t
tcagacgcgatcgacacgaccggtgctcgatttagtacgtcatcagggaaaggggctggagtgggtggggtctcattagaagcaaagcttctggggggacaacagactacgccgcgtctgtgaaaggcagattcaccatctcaagagatgattaccaaaagtntcggggggggggcccatctgacaaatagaacagcctacgaaaaccgaggacacacgcactgtattactgtacgtaggaggggtagggtcgtcgtcggtccggtaacctcccactacgtcgggccgacgggaacctcggcaccggtcctcctcacgcctccacccaacggccactcggtcccttccccctcggccgcccgtacgcctccaggacgccgaccctccgtacgacgccacgacgacccggtcccgtacgggtcgtccggccgtcggtacgaaacgggccgttaaccgttccgtaccgtacgtccgtccgtcgtcgggacgccggggttcgacggtcgaacgggcacgtanacggngactgnnnnnnnnnnnnnnnnnnnnnnnn

SEQ ID NO: 293408 - DNA, 741 bp, Homo sapiens
  misc_feature: GYAE6OF02JSZII.45.60.F05.1.454.CMB.1.raw
  modified_base (174)..(174): a, c, t, g, unknown or other
  misc_feature (174)..(174): n is a, c, g, or t
  modified_base (426)..(426): a, c, t, g, unknown or other
  misc_feature (426)..(426): n is a, c, g, or t
tcagacgcgatcgacacgaccggtgctcgatttagtacgtcatcagggaaagggaaccatggaaaccccagcgcagcttctcttcctcctgctactctggctcccagataccaccggagaaattgtgttgacgcagtctccaggccaccctgtccttgtctccgaggggaaagngcccaccctctccgtgcagggccagtcagtactattaccgtggcagcttacgtagccgtggtaccagccaagaaacccgtggcccagggttccccaggtcctccgtctatctacttagtcgctacaccgaacgtagggaccctacgtacggccgtaacgtaccccgagtaaccgtacggttaccgtagggttacggaccggtacggttcgggtacgggtacgggacgtaacgttacctttaccgccttaccnccaaccctaacgtccgaaacgccgaacggttacgacggtaccgacgtaaggtaacggtttagttttacgcgttaggtacttaaccgtttggtaacttacgacgtattagtccggttactccttaccgtttcgtccgtttcggtacccgttaggaccgtaacggcgtaaacgagttaacccgaacgtaccgttcggcgtacctcgtaaccgtactacgttccgttactaccgtttaccgtacccgttaccgtcccgttaccggtacttaccgtagttccgtacccggttccgtacgggtacccgtttgaaccgggg

SEQ ID NO: 293409 - DNA, 433 bp, Homo sapiens
  misc_feature: GYAE6OF02GODDU.45.60.F05.1.454.CMB.1.raw
  modified_base (345)..(345): a, c, t, g, unknown or other
  misc_feature (345)..(345): n is a, c, g, or t
  modified_base (354)..(354): a, c, t, g, unknown or other
  misc_feature (354)..(354): n is a, c, g, or t
  modified_base (390)..(390): a, c, t, g, unknown or other
  misc_feature (390)..(390): n is a, c, g, or t
  modified_base (420)..(420): a, c, t, g, unknown or other
  misc_feature (420)..(420): n is a, c, g, or t
  modified_base (426)..(433): a, c, t, g, unknown or other
  misc_feature (426)..(433): n is a, c, g, or t
tcagacgcgatcgacacgaccggtgctcgatttagtacgtcatcagggaaaggggctggagtgggtgggtctcattagaagcaaagcttctggggggacaacagactacgccgcgtctgtgaaaggcagattcaccatctcaagagatgattccaaaagtgtcgcccatctgcaaatgaacagcctgaaaaccgaggacacagccatgtattactgtactaggaggggtaggtcgctgtccggtaactcccactacgtggggccagggaaccctggtcaccgtctcctcagcctccaccagggccccatcggtcttcccccgtggccgccctgctccgaggcgcnccctcgagngcacagcgcctgggctgcctggcaaggcctacttcncgatcgcgtctgagtcgggctggcaaggcncatcgnnnnnnnn

SEQ ID NO: 293410 - DNA, 998 bp, Homo sapiens
  misc_feature: GYAE6OF02JFSP2.45.60.F05.1.454.CMB.1.raw
tcagacgcgatcgacacgaccggtgctcgatttagtacgtcatcagggaaagggaaccatggaaccccagcgcagcttctcttcctcctgctactctggctcccagataccaccggagaaattgtgttgacgcagtctccaggcaccctgtccttgtctccagggaaagagccaccctctcctgcagggccagtcagactatactggcagctacttagcctaggtaccagacacgaaaccgtggaccagggtcccaggctcctcgattctattatcgcactaccaaacgtacgggcccaacgttgggactaactccccgtaagacctaagggtttaccgacggttgggaccgaaggttcgggggtacccgttaggggaaccgtaagggaacccgttttacgacccttaccggttacccaaacccgtacgtttacccgaacggtaaccgaaacggtaacccggtttaggggaacccgtacccggtttacggaaaaacgggtttaacgtttttttacggaaccggtaacgggttttaccgggtttaaacttttaacccggtttaacggttaacccgtaaaacccggtttaaacggtttaaacggtttacccggggtttaaacccctttacccgtttaaaaccccggtttttttccccgggtaacggtttttaccccgggttaaccccgggtttaacccgggggtaaacccgtttaaaaacccggggttaccgggttaaaccgttaaaccggttaacccgtaaaaacccgggttaaaccgtttacgggttacgggttacccgttaaccgggtaacccgtaacccgttaagtttaccccgggtttaccgttttacgttaacccgttttaaccggtttaccccggtttttaacccccggtacccgttaaccgttttacccggttaaacggtttaacccggttaccccggtttaaaccgggttttaccccgggttaccggttttaaccccgggtttaaccgggg

SEQ ID NO: 293411 - DNA, 761 bp, Homo sapiens
  misc_feature: GYAE6OF02F4ZQ4.45.60.F05.1.454.CMB.1.raw
  modified_base (169)..(169): a, c, t, g, unknown or other
  misc_feature (169)..(169): n is a, c, g, or t
  modified_base (364)..(364): a, c, t, g, unknown or other
  misc_feature (364)..(364): n is a, c, g, or t
  modified_base (384)..(384): a, c, t, g, unknown or other
  misc_feature (384)..(384): n is a, c, g, or t
tcagacgcgatcgacacgaccggtgctcgatttagtacgtcatcagggaaagggaaccatggaaacccagcgcagcttctcttcctcctgctactctggctcccagatacccgaccggataaattgtggttgacgcagtctcaggcacctgtcttgtctcgaggggaangccacctctctgcgacgggccagtcacgactattcgtggcagtctacgtacgccgtggtaccagacaagaacctggccacgggtccaggcctccgtctagtactattacgtgactactaccgaacgacgggtcctacgtcggacctactacccgagtaccgtacggttctagggtcgtacgtagggtcggtacgngggactacggttccttaccnccttaccaccgtaactacgtacgacgtacgtaacggtacgtagggaccttaccggtaaggtaacgttttacgtttacgacgttacggttacgtttaacgtttacggtaccgtacgtaaacgttacggttaccgttaacggtttaccctaccgtttaccgtttcccgggtaccgttttacccgggacccggttaacgggtaacccgttaagggtacggtaaaccgtacgtaaaccgttaacggtaccgttgtaccggttcgtccgtactaacccgttaggtccttttacggtaccgttacgttccgttacccgttaccgttcccgtagttaccggcggtttacttaccggtcgttacccggtcgtccggttaaccggg

SEQ ID NO: 293412 - DNA, 566 bp, Homo sapiens
  misc_feature: GYAE6OF02FOYSX.45.60.F05.1.454.CMB.1.raw
  modified_base (220)..(220): a, c, t, g, unknown or other
  misc_feature (220)..(220): n is a, c, g, or t
  modified_base (291)..(291): a, c, t, g, unknown or other
  misc_feature (291)..(291): n is a, c, g, or t
  modified_base (294)..(294): a, c, t, g, unknown or other
  misc_feature (294)..(294): n is a, c, g, or t
  modified_base (359)..(359): a, c, t, g, unknown or other
  misc_feature (359)..(359): n is a, c, g, or t
  modified_base (514)..(514): a, c, t, g, unknown or other
  misc_feature (514)..(514): n is a, c, g, or t
  modified_base (517)..(517): a, c, t, g, unknown or other
  misc_feature (517)..(517): n is a, c, g, or t
  modified_base (521)..(521): a, c, t, g, unknown or other
  misc_feature (521)..(521): n is a, c, g, or t
  modified_base (529)..(529): a, c, t, g, unknown or other
  misc_feature (529)..(529): n is a, c, g, or t
  modified_base (534)..(538): a, c, t, g, unknown or other
  misc_feature (534)..(538): n is a, c, g, or t
  modified_base (540)..(540): a, c, t, g, unknown or other
  misc_feature (540)..(540): n is a, c, g, or t
  modified_base (542)..(551): a, c, t, g, unknown or other
  misc_feature (542)..(551): n is a, c, g, or t
  modified_base (553)..(554): a, c, t, g, unknown or other
  misc_feature (553)..(554): n is a, c, g, or t
  modified_base (556)..(566): a, c, t, g, unknown or other
  misc_feature (556)..(566): n is a, c, g, or t
tcagacgcgatcgacacgaccggtgctcgatttagtacgtcatcagggaaagggggctggagtgggtgggtctcattagaagcaaagcttctggggggacaacagactacgccgcgtctgtgaaaggcagattcaccatctcaagagatgattccaaaagtgtcgcccatctgacaaatgaacagcctaggaaaaccgaggacacagccatgtattactntactaggaggggtaggtcgctgtccggtaactcccactacgtgggccaggaccctggcaccgtctctcacnccnccaccaagggcccctaagtccggttcccttcccccgtggcccgtcccgtcgcctaccgagggacnccaccgtccgaacgacgacacgacggccggacccgtgggacctcgtccgtggtacctaaagtacccttacctttcccgtacgtacgtaccggtcgttcgtacgggtacgggaccgggttcggacgggtacgaacgggtccgggactaaccggtanggntagnacgctagngacgnnnnngngnnnnnnnnnngnncnnnnnnnnnnn

SEQ ID NO: 293413 - DNA, 736 bp, Homo sapiens
  misc_feature: GYAE6OF02FRNS2.45.60.F05.1.454.CMB.1.raw
  modified_base (164)..(164): a, c, t, g, unknown or other
  misc_feature (164)..(164): n is a, c, g, or t
  modified_base (649)..(649): a, c, t, g, unknown or other
  misc_feature (649)..(649): n is a, c, g, or t
  modified_base (653)..(653): a, c, t, g, unknown or other
  misc_feature (653)..(653): n is a, c, g, or t
  modified_base (658)..(658): a, c, t, g, unknown or other
  misc_feature (658)..(658): n is a, c, g, or t
  modified_base (663)..(664): a, c, t, g, unknown or other
  misc_feature (663)..(664): n is a, c, g, or t
  modified_base (672)..(672): a, c, t, g, unknown or other
  misc_feature (672)..(672): n is a, c, g, or t
  modified_base (686)..(686): a, c, t, g, unknown or other
  misc_feature (686)..(686): n is a, c, g, or t
  modified_base (702)..(702): a, c, t, g, unknown or other
  misc_feature (702)..(702): n is a, c, g, or t
  modified_base (713)..(713): a, c, t, g, unknown or other
  misc_feature (713)..(713): n is a, c, g, or t
  modified_base (726)..(726): a, c, t, g, unknown or other
  misc_feature (726)..(726): n is a, c, g, or t
  modified_base (731)..(731): a, c, t, g, unknown or other
  misc_feature (731)..(731): n is a, c, g, or t
tcagacgcgatcgacacgaccggtgctcgatttagtacgtcatcagggaaaggggctggagtgggtgggtctcattagaagcaaagcttctggggggacaaacagactacgccgcgtctgtgaaaggcagattcaccatctcaagagatgattcaaaagtgtcncccatcctgcaaatgaacagcctagaaaaccgaggacacagcatgtattactgtactaggaggggtaggtcgcgttcggtaccggtaactcccctaacgtacgtaggggcccgaacgggtaacccctggtacctaccgttcctccgtacaaccggtcccctcccgaaccgtaaaaccgggcccctaagttcccggttaccccgttcccccccgtaggggtccccgtcccccggttcgtacccgttacccggaacgggttaaccggcccgtaacccgttaccccggggaaacgacggggtacccaaccgaaaccggggtccgcccccggtttacgggggccttacggccccggtttagggttaacccgaaaggttacccctttacggttacccgttacccgggaagtttccccgggtcgtacccgttagggaccgggtacccggggtagtcgggtacgggaaccggtaccggctaaaggtcgtaancgancgcgntacgnngtgtgtancgcacgagcgctanagtcgagtcgtagagngcgtcgacgancgacactacgtanctacngtacg

SEQ ID NO: 293414 - DNA, 848 bp, Homo sapiens
  misc_feature: GYAE6OF02HLNSO.45.60.F05.1.454.CMB.1.raw
  modified_base (182)..(182): a, c, t, g, unknown or other
  misc_feature (182)..(182): n is a, c, g, or t
  modified_base (325)..(325): a, c, t, g, unknown or other
  misc_feature (325)..(325): n is a, c, g, or t
  modified_base (338)..(338): a, c, t, g, unknown or other
  misc_feature (338)..(338): n is a, c, g, or t
  modified_base (513)..(513): a, c, t, g, unknown or other
  misc_feature (513)..(513): n is a, c, g, or t
tcagacgcgatcgacacgaccggtgctcgatttagtacgtcatcaggggaaagggaaccatggaaaccccagcgcagcttctcttcctcctgctactctggcctcccagactaccgacggagtaattggtgttgacgcagtcctccgaggccaccctgtccttgtcctacgaagggggaaancgtccctaccctctccgtacgcgacgggccgagtcgaagtacgttacgttacgtggacctaggtaccttaacttcggaccgttacggacccgagactaaacgaaaccgtcgggaccgtaccgggtaccgacggtctcccgtanacttacttagttnacgacacaccggtaacgccggaccaggtcggaccactacccgagtaaccgttcggtacggtacggtcggtaccggacgggtttcgggacgggttaacgggactacggttaacctccgtacctaccgtaaccaccgtaatccgggagaaccacggtagggtacggcttaaaccggngttaaaccggtttgtttaccgacgggtttaacgttacgttacgtaacttcgggtaaacctaacggttaacgggttaacgttaaccgttaaccccgtttacggtttaccttccggtttacccggttttacccgggaccgtaaacggggtaacgtaaacgggtaaccggtaaacgttaaccgtaaaccgttaacggtaccggttaaggtcgtaccgtaccgaacgtaaccgtcgttacgtaccgttacgttaaccgccgttttaacccggcctaacgttaccgttacgtaaccggttcgtaccgttaccgggttacggtaccgttcgggtaaccggg

SEQ ID NO: 293415 - DNA, 723 bp, Homo sapiens
  misc_feature: GYAE6OF02H7QYU.45.60.F05.1.454.CMB.1.raw
  modified_base (656)..(656): a, c, t, g, unknown or other
  misc_feature (656)..(656): n is a, c, g, or t
  modified_base (670)..(671): a, c, t, g, unknown or other
  misc_feature (670)..(671): n is a, c, g, or t
  modified_base (676)..(676): a, c, t, g, unknown or other
  misc_feature (676)..(676): n is a, c, g, or t
  modified_base (679)..(679): a, c, t, g, unknown or other
  misc_feature (679)..(679): n is a, c, g, or t
  modified_base (681)..(682): a, c, t, g, unknown or other
  misc_feature (681)..(682): n is a, c, g, or t
  modified_base (684)..(684): a, c, t, g, unknown or other
  misc_feature (684)..(684): n is a, c, g, or t
  modified_base (686)..(687): a, c, t, g, unknown or other
  misc_feature (686)..(687): n is a, c, g, or t
  modified_base (692)..(693): a, c, t, g, unknown or other
  misc_feature (692)..(693): n is a, c, g, or t
  modified_base (695)..(695): a, c, t, g, unknown or other
  misc_feature (695)..(695): n is a, c, g, or t
  modified_base (700)..(700): a, c, t, g, unknown or other
  misc_feature (700)..(700): n is a, c, g, or t
  modified_base (709)..(711): a, c, t, g, unknown or other
  misc_feature (709)..(711): n is a, c, g, or t
  modified_base (720)..(720): a, c, t, g, unknown or other
  misc_feature (720)..(720): n is a, c, g, or t
tcagacgcgatcgacacgaccggtgctcgatttagtacgtcatcagggaaagggggctggagtgggtgggtctcattagaagcaaagcttctggggggacaacagactacgccgcgtctgtgaaaggcagattcaccatctacaagagatgattaccaaaagtgtccgcccatctgacaaatagaacagcctagaaaccgaggacacagccaatgtattactgtactaaggagggggtagggtcgcgtcggtaccggtaacctccacgttaccgtcgggggccaacgggggaacccgtgggtaccaccggtcctccctcgacgtcccctccaaccggaacgggcccctaaggttcccggttcccctttacccccccgtggggacccccgtccccgttcggtaccgttccccgaaacggggctacccgtaacccccggtaccggaacggacgggtaacccaccggtaaccgggccccgggtaacccccgggttgggggtacccttcgggaaccccgtttcgggggtaactaaaaccgggttaccctttaaccgtttccccggtaaggacccgtttgggtacccgtttggtaaccggtcgggtaaccgggggtccgttacgggggacccgaaaccggggtctaccgtacggttaaggngccgtgcacgtgcnngcgcncgngnncngnngagcnncngtgcncgcgtctgnnnacgacatcngtg

SEQ ID NO: 293416 - DNA, 694 bp, Homo sapiens
  misc_feature: GYAE6OF02FJ68N.45.60.F05.1.454.CMB.1.raw
  modified_base (141)..(141): a, c, t, g, unknown or other
  misc_feature (141)..(141): n is a, c, g, or t
  modified_base (197)..(197): a, c, t, g, unknown or other
  misc_feature (197)..(197): n is a, c, g, or t
  modified_base (592)..(592): a, c, t, g, unknown or other
  misc_feature (592)..(592): n is a, c, g, or t
  modified_base (597)..(597): a, c, t, g, unknown or other
  misc_feature (597)..(597): n is a, c, g, or t
  modified_base (614)..(614): a, c, t, g, unknown or other
  misc_feature (614)..(614): n is a, c, g, or t
  modified_base (620)..(620): a, c, t, g, unknown or other
  misc_feature (620)..(620): n is a, c, g, or t
  modified_base (637)..(637): a, c, t, g, unknown or other
  misc_feature (637)..(637): n is a, c, g, or t
tcagacgcgatcgacacgaccggtgctcgatttagtacgtcatcagggaaaggggctggagtgggtgggtctcattagaagcaaagcttctggggggacaacagactacgccgcgtctgtgaaaggcagattcaccatctnaagagatgattccaaaagtgtcgcccatctgacaaatgaacagcctagaaaaccgnggacacagccatagtattactgtacctaggtaggggtaggtacgccttcgtaccggtaacctcccaacgttacgtgggggccctaaggggaaccccgtcggtaccaaccgttctccctacacgtccctaccaaccccgaagggcccctaagtacccggttacccgttcccccgtaggcccgtccccgttacgcctacccggaagggtacgaccgtacccgttaccggaggaccgtaccaaccgacggcccggacccggttggggccttaccgggccttagggtttaaccgaaacgggttaccttaaccgtttcccgttaggacctttcggaaccggttcgtacggtaacgggtcccggtacggtacgggaacgaaccggtcgtaccgaagtacgngtacntagctacagtcgacgtnacggtnacgtgtactgcagtacncacgagtacgcacgtacgactacgaacgaccagtacactaccgacgacgagtagacg

SEQ ID NO: 293417 - DNA, 863 bp, Homo sapiens
  misc_feature: GYAE6OF02HID84.45.60.F05.1.454.CMB.1.raw
tcagacgcgatcgacacgaccggtgctcgatttagtacgtcatcagggaaagggggggagaggagccccagccgtgagattcccaggagtttccacttggtgatcagcactgaacacagaccaccaaccatggagtttgggcttagcttgggttttccttgttgcttaattttaaaaggtgtccaattgtagaagtgcagtcgtggtggagtcggtagggggatacgttggtacaggccgagggccgtcctgagtagtctcctgtatagtcttcgtaggtacttcgtacgtttggtgtatttagtacttagtcgtaccgtcgggtacccgccgaggtccgtacccgaaggggggaacggggtcgtagggtagggttggggtcgggttcgttacgtacggttaaggaacgacgtaaacgtcggttacggggtacggggggaacctaaacgaacggtaccgtaaccggcccggtcggttacgttacggtaacggtaaacggcgaaagttaacgttccctaaccggtaactttacgtaaccgaaagtacggtacgtacgttaacgtttaaacccgtaaaaggttccgggttacccgtacccgtaacttccggtaacgtaactaaacgtacgaaaaccgacgtaaccctaaaccgggtaaaaacccggtacggtaaaccgaccgaacggtaccctaagttacgtttaaccgttacgtaacggttaacgggttacggggtacgggggtttacgggtaccgttccgggtccggtttaacccggttaacccgtcccgttaaaccggttaccgggaccgggggtaacccggtaacccgggtacccggttaccgggttacccgtacccccgg

SEQ ID NO: 293418 - DNA, 652 bp, Homo sapiens
  misc_feature: GYAE6OF02ITMP9.45.60.F05.1.454.CMB.1.raw
  modified_base (606)..(606): a, c, t, g, unknown or other
  misc_feature (606)..(606): n is a, c, g, or t
  modified_base (611)..(612): a, c, t, g, unknown or other
  misc_feature (611)..(612): n is a, c, g, or t
  modified_base (614)..(615): a, c, t, g, unknown or other
  misc_feature (614)..(615): n is a, c, g, or t
  modified_base (618)..(618): a, c, t, g, unknown or other
  misc_feature (618)..(618): n is a, c, g, or t
  modified_base (621)..(624): a, c, t, g, unknown or other
  misc_feature (621)..(624): n is a, c, g, or t
  modified_base (626)..(627): a, c, t, g, unknown or other
  misc_feature (626)..(627): n is a, c, g, or t
  modified_base (629)..(637): a, c, t, g, unknown or other
  misc_feature (629)..(637): n is a, c, g, or t
  modified_base (639)..(648): a, c, t, g, unknown or other
  misc_feature (639)..(648): n is a, c, g, or t
  modified_base (650)..(652): a, c, t, g, unknown or other
  misc_feature (650)..(652): n is a, c, g, or t
tcagacgcgatcgacacgaccggtgctcgatttagtacgtcatcagggaaaggggctggagtgggtgggtctcattagaagcaaagcttctggggggacaacagactacgccgcgtctgtgaaaggctgattcaccatctcaagagatgattccaaaagtgtcgcccatctgcaaatgaacagcctagaaaaccgagacacagccatgtattactgtactaggaggggtaggtcgcgtcgtaccggtaactcccactacgtcggggccacgggaaccctggtacctaccgtcctccctcgacgcccctacccaaccgtaacgggcccctacgttcccgggttcccctttccccccgtcgggccccgtacccccgtcgtcccgtacccggaacgggaccgacccgtaccccgttccggacgggtaaccgacccgaaccgccggggacccggtcccccggtggggggtcccctcgggtcccggttacgggtaccgaaacggttacccgttacccgtttcccgtaccgtacgtcccgggtaccgttcgtacggggtacgggtccggggttccggtacgggaccggtaacggggccgtacgtaagtacgnagcgnngnngcncgnnnnanncnnnnnnnnngnnnnnnnnnncnnn

SEQ ID NO: 293419 - DNA, 528 bp, Homo sapiens
  misc_feature: GYAE6OF02HRDLJ.45.60.F05.1.454.CMB.1.raw
  modified_base (345)..(345): a, c, t, g, unknown or other
  misc_feature (345)..(345): n is a, c, g, or t
  modified_base (350)..(350): a, c, t, g, unknown or other
  misc_feature (350)..(350): n is a, c, g, or t
  modified_base (361)..(361): a, c, t, g, unknown or other
  misc_feature (361)..(361): n is a, c, g, or t
  modified_base (366)..(366): a, c, t, g, unknown or other
  misc_feature (366)..(366): n is a, c, g, or t
  modified_base (491)..(491): a, c, t, g, unknown or other
  misc_feature (491)..(491): n is a, c, g, or t
  modified_base (495)..(495): a, c, t, g, unknown or other
  misc_feature (495)..(495): n is a, c, g, or t
  modified_base (497)..(528): a, c, t, g, unknown or other
  misc_feature (497)..(528): n is a, c, g, or t
tcagacgcgatcgacacgaccggtgctcgatttagtacgtcatcagggaaaggggctggagtgggtgggtctcattagaagcaaagcttctggggggacaacagactacgccgcgtctgtgaaaggcagattcaccatctcaagagatgattccaaaagtgtccgcccatctgcaaaatgaaacacgcctagaaaaccgaggacacacgcatgtattacgtgtacgtaggaggggtaggtcgtcgtcgtaccggtaactcccgtactagggtccgggccgaacggacccgtggtccaccgtctctcgacgtcctacgaccgacggccagtccgtaccttccccgngcccnccgtgcctcgnggacnccaccgtcgacgacgacgcgaacgcccggtccgtggcctcggccgtcggacgtaacgtaccttaccttccgtacgtaccgtcgtccgtcgtagacggcgggtcgtcggacgacggacgcagacgncgtngnnnnnnnnnnnnnnnnnnnnnnnnnnnnnnnn

SEQ ID NO: 293420 - DNA, 621 bp, Homo sapiens
  misc_feature: GYAE6OF02JHWKC.45.60.F05.1.454.CMB.1.raw
  modified_base (487)..(487): a, c, t, g, unknown or other
  misc_feature (487)..(487): n is a, c, g, or t
  modified_base (521)..(521): a, c, t, g, unknown or other
  misc_feature (521)..(521): n is a, c, g, or t
  modified_base (538)..(538): a, c, t, g, unknown or other
  misc_feature (538)..(538): n is a, c, g, or t
  modified_base (548)..(548): a, c, t, g, unknown or other
  misc_feature (548)..(548): n is a, c, g, or t
  modified_base (562)..(562): a, c, t, g, unknown or other
  misc_feature (562)..(562): n is a, c, g, or t
  modified_base (616)..(616): a, c, t, g, unknown or other
  misc_feature (616)..(616): n is a, c, g, or t
tcagacgcgatcgacacgaccggtgctcgatttagtacgtcatcagggaaaggggctggagtggttgggtctcattagaagcaaagcttctgggggacaacagactacgccgcgtctgtgaaaggcagattcaccatctcaagagatgattccaaaagtgtcgcccatctgcaaatgaacagcctagaaaaccgagacacagccatgtattactgtactaggaggggtaggtcgctgtccggtactcccactacgtgggccgacggaccctggtaccaccgtctcctcacgccctaccaccgaacggcccaagttccggtcccttccccgtggcccgccgtcgcctaccgacggtcgacctacccgtacgaagtacgccaacgtcggaccggcccgtgggcctcgtcccgttaggtaccgaacggtacctttacccgttcccgtaccggtcgttaccggcgttaccgtaggacgggtccggtccggngggtaacgaccgggtccaacgtacgttaggcccncgcagcacgcgcgcgtnacgacgtcgngcgacgacgcgacncgcgacgcgtacgcgctcgtcgacgtcgcgtacgtacgtaccgtacgacgtacncgacg

SEQ ID NO: 293421 - DNA, 790 bp, Homo sapiens
  misc_feature: GYAE6OF01APL1P.16.10.A10.1.454.CMB.1.raw
tcagtgtactactccacgaccggtgctcgatttagcgtcgatctcaggggtgggtccaggaggcagaactctgggtgtctcaccatggcctggatccctctacttctcccctcctcactctctgcacaggctctgaggcctcctttgagttgacacagccaccctcggtgtcagtgtccccaggacagacggccagggtactccacgtcgtccttccttacgagtagtcgactagttccgaaccgaacggactaaattgtcgttccttttcggtttaccggtaaccacgaccgaaaggaaccgaccggaccggacccggacccggtccccgttgggttggggttgggtagtaattaataaagtaaacgaccaaccaacgaaggacccggtaccctacgggaacgggtacccttcccgggtgggaccgttactttccgtcggtcggtccctaccgacgtctacggaacgggaccacgtacgtaccgtacggttacgaaccgtacggttcgggtaggtaccgtaccggacggacgaaaggaacggaacgggtagggtactaactttaacgttacgtcgtacgtacgtcgtacgaaccaaacccacctacgtcgacgtacgggtccgggtttacgggtacccggggacgggaaccgggaaccctacggtccggtaaccggtaccccggttcgtaccggtccggtaccacccgggacccgaacggttcccgtcccccggtacccccggttcggtaccctaccctttccggttccccgttaccccccgtaccccg

SEQ ID NO: 293422 - DNA, 524 bp, Homo sapiens
  misc_feature: GYAE6OF01BD4HO.16.10.A10.1.454.CMB.1.raw
  modified_base (520)..(520): a, c, t, g, unknown or other
  misc_feature (520)..(520): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactttgcgaaagatcctgaggcctataccactcagtcagctggttcgacccctggggccagggaaccctggtcaccgtctcctcagcctccaccaagggcccatcggtcttccccctggcaccctcctccaacgagcacctctcggggcacagcgcctgggctgcctggtcaaggactactccgagtacgtcnctcg

SEQ ID NO: 293423 - DNA, 537 bp, Homo sapiens
  misc_feature: GYAE6OF01C9IB6.16.10.A10.1.454.CMB.1.raw
  modified_base (200)..(200): a, c, t, g, unknown or other
  misc_feature (200)..(200): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagnggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccactcagtcagctggttcgaccctgggccagggaaccctggtcaccgtctcctcagcctccaccaacgggcccatccggtcttccccctcggccaccctccctcccaacgacgcacctccgtcgggggcacgacgcggcccgtgggctggcctggtcaacggctacttccgagtgtactacg

SEQ ID NO: 293424 - DNA, 506 bp, Homo sapiens
  misc_feature: GYAE6OF01ALGQU.16.10.A10.1.454.CMB.1.raw
tcagtgtactactccacgaccggtgctcgatttagcgtcgatctcagggggtgggtccaggaggcagaactctgggtgtctcaccatggcctggatccctctacttctcccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggccctgtggtggtgatatataaagacacacagaggccctcagggatcccgtgggcgattctctggctcagctcagggacgacagtcacgttgaccagtcggtgagtccaggcagaagacgagggtgacgtatactgtcagtctgcaaacacactgcagcgtgttcggcggaggaccagctcggaccgtcgtgcgtcaggacccaggctacgtccccgtcggtcacgtctcgtcccctacccg

SEQ ID NO: 293425 - DNA, 550 bp, Homo sapiens
  misc_feature: GYAE6OF01AOXJ6.16.10.A10.1.454.CMB.1.raw
  modified_base (340)..(340): a, c, t, g, unknown or other
  misc_feature (340)..(340): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgtcatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagntcctgaggcctataccacctcagtcagctggttcgacccctgggccagggaccctggtcaccgtctcctcagcctccaccaacgggcccatccggtccttccccctcggccaccctccctcccaacgacgccaccctcgtcgggggccaccgacggccggccccgtcgggcctcggccctggtcaacggtactacttccgagtgtacacg

SEQ ID NO: 293426 - DNA, 518 bp, Homo sapiens
  misc_feature: GYAE6OF01EOZLJ.16.10.A10.1.454.CMB.1.raw
  modified_base (484)..(484): a, c, t, g, unknown or other
  misc_feature (484)..(484): n is a, c, g, or t
tcagtgtactactccacgaccggtgctcgatttagcgtcgatctcagggggtgggtccgaggaggcagaactctgggtgtctcaccatggcctggatccctctacttctcccctcctcactctctgcacaggctctgaggcctcctttgagttgacacagccaccctcggtgtcagtgtcccccaggacagacggccaggatcacctgctcttcagatgcattgccaaggcaatatgcttcttggtaccagcagaagccaggccaggccctgtggtggtgatatataaagacacacagaggccctcgagggactcccgtgggcgattctctggctccagctcagggacacagtcacgttgaccatcggtgagtccaggcagaagacgagggtgactattacgtgtcagtctgacaaacgaccactgcaggcggtagttcggcggagggaccaagcgtgaccgtctgccgtcacgcccaaggccncgccccctggtccacctctcccgtcccgtccccg

SEQ ID NO: 293427 - DNA, 576 bp, Homo sapiens
  misc_feature: GYAE6OF01CPKJN.16.10.A10.1.454.CMB.1.raw
  modified_base (341)..(341): a, c, t, g, unknown or other
  misc_feature (341)..(341): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcaccttagcggttatgccatgagctgggtccgccaggctccagggaaggggctgggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgacgaaagntcctgaggcctaataccacctcagtcagctggttccgaccccgtgggccgagggaccctggtcaccgtctcctccagcctccaccacgggcccacgtccggtccttccccctcggccacccctccctccaacgacgccaccgtcgtcggggccaccgacgccggcccgtcgggcctcggtcccgtgggtaccgaacggtaccttaccgttacccggtagttacgtaccgtaacgg

SEQ ID NO: 293428 - DNA, 559 bp, Homo sapiens
  misc_feature: GYAE6OF01APYNR.16.10.A10.1.454.CMB.1.raw
  modified_base (317)..(317): a, c, t, g, unknown or other
  misc_feature (317)..(317): n is a, c, g, or t
  modified_base (436)..(436): a, c, t, g, unknown or other
  misc_feature (436)..(436): n is a, c, g, or t
  modified_base (452)..(452): a, c, t, g, unknown or other
  misc_feature (452)..(452): n is a, c, g, or t
  modified_base (500)..(500): a, c, t, g, unknown or other
  misc_feature (500)..(500): n is a, c, g, or t
tcagtgtactactccacgaccggtgctcgatttagcgtcgatctcagggggtgggtccaggaggcagaactctgggcgtctcaccatggcctggatccctctacttctccccctcctccactctctgcacaggctctgaggcctccttttgagttgacacacgcccaccctcggtgtcagtcgtccccaggacagacggccaggatcacctgctcttcagatgcattgccaaggcaatatgctttcttggtaccagcagaagccaggccaggcccctgtcggtggtgatagtagtaaagacacaacagacggccctnagggactccccgtgggccatttcctctggtacctccacgtcctcgaggggaccacgacgtcacgtttgaaccagtccgggtggacgtccgaggccagaagacggaggtgactattacgngtcagtctgacaaacnccaatcgacgagcggtgttcggcgggacggaccagctcgaccgtccgngtccgcgacgcccgaggcctccgacccccgtcggtcaccctctccgttcccccgccccg

SEQ ID NO: 293429 - DNA, 561 bp, Homo sapiens
  misc_feature: GYAE6OF01B8QZ4.16.10.A10.1.454.CMB.1.raw
  modified_base (340)..(340): a, c, t, g, unknown or other
  misc_feature (340)..(340): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagntcctgaggcctataccactcagtcagctggttcacccgtgggccacgggaacctggtcaccgtctcctcacgcctccaccaacggcccatccggtccttcccccgtcggccacccctccctcccaacgacgccacctcgtcggggccacgacgccgggcccgtcggggcctcggcccgtcggtacaacgggtacttaccgttaccgacgtacgtacgtacg

SEQ ID NO: 293430 - DNA, 630 bp, Homo sapiens
  misc_feature: GYAE6OF01DWUC6.16.10.A10.1.454.CMB.1.raw
  modified_base (302)..(302): a, c, t, g, unknown or other
  misc_feature (302)..(302): n is a, c, g, or t
  modified_base (310)..(310): a, c, t, g, unknown or other
  misc_feature (310)..(310): n is a, c, g, or t
  modified_base (369)..(369): a, c, t, g, unknown or other
  misc_feature (369)..(369): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccgaggggaaggggctgggagtgggtctcaacttttaggtggtagtggtggtcacgcctactacgcagagtccgtgaacgggccgattcaccatctccagagacacttccgagaacacgctgtatctgcgaatgaacngcctgagngtcgaggacacggccatatattactgtgcgaaaagctcctgacggacctataccacctnacgtcagtccttcgggttaccgaccccgtcggggacccgacgggaaccccgttgggtacccacccggtcctaccctcgaccgtccctcccgaaccgaacgggccccagtcccggttcccttcccccgtcggcccctaccctcccgtacccgaacgacgcctacccgtcggtcggggaccaccgacggccggcccggtcgggcctcggtcccgtgggtacctaacgggtccttaccgttaccggagtaacgtacgtaaccgg

SEQ ID NO: 293431 - DNA, 509 bp, Homo sapiens
  misc_feature: GYAE6OF01D76MZ.16.10.A10.1.454.CMB.1.raw
  modified_base (456)..(456): a, c, t, g, unknown or other
  misc_feature (456)..(456): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggccctgtggtggtgatatataaagacacacagaggcctcagggatccctgggcgattctctggctccagctcgagggacgacagtcacgttgaccatcggtggagtccaggcagaagacgaggtgactatactgtcagtctgacaaacaccactgcagcggtgttcggcggagggacaggctgaccgtcgngcgtcagacccgaggcctcgcccccgtcggtccacctctcgtccccgtccccg

SEQ ID NO: 293432 - DNA, 577 bp, Homo sapiens
  misc_feature: GYAE6OF01DTTHP.16.10.A10.1.454.CMB.1.raw
  modified_base (276)..(276): a, c, t, g, unknown or other
  misc_feature (276)..(276): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttctggtaccagcagaagccaggccaggccctgtggtgngatatataaagacaacacagaggccctagagggatcccgtgggcgattctctggctccagctcgagggacgaacagtcacgttgaccagtcggtaggagtccaggcaaggaagacggagggtgaacgtaattacgtgtacgtagtctagacaaacaccaacgtcgacgagcggtaggttcgggacggacgggaccagaccgtacgacccgtaccgtggtccgtccgaggaccccgaaaggcccgttaccggcccccccgttacggtcccaaccttcccgttaccgttccccgtaacccccg

SEQ ID NO: 293433 - DNA, 568 bp, Homo sapiens
  misc_feature: GYAE6OF01B72UM.16.10.A10.1.454.CMB.1.raw
  modified_base (340)..(340): a, c, t, g, unknown or other
  misc_feature (340)..(340): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagntcctgaggcctataccactcagtcagctggttcgacccgtgggccacgggaccctggtcacccgtctcctcacgcctccaccgaacggcccacgtccggtccttcccccgtcggccaccctcctcccacgacgcaccctcgtcgggggccaccgacgccgggcccgtcggggcctcggcccgtggtccgaacggtacctaccgttcccggaacgttacgtacgtaccg

SEQ ID NO: 293434 - DNA, 583 bp, Homo sapiens
  misc_feature: GYAE6OF01B114K.16.10.A10.1.454.CMB.1.raw
  modified_base (297)..(297): a, c, t, g, unknown or other
  misc_feature (297)..(297): n is a, c, g, or t
  modified_base (340)..(340): a, c, t, g, unknown or other
  misc_feature (340)..(340): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacngcctgagagtcgaggacacggccatatattactgtgcgaaagntcctgaggcctataccactcagtcagctggttccgacccgtgggccacgggaaccctggtcacccgtctcctcacgccctaccacccaacgggccccagtcccggttcccttccccccgtcgggcccaccccgtccctcccgaacgacgccaccgtccgtcggggcaccgacggccggcccgtcgggcctcggcccgttcgggtcaaacgggtaccttacgttaccgacggtagtaccgtacg

SEQ ID NO: 293435 - DNA, 542 bp, Homo sapiens
  misc_feature: GYAE6OF01ED2BT.16.10.A10.1.454.CMB.1.raw
  modified_base (487)..(487): a, c, t, g, unknown or other
  misc_feature (487)..(487): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttctggtaccagcagaagccaggccaggccctgtggtggtgatatataaagacaacacagacggccctcgagggactcccgtgggccgtattctcgtggcctccgagctcgagggacacagtcacgttgaccagtcgggtggacgtccaggcaaggaagacggagggtgaactagttactgtcagtctagacaaacacactgcagcggtgttcgggcgggtagggacccaaggcctaggacccgttccgngccgtcacggcccaaggcctccgcccccgttgccacctcgtccgtccccgtcccg

SEQ ID NO: 293436 - DNA, 503 bp, Homo sapiens
  misc_feature: GYAE6OF01BTW47.16.10.A10.1.454.CMB.1.raw
  modified_base (415)..(415): a, c, t, g, unknown or other
  misc_feature (415)..(415): n is a, c, g, or t
  modified_base (457)..(457): a, c, t, g, unknown or other
  misc_feature (457)..(457): n is a, c, g, or t
tcagtgtactactccacgaccggtgctcgatttagcgtcgatctcagggggtgggtccaggaggcagaactctgggtgtctcaccatggcctggatccctctacttctcccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggcccctgtggtggtgatatataaagacacacagaggccctcagggatccctgggcgattctctggctccagctcagggacgacagtcacgttgaccatcggtggagtccaggcagaagacgagggtgactattactgtcagtctgcaaacnccactgcagcggtgttcggcggagggaccagctgaccgtccngcgtcagcccaaggcctgccccctggccactctcgttcccgccccg

SEQ ID NO: 293437 - DNA, 498 bp, Homo sapiens
  misc_feature: GYAE6OF01A833U.16.10.A10.1.454.CMB.1.raw
  modified_base (454)..(454): a, c, t, g, unknown or other
  misc_feature (454)..(454): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggcccctgtggtggtgatatataaagacacacagaggccctcagggatccctgggcgattctctggctccagctcagggacgacagtcacgttgacatcggtgagtccaggcagagacgaggtgactatactgtcagtctgaccaaacaccactgcagcggtgttcggcggaggaccagcgtgaccgtcngcgtcagcccagcctcgccccgtcgcactctcgtccccgtcccg

SEQ ID NO: 293438 - DNA, 571 bp, Homo sapiens
  misc_feature: GYAE6OF01AKCBQ.16.10.A10.1.454.CMB.1.raw
  modified_base (340)..(340): a, c, t, g, unknown or other
  misc_feature (340)..(340): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagntcctgaggcctataccacctcagtcagctggttccgacccgtgggccacgggacctggtccaccgtctcctcacgcctccaccaacggcccactccggtccttcccccgtcgcccaccctcctccaacgacgccaccgtcgtcggggccacgacgccggcccgtcgggccgtcggcccgtcgggtaccgaacggtaccgttaccgttacccggaggttacgtacgtaccgg

SEQ ID NO: 293439 - DNA, 617 bp, Homo sapiens
  misc_feature: GYAE6OF01CS5YX.16.10.A10.1.454.CMB.1.raw
  modified_base (200)..(200): a, c, t, g, unknown or other
  misc_feature (200)..(200): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagnggtagtggtggtcacgcctactacgcagagtccgtgaagggccgattcaccatctccagagacacttccgagaacacgctgtatctgcgaatgaaacagcctgagagtcgaggacacggccatatattactgtgcgaaagatctgacggtcctaataccacctcagtcagtcgtcggttccgaccccgtcggggccgacgggaacccgtcggtcacccgtcctcctccacgccctccaacccgaacgggcccacgtccggttccttcccccgtcggtaccctaccccttcccgtcccaacgaccgcctacccgtcggtcggggaccgtaccgacggcccggccccgtcgggtccgtcggcccgttcgggtaccgaacgggtaccttaccgttacccggaacgtacgtaccgtaaccg

SEQ ID NO: 293440 - DNA, 529 bp, Homo sapiens
  misc_feature: GYAE6OF01A32W0.16.10.A10.1.454.CMB.1.raw
  modified_base (474)..(474): a, c, t, g, unknown or other
  misc_feature (474)..(474): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggccctgtggtggtgatatataaagacacacagaggccctcgagggactcccgtgggcgattctctggctccagctcgagggacgacagtcacgttgaccagtcggtggacgtccgaggcaaggaagacggagggtgaactattactgtacgagtctagacaaacaccactgcagtcggtgttcgggcggaggaccaggctgaccgtcgngcgtcgacgccgaaggcctcgccccctcggtcacctcgtccgttccccgtccccg

SEQ ID NO: 293441 - DNA, 581 bp, Homo sapiens
  misc_feature: GYAE6OF01CNDRK.16.10.A10.1.454.CMB.1.raw
  modified_base (555)..(555): a, c, t, g, unknown or other
  misc_feature (555)..(555): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagcccaccctcggtgtcagtgtccccaggacagacggccaggatcacctgctcttcagatgcattgccaaggcaatatgcttcttggtaccagcagaagccaggccacggccctggtggtggtgatataataaagacacacagacggccctgagggactccccgtgggccgtatttcctcgtcggcctccgagctcgagggacgacgagtcacgttgacctagtcggtgacgtacgaggcgaagaagacggagggtatacgtattacgtgtacgtaagtctagacctaaacaccacgtgacaggtacggtggttccggacgggtaacggaaccgaacgcgtacggacccgtcgtgccgtacgacgaccgtaggcccgtcccgcccccgtcgtacccncctttacctccgtaccccgtaccccg

SEQ ID NO: 293442 - DNA, 530 bp, Homo sapiens
  misc_feature: GYAE6OF01B6KZD.16.10.A10.1.454.CMB.1.raw
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctccttttgagttgacacagccaccctcggtgtcagtgtccccaggacagacggccaggatcacctgctcttcagatgcattgccaaggcaatatgcttcttggtaccagcagaagccaggccaggcccctgtggtggtgatatataaagacacacagaggccctcagggactcccgtgggccgattctctggctccgagctcgagggacgacagtcacgttgaccagtcggtggagtccgaggcagaagacgagggtgactatactgtcagtctgacaaacaccactgcaggcggtgtcgggcggagggaccaaggctcgaccgtcctgcgtcagccccgaaggcctcggccccccgtcggtccaccttctccgttcccctacccccg

SEQ ID NO: 293443 - DNA, 528 bp, Homo sapiens
  misc_feature: GYAE6OF01BCC0Z.16.10.A10.1.454.CMB.1.raw
  modified_base (523)..(528): a, c, t, g, unknown or other
  misc_feature (523)..(528): n is a, c, g, or t
tcagtgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggtcgacccctgggccagggaaccctggtcaccgtctcctcacgcctccaccaacgggcccatccggtccttccccctcggccaccctccctccaacgacgccacctcgtggggcacgacgcggccctgggctgcctggtcaagggacctacgttccgagtacgtacacgtgagcgggctgggcaaggcgcagtgnnnnnn

SEQ ID NO: 293444 - DNA, 495 bp, Homo sapiens
  misc_feature: GYAE6OF01DZCKS.16.10.A10.1.454.CMB.1.raw
  modified_base (305)..(305): a, c, t, g, unknown or other
  misc_feature (305)..(305): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctccttttgagttgacacagccaccctcggtgtcagtgtccccaggacagacggccaggatcacctgctcttcagatgcattgccaaggcaatatgcttcttggtaccagcagaagccaggccaggccctgtggtggtgatatataaagacacacagagccctnagggatccctgggcattctctggctccagctcagggacgacagtcacgttgaccatcggtggagtccaggcagagacgagggtgactattactgtcagtctgacaacacatgcagcggtgtcggcggaggacagctcgaccgtcctgcgtcagcccaggcctcgccccgtcgcactctcgtccctacccg

SEQ ID NO: 293445 - DNA, 532 bp, Homo sapiens
  misc_feature: GYAE6OF01DGR3M.16.10.A10.1.454.CMB.1.raw
  modified_base (330)..(330): a, c, t, g, unknown or other
  misc_feature (330)..(330): n is a, c, g, or t
  modified_base (333)..(333): a, c, t, g, unknown or other
  misc_feature (333)..(333): n is a, c, g, or t
  modified_base (340)..(340): a, c, t, g, unknown or other
  misc_feature (340)..(340): n is a, c, g, or t
  modified_base (467)..(467): a, c, t, g, unknown or other
  misc_feature (467)..(467): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattacngtncgaaagntcctgaggcctataccactcagtcagctggttcgacccctgggccaggaccctgtcaccgtctcctcagcctccaccaacggcccatcggtcttcccctcggcaccctcctccaagacgcacctcgnggggcacgacgccggcccgtcgggcctcggcctggtcaaggtcctacttccgagtacgtcgtacg

SEQ ID NO: 293446 - DNA, 568 bp, Homo sapiens
  misc_feature: GYAE6OF01EE649.16.10.A10.1.454.CMB.1.raw
  modified_base (202)..(202): a, c, t, g, unknown or other
  misc_feature (202)..(202): n is a, c, g, or t
  modified_base (297)..(297): a, c, t, g, unknown or other
  misc_feature (297)..(297): n is a, c, g, or t
  modified_base (329)..(329): a, c, t, g, unknown or other
  misc_feature (329)..(329): n is a, c, g, or t
  modified_base (340)..(340): a, c, t, g, unknown or other
  misc_feature (340)..(340): n is a, c, g, or t
  modified_base (522)..(522): a, c, t, g, unknown or other
  misc_feature (522)..(522): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccgagggaaggggctgggagtgggtctcaacttttagnggtagtggtggtcacgcctatacgcagagtccgtgaagggccattcaccatctccagagacacttccgagaacacgctgtatctgcgaatgaacngcctgagagtcgaggacacggcatatattacngtgacgaaagntctgagcctataccactcagtcagctggttccgacccgtcgggccgacgggaacccgtcggtcctaccgtcctcctccacgccctaccaccgacggcccacgtccgtccttcccccgtcggccctaccctccctacccgaacgacgccaccgtcgcggggcacgacgccggcccgtcgggcncggccgtcggtacaacggtacctacgttaccgagtacgtacgtacg

SEQ ID NO: 293447 - DNA, 555 bp, Homo sapiens
  misc_feature: GYAE6OF01DFI0G.16.10.A10.1.454.CMB.1.raw
  modified_base (393)..(393): a, c, t, g, unknown or other
  misc_feature (393)..(393): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggccctgtggtggtgattataataaagacacacagaggccctcagggatcccgtgggcgattctctggctccgagctacgagggacgacagtcacgttgaccatcggtggagtcagcagagacgaggtnaactatactgtcagtctgacaaacaccactgacaggcggttcgttccgggcgggacgggaacccaaggcctacggaacccgtcctcggccgtcacggtcccaaacgggtccctccgccccccgtcgggtacccaccgttcctccgttcccccgtaacccccg

SEQ ID NO: 293448 - DNA, 515 bp, Homo sapiens
  misc_feature: GYAE6OF01ALOCF.16.10.A10.1.454.CMB.1.raw
  modified_base (403)..(403): a, c, t, g, unknown or other
  misc_feature (403)..(403): n is a, c, g, or t
  modified_base (418)..(418): a, c, t, g, unknown or other
  misc_feature (418)..(418): n is a, c, g, or t
  modified_base (437)..(437): a, c, t, g, unknown or other
  misc_feature (437)..(437): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggcccctgtggtggtgatatataaagacacacagaggccctcagggatcccgtgggcgattctctggctccagctcagggacacagtcacgttgaccatcggtggagtccgaggcagaagacggaggtagactattacngtcagtctgacaacncactgcagcggtgtccggnggacggaccagctagaccgtctgcgtcgagcccgaaggcctcgcccccgtcggtcactcccgttgtcccccgtccccg

SEQ ID NO: 293449 - DNA, 595 bp, Homo sapiens
  misc_feature: GYAE6OF01C8S3K.16.10.A10.1.454.CMB.1.raw
  modified_base (590)..(591): a, c, t, g, unknown or other
  misc_feature (590)..(591): n is a, c, g, or t
  modified_base (593)..(595): a, c, t, g, unknown or other
  misc_feature (593)..(595): n is a, c, g, or t
tcagtgtactactccacgaccggtgctcgatttagcgtcgatctcaggggtccctgagactctcctgtgcagcctctggattcacccttagcggttatgccatgagctgggtccgccaggctccgagggaaggggctggagtgggtctctaacttttagtggtagtggtggtcacgcctactacgcagagtccgtgaagggccgattccaccatctccagagacacttccgagaacacgctgtatctgcgaatgaacagcctgagagtcgaggacacggccatatattactgtgacgaaagatcctgacggcctataccacctcagtcagctggttccgacccgtcggggccacggggaacccctggtccacccggtctcctcacgccctcccaaccgaacggggcccctaagtcccggttcccttcccccgtcgggtcccacccctccctacccaacgacgccaccgtcgtcgggggccacgcgcggcccgtgggctcgccgtggtaccgaaggacctacgttaccggacgtaacgtaccacgtcggacggaccgggtcgtacgggacgtaagggccgacacgtacganngnnn

SEQ ID NO: 293450 - DNA, 573 bp, Homo sapiens
  misc_feature: GYAE6OF01AXLX6.16.10.A10.1.454.CMB.1.raw
  modified_base (341)..(341): a, c, t, g, unknown or other
  misc_feature (341)..(341): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgacgaaagntcctgacggcctataccactcagtcagcttcggttcgaccccgtggggccacgggaaccctggtcaccgtctcctcacgccctccaccgaacgggcccacgtccggttccttccccccgtggccctaccccgtccctacccgaacgacgccacccgtcgtcggggccacgacgccggcccgtcgggcgtcgccgtcggtacgaacggtactacgttacgacgtgtacgtacg

SEQ ID NO: 293451 - DNA, 574 bp, Homo sapiens
  misc_feature: GYAE6OF01BDN3M.16.10.A10.1.454.CMB.1.raw
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttccgacccgtgggccagggaccctggtccaccgtctcctcacgcctccaccaacgggcccacgtccggtccttcccccgtcggcccacccctccctcccaagacgcaccctcgtcggggcacgacggccgggccccgtcgggcctcggcccgtcgggtaccgaacggtaccttaccttacccggaggttacgtaacgtacgg

SEQ ID NO: 293452 - DNA, 657 bp, Homo sapiens
  misc_feature: GYAE6OF01DC3VU.16.10.A10.1.454.CMB.1.raw
  modified_base (199)..(199): a, c, t, g, unknown or other
  misc_feature (199)..(199): n is a, c, g, or t
tcagtgtactactccacgaccggtgctcgatttagcgtcgatctcagggtcgttcgtggctcacgtccaccaccacgcatgtgacctcaggggtccctgagactctcctgtgcagcctctggattcaccttagcggttatgccatgagctgggtccgccaggctccagggagggctggagtgggtctctaacttttagnggtagtggtggtcacgcctactacgcagagtccgtgaagggccattcacatctccagagacacttccgagaacacgctgtatctgcgaatgaacagcctgagagtcgaggacacggcatatatactgtaactaagtccgcgggtcgccgcggtcccggtaacctcgggatttgggttttcagttttcgacggggtaccaaggggtaccaagtcggtactaccgttctccgttacacgcccttaccgaccgaacgggcccctaagttcccgggtccctttaccccccgtcgggtaccctaccccgttccctacccgaaacggtcgaccctaacccgtcggttacggggacctaccgaccgggacccgtccccggtcgggtcccgttacggtcccgttagggtaccgaacggtacccttacgttcccgaaggttacgtactacgtagccgggtaccgggg

SEQ ID NO: 293453 - DNA, 589 bp, Homo sapiens
  misc_feature: GYAE6OF01DJFOS.16.10.A10.1.454.CMB.1.raw
  modified_base (206)..(206): a, c, t, g, unknown or other
  misc_feature (206)..(206): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccgaggggaaggggctgggagtgggtctctaacgtttttagngggtagtggtggtcacgcctactacgcagagtccgtgaagggccgattcaccatctccagagacacttccgagaacacgctgtatctgcgaatgaacagcctgagagtcgaggacacggccatatattactgtagacgaaagatccgtagaggccctaatacccacctcagtcagtcttgggttcccgaccccgtcggggacccgacgggaaccccgtggtccaccgttcctccctcacgccctaccaccgaaccgggcccacgttcccggtcccttcccccgtcgcccacccctccctaccaacgcgacctaccgtcgtcggggcacgcggccggcccgtcgggctcggcctggcaacgtctacgtccgagtcgtacgtacg

SEQ ID NO: 293454 - DNA, 545 bp, Homo sapiens
  misc_feature: GYAE6OF01DCLTZ.16.10.A10.1.454.CMB.1.raw
  modified_base (201)..(201): a, c, t, g, unknown or other
  misc_feature (201)..(201): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaactttttagnggtagtggtggtcacgcctactacgcagagtccgtgaagggccgattcaccatctccagagacacttccgagaacacgctgtatctgcgaatgaaacagcctgagagtcgaggacacggccatatattactgtgacgaaagatcctgaggcctataccactcagtcagctggtcgacccgtgggccacgggaaccctggtcaccgtctcctcacgcctccaccaacggcccatcgtccttcccctggccaccctccctccaacgacgcacctcgtcggggccacgacgccggcccgtgggcctggccgtggtcaacggtactaccgttcgacgtagtacgtacg

SEQ ID NO: 293455 - DNA, 524 bp, Homo sapiens
  misc_feature: GYAE6OF01EI0AI.16.10.A10.1.454.CMB.1.raw
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggccctgtggtggtgatatataaagacacacagacggccctcgagggactcccgtgggcgattctctggcctccagctcgagggacgacgagtcacgttgaccagtcggtgacgtccaggcagaagacgagggtgactattactgtctagtctgacaacaccactgcaggcggtgtcggcggaggaccaagcgtgaccgtcctgcgtcgagcccgaaggccgtcgcccccgtcggtccacctcgtccgtccccgtccccg

SEQ ID NO: 293456 - DNA, 594 bp, Homo sapiens
  misc_feature: GYAE6OF01AJ63A.16.10.A10.1.454.CMB.1.raw
  modified_base (340)..(340): a, c, t, g, unknown or other
  misc_feature (340)..(340): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagntcctgaggcctataccactcagtcagctggttcgaccctgggccagggacctggtcaccgtctcctcacgccctccaccaacgggcccacgtccggtccttccccctcggcccacccctccctcccaacgacgccaccctccgtcgggggccaccgacggccgggccccgtcggggcccgttcggccccgttcgggttacccgaaacgggtacccttaaccgtttacccggaacggttaacggtacctaaccgg

SEQ ID NO: 293457 - DNA, 586 bp, Homo sapiens
  misc_feature: GYAE6OF01A5LHE.16.10.A10.1.454.CMB.1.raw
  modified_base (329)..(329): a, c, t, g, unknown or other
  misc_feature (329)..(329): n is a, c, g, or t
  modified_base (339)..(339): a, c, t, g, unknown or other
  misc_feature (339)..(339): n is a, c, g, or t
  modified_base (359)..(359): a, c, t, g, unknown or other
  misc_feature (359)..(359): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaactttagtggtagtggtggtcacgcctactacgcagagtccgtgaagggccgattcaccatctccagagacacttccgagaacacgctgtatctgcgaatgaacagcctgagagtcgaggacacggccatatattacngtgcgaaagntcctgagcctataccacctnagtcagctggttccgaccccgtgggccagggaacccgtggtccaccgtctcctcacgcctaccaccgaacgggcccatccggtccttcccccgtcggccacccctccctacccgtaacgacgccctaccctcgtcgggggaccacgacgccgggccccgtcggggcctcggcccgtggtaccgaaacggtaccctaccgttacccggtagttaaccgtcgtaaccgg

SEQ ID NO: 293458 - DNA, 514 bp, Homo sapiens
  misc_feature: GYAE6OF01BY3UZ.16.10.A10.1.454.CMB.1.raw
  modified_base (423)..(423): a, c, t, g, unknown or other
  misc_feature (423)..(423): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagcccaccctcggtgtcagtgtccccaggacagacggccaggatcacctgctcttcagatgcattgccaaggcaatatgcttcttggtaccagcagaagccaggccaggccctgtggtggtgatatataaagacacacagacggccctcgagggactccccgtgggcattctctggctccagctcgagggacgacagtcacgttgaccagtcggtggagtccaggcagaagcgaggtgactattactgtacagtctagacaaacncactgcagcgtgtcggcggaggacagctcgaccgtctagcgtccagcccgagcctcgcccccgtcgtaccactcctccgttcccctacccg

SEQ ID NO: 293459 - DNA, 666 bp, Homo sapiens
  misc_feature: GYAE6OF01CCXBU.16.10.A10.1.454.CMB.1.raw
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagaccggccaggatcacctgctcttcagatgcattgccaaggcaatatgctttcttggtaccagccagaagccaggccacggcccctggtggtggtgattaataataaagacaacacagaggccctcgagggactcccgtgggcgtagttctcgtggcctccgagctcgacgggacgacagtcacgttgaactagtcgggtggacgtccgaggcaggaaacgacgaagggtagacgttaagttagtcgtacaggtctagaaccgaaaccaccacgtacgaccgtaacggtccgggttacggttaccggggacggggaacgggtaacccggaagggacccgttacgggaaccccggttcccgtggtacccggttaaccgaccgggaacccccgttaaacgggcccgttaccccgggccccccgttaccgggtaccctaacccgtttccccgttacccgggttccccccgtaccccccgg

SEQ ID NO: 293460 - DNA, 603 bp, Homo sapiens
  misc_feature: GYAE6OF01DJ2HS.16.10.A10.1.454.CMB.1.raw
  modified_base (340)..(340): a, c, t, g, unknown or other
  misc_feature (340)..(340): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttgtggtagtggtggtcacgcctactacgcagagtccgtgaagggccgattcaccatctccagagacacttccgagaacacgctgtatctgcgaatgaacagcctgagagtcgaggacacggccatatattactgtgacgaaagntcctaggacggcctaataacccgaccttcgagttcaggtcttgggttcccgaccccgtcggggcccgacgggaacccctcggtccacccgtcctcctcacgccctaccacccgaacgggccccacgtccggttcccttcccccgtggccctacccctccctccgaacgacgcctaccgtcgtcggggccacgacggccggcccgtcgggcctcggcccgtcggtacgaacggtaccttaccgttccgtacgtacgtacgtacg

SEQ ID NO: 293461 - DNA, 782 bp, Homo sapiens
  misc_feature: GYAE6OF01CMOBK.16.10.A10.1.454.CMB.1.raw
  modified_base (299)..(299): a, c, t, g, unknown or other
  misc_feature (299)..(299): n is a, c, g, or t
  modified_base (321)..(321): a, c, t, g, unknown or other
  misc_feature (321)..(321): n is a, c, g, or t
  modified_base (353)..(353): a, c, t, g, unknown or other
  misc_feature (353)..(353): n is a, c, g, or t
tcagtgtactactccacgaccggtgctcgatttagcgtcgatctcagggggtgggtccaggaggcagaactctgggtgtctcaccatggcctggatccctctacttcctccccctcctcactctctgcacaggctctggacggccttcctttgagttgacacagcccaccctcggtgtcagtcgccccaggaccagaccggccaggatcacctgcctcttcagatcgctattgccaaaggcaatatgctttcgttggaccagcaagaacgccaaggccacggccctggtggtgtgatanaataaagacacacagacgtccncagggatcccgtggcgattctctggctccgancgcgacgggacacgagtactaacgttcgaaccgacgtcgggtacggacgtacccggaaggaccgaaggaaacggaccggtaaggggtacgtaaaccgtttaagttaaccgtgttaccgaacggtttcctacgggaaccaaaaaccgacccctaaacgttcggaaccgtaaaccgggtcggggttttacccggggttccggggaccgggggtaaaccggggtaaacccgggtaaacggcccgttaaccgggtaaaccccccggtttacggaccggtcccggggttaaacccgacccgggtacccccggaaaacccggggttccccgttaaaccccccgggtccccccccggtttaaccccgggggtacccttacccccggtttaccggtttaccccccgggtttcccccccctttaaaaccccccccggg

SEQ ID NO: 293462 - DNA, 605 bp, Homo sapiens
  misc_feature: GYAE6OF01A1WJV.16.10.A10.1.454.CMB.1.raw
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccacggccctgtggtggtgatataataaagacacacagacggccctcgagggactcccgtgggcgtattctcgtggcctccgagctacgagggaccgacgacgtcacgttcgaaccagtccgggtaggacgtccgaggtacgaagaaggacggagggtagactattacgtgtacgtagtctacgacaaacaccagtcgacgacgtcggtcggtcgggacggtacgggaacctaggccgtacggacccgtcgtacggtccgtaccgacggccccgtaagggtccctacccggccccccgttacggtccctaacccgttcccgttcccgttcccccgtaacccccg

SEQ ID NO: 293463 - DNA, 522 bp, Homo sapiens
  misc_feature: GYAE6OF01B1QB9.16.10.A10.1.454.CMB.1.raw
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggcccctgtggtggtgatatataaagacacacagaggccctcgagggatccccgtgggcgtattctctggctccagctcgagggacgacagtcacgttcgaccagtcggtaggacgtccgaggcagaagacgagggtagactattactgtcagtctgacaaacacactgcagcggtgttcggcggacggacagctgaccgtccgtgcgtcagcccgaggcctcgcccccgtggtcctacgtcctcgtcccctaccccg

SEQ ID NO: 293464 - DNA, 644 bp, Homo sapiens
  misc_feature: GYAE6OF01BCBVV.16.10.A10.1.454.CMB.1.raw
  modified_base (202)..(202): a, c, t, g, unknown or other
  misc_feature (202)..(202): n is a, c, g, or t
  modified_base (259)..(259): a, c, t, g, unknown or other
  misc_feature (259)..(259): n is a, c, g, or t
  modified_base (328)..(328): a, c, t, g, unknown or other
  misc_feature (328)..(328): n is a, c, g, or t
  modified_base (331)..(331): a, c, t, g, unknown or other
  misc_feature (331)..(331): n is a, c, g, or t
  modified_base (339)..(339): a, c, t, g, unknown or other
  misc_feature (339)..(339): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccgaggggaaggggctggagtgggtctcaacttttagnggtagtggtggtcacgcctatacgcagagtccgtgaaggccatcaccatctccaganacacttccgagaacacgctgtatctgacgaatcgaacagcctgagagtcgagacacggcatatattacngtnacgaaagntccgtagacgtcctataccctactcagtcagtctcgggttcccaccccgtgggccgaacgggacccttcggtaccgacccgtcctaccctaccgacgtaccctaccgaaccgaacggccctacgtcccggttccccttcccccgtacggcccctaccccttcccgtaccccgtaacgaccgaccctacccgtaccggtcggggaccaccggccgtacccggtcccggtcgggcccgtccggtccgttcgggtaaccgtaaacggtacccttaccgttaccggtaacgttaacgtaccgtaaccgg

SEQ ID NO: 293465 - DNA, 505 bp, Homo sapiens
  misc_feature: GYAE6OF01CQ9IB.16.10.A10.1.454.CMB.1.raw
  modified_base (305)..(305): a, c, t, g, unknown or other
  misc_feature (305)..(305): n is a, c, g, or t
  modified_base (419)..(419): a, c, t, g, unknown or other
  misc_feature (419)..(419): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggccctgtggtggtgatatataaagacacacagaggccctnagggatccccgtgggcgattctctggctccagctcagggacgacagtcacgttgaccagtcggtggagtccaggcagaagacgagggtgactattactgtcagtctgacaaacncactgcagcggtgtcggcggaggacagctgaccgtcctgcgtcagcccaggctcgcccccgtcgacactcctcgttcccctacccc

SEQ ID NO: 293466 - DNA, 681 bp, Homo sapiens
  misc_feature: GYAE6OF01B61D8.16.10.A10.1.454.CMB.1.raw
  modified_base (217)..(217): a, c, t, g, unknown or other
  misc_feature (217)..(217): n is a, c, g, or t
  modified_base (236)..(236): a, c, t, g, unknown or other
  misc_feature (236)..(236): n is a, c, g, or t
tcagtgtactactccacgaccggtgctcgatttagcgtcgatctcagggggtgggtccaggaggcagaactctgggtgtctcaccatggcctggatccctctacttttccccctcctcactctctgcacaggctctgaggccttcctttgagttgacacagcccaccctcggtgtcagtcgtccccaggacagacgccaggatcacctgctctcagntgcattgaccaaggcaatntgcttcttggtaccagcagaacgccaggccaggcccctggtcggtggtgatataataaagacacacagacgccctagaggactccgtgggcattctcgtggcctccgacgctacgacgggacgacgtacggtacctacggttacgacccgtagtcgggtagggacgtaccgagggaccaaggaacggacggtaaggggtacgtaacgttaagttacgtaggtacgacggttcctagaacctaaaccacctacgtcgacgacgggtcgggttacggttaccggggacgggaacgggaccaacgggtcgtaccggacccggttccgtacggtaccggtaccgaccggaccccggaacgggtccccgttaccccgggtcccccccgttacggtacccgtacccttacccgggtttccccggttccccccgtcccccgtttaccccggg

SEQ ID NO: 293467 - DNA, 584 bp, Homo sapiens
  misc_feature: GYAE6OF01BM7WR.16.10.A10.1.454.CMB.1.raw
  modified_base (332)..(332): a, c, t, g, unknown or other
  misc_feature (332)..(332): n is a, c, g, or t
  modified_base (342)..(342): a, c, t, g, unknown or other
  misc_feature (342)..(342): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccgaggggaaggggctggagtgggtctctaacttttaggtggtagtggtggtcacgcctactacgcagagtccgtgaagggccattcaccatcctccagagacacttccgagaacacgctgtatctgcgaatgaacagcctgagagtcgagacacggcatatattacngtgacgaaantcctggacgcctaactacccacctcagtctagcgtcggttacccgaccccggtcgggcccgacgggacccgtcggtaccaccgtctcctcaccgcctaccaccgacggcccacgtccgtcctcccgtcgcccaccctccaccagcgcaccgtcggtcgggccacgcgcccggtaccgtcgggcgtcggtccgtacggtaccgaacgtaccgttaccgttaccgtacgttaacgtcgtaacgg

SEQ ID NO: 293468 - DNA, 545 bp, Homo sapiens
  misc_feature: GYAE6OF01BRTB8.16.10.A10.1.454.CMB.1.raw
  modified_base (539)..(545): a, c, t, g, unknown or other
  misc_feature (539)..(545): n is a, c, g, or t
tcagtgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaatcctcgacttatgatcttttgactggtctactttcaatactggggccaggggacccgggtcaccgtctcttcagcctccaccaagggcccatcggtccttcccctggccacccctcctaccaacgacgccaccgtcgtcgggggcacgacgccgggccctgggcctcgtccgtcgggtcaacggacctaaccgttccgagtacgtacactggaggcgggcgtgggcaagggccgcgagtagcnnnnnnn

SEQ ID NO: 293469 - DNA, 987 bp, Homo sapiens
  misc_feature: GYAE6OF01D8A2H.16.10.A10.1.454.CMB.1.raw
tcagtgtactactccacgaccggtgctcgatttagcgtcgatctcagggggtggtccaggaggcagaactctggtgtctcaccatcggcctggatccctctacttctcccctctcactctctgcacaggctctgaggcctctttgagttgacacagccaccctcggtgtcagtcgtccccaggacaggacggccaggatcactgctcttcagatgctattcgaccaaggccaaatagtcgtaccttttacgttcgggtacctaaggccgaaagaacgcccgaacgggccccgaaacgggtcccccgttaggttaccggttaggtacggtaactttaagttaacgttaaaacggaccgtaacccgaaccgtaacgggaccgggtacccctttacggaacggggtaacttcccccggttaggggccgtaaacgttttccgtaccggttaacggggtccccgtttacccggaacggtacccgtacccgggtaacggggtaaccccgtaaaccgtaacggtttcccgaaaacccgggtttacgtaaacccccgtaagggtttacccggggttacgggtaaccggtttaccccgggtaaacggggaacccggttaaagggaaaaccgggtaaccgggggttaaacgggggttacggtaaaacccggtttttaaaggttttaaccccggtttaacgggttttaccggtaaaccgggttttacccgttaaccgggtaaccttaaaaaccccggttcccgttaaccggtttacggaaccccggttaacggggttacccgggttttaacgggtttcccggggaaaccgggggtaacccggggtaaacccgtaacgggttcccgtaacgggttaaccccgttacccggtacggttaacccggtaccgtaacgggaccccggtaacggtacccgtccggtaaccccccgttggtaccccttaacgtttccccgttaccgttcccccgttaacccccgg

SEQ ID NO: 293470 - DNA, 623 bp, Homo sapiens
  misc_feature: GYAE6OF01D8NQA.16.10.A10.1.454.CMB.1.raw
  modified_base (320)..(320): a, c, t, g, unknown or other
  misc_feature (320)..(320): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagcccaccctcggtgtcagtcgtccccaggacagacggccaggatcacctgctcttcagatgcattgaccaaggcaatatgcttcttggtaccagcaagaagccaggccacggccctgtggtgtgatatataaagacacacagacgccctgaggactcccgngggcattctctggctccgagctacgagggacacagtccacgttcgaccgtagtcgggtaggacgtccgaaggcaaggaagacggagggtgaacttagttacctgtactacgtctagaccaaacacctactcgactacggtcgggtcgggttaccgggacgggtaaccgggaccaacgggtccgtacggtacccgttccgtcggtacccggttaccggaaccgtaccccggaaacggtcccgtccccggaccccccgttcgggtaaccctacccgttcccgttcccggtcccccgtaccccccg

SEQ ID NO: 293471 - DNA, 576 bp, Homo sapiens
  misc_feature: GYAE6OF01CKYTN.16.10.A10.1.454.CMB.1.raw
  modified_base (200)..(200): a, c, t, g, unknown or other
  misc_feature (200)..(200): n is a, c, g, or t
  modified_base (340)..(340): a, c, t, g, unknown or other
  misc_feature (340)..(340): n is a, c, g, or t
  modified_base (418)..(418): a, c, t, g, unknown or other
  misc_feature (418)..(418): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagnggtagtggtggtcacgcctactacgcagagtccgtgaagggccattcaccatctccagagacacttccgagaacacgctgtatctgcgaatgaacagcctgagagtcgaggacacggccatatattactgtgacgaaagntcctgacggcctaataccactcagtcagtctggtccgaccccgtgggcccgacgggaccctggtccaccgtctcctcncgccctccaccgacggcccacgtccggtccttccccgtgccctaccctccctacccgaacgcgccaccgtcggcggggccacgcggccggtcccgtcgggtccgtcggcccgtcggtacgaacggtaccttaccgttaccggacgtcgtaccgtacgg

SEQ ID NO: 293472 - DNA, 571 bp, Homo sapiens
  misc_feature: GYAE6OF01D3BBT.16.10.A10.1.454.CMB.1.raw
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggccctgtggtggtgatatataaagacacacagaggccctgagggactcccgtagggcgattctctggctccagctcgagggacgacagtcacgttgaccagtcgggtggacgtccgagccgaagaagacgaggtgactattactgtcagtctgacaaacaccacgtcgacgacggtcggtcggttccgggcgggaacgggtactaacgcgtacgaccgtccgtcggtccgtacacggcccgaaacggtcccgtaccgtccccccgtcggtaccctaccgttccgttcccgttccccgtaacccccg

SEQ ID NO: 293473 - DNA, 501 bp, Homo sapiens
  misc_feature: GYAE6OF01BN7OG.16.10.A10.1.454.CMB.1.raw
  modified_base (415)..(415): a, c, t, g, unknown or other
  misc_feature (415)..(415): n is a, c, g, or t
tcagtgtactactccacgaccggtgctcgatttagcgtcgatctcagggggtgggtccaggaggcagaactctgggtgtctcaccatggcctggatccctctacttctcccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggcccctgtggtggtgatatataaagacacacagaggccctcagggatccctgggcgattctctggctccagctcagggacgacagtcacgttgaccatcggtggagtccaggcagaagacgagggtgactattactgtcagtctgcaaacnccactgcagcggtgttcggcggtagggaccagctcgaccgtcctgcgtcagcccaggctcgcccctgcactctcgtcccgtccccg

SEQ ID NO: 293474 - DNA, 553 bp, Homo sapiens
  misc_feature: GYAE6OF01ARI8A.16.10.A10.1.454.CMB.1.raw
  modified_base (200)..(200): a, c, t, g, unknown or other
  misc_feature (200)..(200): n is a, c, g, or t
  modified_base (272)..(272): a, c, t, g, unknown or other
  misc_feature (272)..(272): n is a, c, g, or t
  modified_base (298)..(298): a, c, t, g, unknown or other
  misc_feature (298)..(298): n is a, c, g, or t
  modified_base (337)..(337): a, c, t, g, unknown or other
  misc_feature (337)..(337): n is a, c, g, or t
  modified_base (340)..(340): a, c, t, g, unknown or other
  misc_feature (340)..(340): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccaggggaagggctggagtgggtctcaacttttagnggtagtggtggtcacgcctactacgcagagtccgtgaagggccgattcaccatctccagagacacttccganaacacgctgtatctgcgaatcgaacngcctgagagtcgagacacggcatatatactgtgcgaaantcngacgcctataccactcagtcagtcgtcggttccgacccgtgggccgacgggacctcggtcaccgtctcctcacgccctaccgaccgacggcccactccgtcctccccgcgccaccctcctccaacgcgcaccgtcgcgggccacgacgccggcccgtgggcctcggtcccgtcggtaccgaaggtacctacgttaccggagtacgtacgtacg

SEQ ID NO: 293475 - DNA, 587 bp, Homo sapiens
  misc_feature: GYAE6OF01C0RLF.16.10.A10.1.454.CMB.1.raw
  modified_base (274)..(274): a, c, t, g, unknown or other
  misc_feature (274)..(274): n is a, c, g, or t
  modified_base (300)..(300): a, c, t, g, unknown or other
  misc_feature (300)..(300): n is a, c, g, or t
  modified_base (333)..(333): a, c, t, g, unknown or other
  misc_feature (333)..(333): n is a, c, g, or t
  modified_base (383)..(383): a, c, t, g, unknown or other
  misc_feature (383)..(383): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccaggggaaggggctggagtgggtctctaacttttagtggtagtggtggtcacgcctactacgcagagtccgtgaagggccgattcaccatctccagagacacttccganaacacgctgtatctgcgaaatgaacngcctgagagtcgaggacacggccatatattacngtgacgaaagctccgtgacggcctaatacccactcagtcagctggttccncccgtcgggccgacgggacctggtccacccgtctcctcacgcctcccgaccgaacggcccacgtcccggtccctttcccccgtcggcccacccctccctacccgaacgaccgccaacccgtcggtcggggccaccgacggccggcccgtcgggctcggcccgtcggtacgaacggtaccttacgttccgacgttagtactacgg

SEQ ID NO: 293476 - DNA, 573 bp, Homo sapiens
  misc_feature: GYAE6OF01BUOIL.16.10.A10.1.454.CMB.1.raw
  modified_base (202)..(202): a, c, t, g, unknown or other
  misc_feature (202)..(202): n is a, c, g, or t
  modified_base (342)..(342): a, c, t, g, unknown or other
  misc_feature (342)..(342): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccaggggaaggggctgggagtgggtctcaacttttagnggtagtggtggtcacgcctactacgcagagtccgtgaagggccattcaccatctccagagacacttccgagaacacgctgtaatctgcgaatgaacagcctgagagtcgaggacacggcaatatattactgtgcgaaagntcctggagcctataccactcagtcagctggttccgacccgtgggccacgggaaccctggtcaccgtctcctcacgcctccaccgaacggcccagtcgtccttccccgtcggccaccctccctaccaagacgccaccgtcgtcggggccacgacgccggcccgtcgggctcggcccgtcggtaccgaacgggtaccttaccgttacccggaaggttacgtaaccgtaaccgg

SEQ ID NO: 293477 - DNA, 598 bp, Homo sapiens
  misc_feature: GYAE6OF01CABO7.16.10.A10.1.454.CMB.1.raw
  modified_base (592)..(592): a, c, t, g, unknown or other
  misc_feature (592)..(592): n is a, c, g, or t
  modified_base (594)..(596): a, c, t, g, unknown or other
  misc_feature (594)..(596): n is a, c, g, or t
  modified_base (598)..(598): a, c, t, g, unknown or other
  misc_feature (598)..(598): n is a, c, g, or t
tcagtgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgaagaacacgctgtatctgcgaatgaacagcctgagagtcgaggacacggccatatattactgtgacgaaagatcctgacggcctataccacctcagtcagctggttccgaccccgtggggccacgggaaccctggtccaccgtcctcctcacgtccctccaccgaaacgggcccctaacgtccggttcccttcccccgtcggtcccctacccctccctacccaacgacgacctacccgtcgtcgggggccacgacggccggcccgtgggctcggcctgggtaccgtaacggtaccttacgttccgagttaacgtaccgtacgtcggacggccgggtcgtgggacgaacgggccgacgacgtagnannngn

SEQ ID NO: 293478 - DNA, 534 bp, Homo sapiens
  misc_feature: GYAE6OF01C7JEL.16.10.A10.1.454.CMB.1.raw
  modified_base (318)..(318): a, c, t, g, unknown or other
  misc_feature (318)..(318): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctccttttgagttgacacagccaccctcggtgtcagtgtccccaggacagacggccaggatcacctgctcttcagatgcattgccaaggcaatatgcttcttggtaccagcagaagccaggccaggccctgtggtggtgatatataaagacacacagaggccctgagggactcccgngggcgattctctggctccagctcgagggacgacagtcacgttgacccagtcggtggacgtccgagccaagaacgacggagggtgaactaattactgtcagtctcgacaaacaccactgcagcggtgttcggcggaggacagctgaccgtctgcgtcgacgcccaaggccgtccgcccccgtcgggtaccaccgttcgtccgttccccgtacccccg

SEQ ID NO: 293479 - DNA, 554 bp, Homo sapiens
  misc_feature: GYAE6OF01BBDSM.16.10.A10.1.454.CMB.1.raw
tcagtgtactactccacgaccggtgctcgatttagcgtcgatctcagggggtgggtccaggaggcagaactctgggtgtctcaccatggcctggatccctctacttctccccctcctcactctctgcacaggctctgaggccttcctttgagttgacacagcccaccctcggtgtcagtcgtccccaggacagacggccaggatcacctgctcttcagatgcattcgaccaaggcaatatgtcttcttggtaccagacagaagccaggccacggccctgtggtggtgatatataaagacacacagacgccctgaggactccgtgggcattctcgtggcctccagctcgagggacgacagtcacgttgaccgtagtcgggtagacgtccgaggacaaggaaggacggaggtagaacttagttacgtgtactagtctacgacaacaccactgcgaggtcggtgtacgggacggacggaccgagcctagcccgtctgaccgtcgaccgaccgagcccgtccgccccgtcgaccctacgtcctcccgtccccgtcccg

SEQ ID NO: 293480 - DNA, 557 bp, Homo sapiens
  misc_feature: GYAE6OF01DJC9V.16.10.A10.1.454.CMB.1.raw
  modified_base (201)..(201): a, c, t, g, unknown or other
  misc_feature (201)..(201): n is a, c, g, or t
  modified_base (299)..(299): a, c, t, g, unknown or other
  misc_feature (299)..(299): n is a, c, g, or t
  modified_base (424)..(424): a, c, t, g, unknown or other
  misc_feature (424)..(424): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcaccttagcggttatgccatgagctgggtccgccaggctccgaggggaagggctggagtgggtctctaacttttggnggtagtggtggtcacgcctactacgcagacgtccgtgaacgggccattcaccatctccagacgcacttccgagaacacgctgtatctgcgaatgaacngcctggagagtcgaggacacggccatatatactgtgacgaagatcctgaggcctaagtacccacctcagtcagtctggttcgccccgtgggccacgggaaccgtggtcaccgtctcctcacgccnctaccgaacggcccacgtcggtccttccccgtcgccaccctcctccgacgacgcacctcgtcggggcacgacggccggcccgtcgggctcggccgtcggtcgaacggtactacgttaccgagtacgtctaccg

SEQ ID NO: 293481 - DNA, 506 bp, Homo sapiens
  misc_feature: GYAE6OF01BHWSR.16.10.A10.1.454.CMB.1.raw
  modified_base (326)..(326): a, c, t, g, unknown or other
  misc_feature (326)..(326): n is a, c, g, or t
  modified_base (393)..(393): a, c, t, g, unknown or other
  misc_feature (393)..(393): n is a, c, g, or t
  modified_base (417)..(417): a, c, t, g, unknown or other
  misc_feature (417)..(417): n is a, c, g, or t
  modified_base (456)..(456): a, c, t, g, unknown or other
  misc_feature (456)..(456): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggcccctgtggtggtgatatataaagacacacagaggccctcagggatccctgggcgattcnctggctccagctcgagggacgacagtcacgttgaccatcggtggagtccaggcagaagacgagggtnactattactgtcagtctgcaaacncatgcagcggtgttcggcggaggaccagctcgaccgtcngcgtcacgcccaaggcctcgccccctggtccacgtctcgtcccctacccg

SEQ ID NO: 293482 - DNA, 629 bp, Homo sapiens
  misc_feature: GYAE6OF01BS50Q.16.10.A10.1.454.CMB.1.raw
  modified_base (467)..(467): a, c, t, g, unknown or other
  misc_feature (467)..(467): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtcgtccccaggacagacggccaggatcacctgctcttcagatgcattgaccaaggcaatatgtcttcttggtaccagcaagaagccaggccaggccctgtggtggtgatataataaagacaacacagacggccctcgagggactcccgtgggcgtaattccgtcgtcggctccgagctcgaggggacaacgaggtcacgttacgaacctagtcggtggagtcccgagggtcgaacggaaggaccgggtaagggtagtacgttaaattacgtgtacagtctacgacaaaccnccactgcgagtcggtaggttaccgggacgggtaacgggaccgaacggtccgacggtacccgtccgtcgccggtccaccggtacccgaaacgggcccgttacccggcccccccgtcgggttacccaccgtttcccgttcccggttccccccgttaacccccgg

SEQ ID NO: 293483 - DNA, 535 bp, Homo sapiens
  misc_feature: GYAE6OF01BQ7XL.16.10.A10.1.454.CMB.1.raw
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggccctgtggtggtgatatataaagacacacagaggccctcgagggatcccgtgggcgtattcgtctggctccagctcagggacgacagtcacgttgaccagtcggtggacgtccaggcagagacgaggtgactattacgtgtcagtctgaccaaacaccacgcgcgacgcggtgttcggcggacgggaccagcgtcgaccgtcgtacgcgtcacggcccgaacggccgtccgccccgtcggtcctaccgtcctccgttccccgtaccccg

SEQ ID NO: 293484 - DNA, 598 bp, Homo sapiens
  misc_feature: GYAE6OF01CNDJ4.16.10.A10.1.454.CMB.1.raw
  modified_base (342)..(342): a, c, t, g, unknown or other
  misc_feature (342)..(342): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaactttttagtggtagtggtggtcacgcctactacgcagagtccgtgaagggccgattcaccatctccagagacacttccgagaacacgctgtatctgcgaatgaacagcctgagagtcgaggacacggccatatattactgtgacgaaagntcctaggacgcctaatacccacctcacgtcagtcctggttaccgaccccgtcgggccgacgggaacccgtcggtccacccgtcctcctcacgccctaccaccgaacggcccgtacgtccggttccttccccgtcggccctacccctccgtacccaacgacgcctaccgtccgtcggggtccacgacgccggcccgtcgggctcggtccgtacggtacgaacggtaccttaccgttaccgtacgtacgtacgtacgg

SEQ ID NO: 293485 - DNA, 697 bp, Homo sapiens
  misc_feature: GYAE6OF01B0L5W.16.10.A10.1.454.CMB.1.raw
  modified_base (171)..(171): a, c, t, g, unknown or other
  misc_feature (171)..(171): n is a, c, g, or t
tcagtgtactactccacgaccggtgctcgatttagcgtcgatctcagggggtgggtccaggaggcagaactctgggtgtctcaccatggcctggatccctctacttctcccctctcactctctgcacaggctctgaggcctccttttgagttgacacagccaccctcggtntcagtcgtccccaggacaggacggccaggactcgacctgcctcttcagatcgcattcgccaaggcaatatgtctttcttcggtaccacgacagacgaccgacggccgacggccgtggtcggtcgtagtataactaagtaaacgacaacgacgacggacggtccgtacggacgggtacttccggtcgggtaccgtactttcgtcgtacggtcctacgtacgtcgtacggacggacgacgtacgtacgtacggtacgaccgtacggtcgggtacggtacgtaccgacggacgaaggtaacggtaacggtagggtaacgtaacgttaagttacgttacgtacgtacgtacgtaacgaacctaaccgaccgtacgtcgacgtacggtacggtacgggtacgggacggtacggtaacctacggtacgtacggtaccggttaccggtacggtaccgaccggtaccgtacggtcccgtcccggtaccccgttacgtacctaccgttccgttacccgttccccgtaccgtccgg

SEQ ID NO: 293486 - DNA, 626 bp, Homo sapiens
  misc_feature: GYAE6OF01CGDUL.16.10.A10.1.454.CMB.1.raw
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggccctgtggtggtgatataataaagacacacagacggccctacgagggactcccgtgggcgtattctcgtcggctccgagctacgagggacgacagtcgacgttgacccagtcggtaggacgtccgaggacaaggaagacggaagggtacgaacgttaagttacgtggtactaaggttcctagaaccaaacacccaacgtcgaccgaggtcggttcgggttccgggacgggaacgggaacccaggaccgtacgggacccgttccgtacggtcccggtacgaccggacccgaaacgggcccgtacccggccccccgttacggtacccaccgttcccgttccggtttccccccgtaacccccg

SEQ ID NO: 293487 - DNA, 615 bp, Homo sapiens
  misc_feature: GYAE6OF01DKH5N.16.10.A10.1.454.CMB.1.raw
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggaccagcagaagccaggccacggccctgtggtggtgatatataaagacacacagaggccctgaggactcccgtgggcgattctcgtgctccagcctacgagggacgacgagtccacgtttgaccagtcgggtaggacgtccgaggcgaaggaaggaacggagggtgaacgttaagttacgtgtctagtctagaccaaacaccactgacgtacggtcggttgggttccgggacgggaacgggaccgtaacggccgtacggtaacccggtccgtacggtccggtaccgacggaccccggaacggtcccggtacccggtcccccccgttacgggttaccctacccgttccgttcccgttccccccgtaacccccg

SEQ ID NO: 293488 - DNA, 550 bp, Homo sapiens
  misc_feature: GYAE6OF01BZ2DR.16.10.A10.1.454.CMB.1.raw
  modified_base (299)..(299): a, c, t, g, unknown or other
  misc_feature (299)..(299): n is a, c, g, or t
  modified_base (468)..(468): a, c, t, g, unknown or other
  misc_feature (468)..(468): n is a, c, g, or t
  modified_base (470)..(470): a, c, t, g, unknown or other
  misc_feature (470)..(470): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctgggagtgggtctctaacttttagtggtagtggtggtcacgcctactacgcagagtccgtgaagggccgattcaccatctccagagacacttccgagaacacgctgtatctgcgaatgaacngcctgagagtcgaggacacggccatatattactgtgcgaaagatcctagacggcctataccactcagtcagctggtccgacccgtgggccaggacctggtccaccgtctcctcacgcctccaccacggcccactccgtccttccccctcgccaccctcctccaacgacncnccgtcgtcggggcacgacgccggcccgtcgggctcggccgtcggtcgaacggtactaccgttaccgagtacgtacgtacg

SEQ ID NO: 293489 - DNA, 617 bp, Homo sapiens
  misc_feature: GYAE6OF01AQQEK.16.10.A10.1.454.CMB.1.raw
  modified_base (205)..(205): a, c, t, g, unknown or other
  misc_feature (205)..(205): n is a, c, g, or t
  modified_base (259)..(259): a, c, t, g, unknown or other
  misc_feature (259)..(259): n is a, c, g, or t
  modified_base (287)..(287): a, c, t, g, unknown or other
  misc_feature (287)..(287): n is a, c, g, or t
  modified_base (308)..(308): a, c, t, g, unknown or other
  misc_feature (308)..(308): n is a, c, g, or t
  modified_base (344)..(344): a, c, t, g, unknown or other
  misc_feature (344)..(344): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattccacccttagcggttatgccatgagctgggtccgccaggctccgaggggaaggggctgggagtgggtctctaacttttagnggtagtggtggtcacgcctactacgcagagtccgtgaagggccattcaccatcncagagacacttccgagaacacgctgtanctgcgaatgaacagcctgagngtcgaggacacggccatatattactgtgcgaaaagntcctgacggtcctaataccactcagtcagcttggttccgaccccgtgggccacgggtaaccctcggtaccgaccgtctcccgtcacgtcctcccaaccgaaccgggcccaagtcccggttccttccccccgtcggcccaccccgtccctacccgtaacgacgcctacccgtcgtcggggaccaccgacgcccgggcccgtcggggccttcggcccgttagggtcccaaacgggtaccgtacccgttaccggaacgttaacggtaccgtaacgg

SEQ ID NO: 293490 - DNA, 625 bp, Homo sapiens
  misc_feature: GYAE6OF01CFPYT.16.10.A10.1.454.CMB.1.raw
  modified_base (320)..(320): a, c, t, g, unknown or other
  misc_feature (320)..(320): n is a, c, g, or t
  modified_base (324)..(324): a, c, t, g, unknown or other
  misc_feature (324)..(324): n is a, c, g, or t
  modified_base (356)..(356): a, c, t, g, unknown or other
  misc_feature (356)..(356): n is a, c, g, or t
  modified_base (379)..(379): a, c, t, g, unknown or other
  misc_feature (379)..(379): n is a, c, g, or t
  modified_base (388)..(388): a, c, t, g, unknown or other
  misc_feature (388)..(388): n is a, c, g, or t
  modified_base (427)..(427): a, c, t, g, unknown or other
  misc_feature (427)..(427): n is a, c, g, or t
  modified_base (465)..(465): a, c, t, g, unknown or other
  misc_feature (465)..(465): n is a, c, g, or t
  modified_base (502)..(502): a, c, t, g, unknown or other
  misc_feature (502)..(502): n is a, c, g, or t
tcagtgtactactccacgaccggtgctcgatttagcgtcgatctcaggggggtggggtccaggaggcagaactctgggtgtctcaccatggcctggatccctctacttcctcccctctcactctctgcacgaggctcgtggacggcctccttttgagttcgaccacacgccctacccgtggtcgtcaggtcgtccccgagggaccacggacggccagggtactccaccgtgccttctacgagatgactagtcgacctaaaggcaattatcgtacttcgttggaccacgacaagaacgccagggccacggcccgtgtaggngtanaatagttaacaaagacacacacgacggtcccngagggactcccgtggctattcgntggcctacngtactcgaggacactagtccacgttcgacctagtcgggngacgtccgagcaggaacgcggtaggacaacgtattagngtacaggtctacaaccaaaatcaacctgacaacgggnggttcgtcgggacgggtacgggaaccaggttccgtacggacccggtctacggacgtaccgacggtacccgacggccgtccccgccccgttacgggcttacccgtcgtccttccccggaacccc

SEQ ID NO: 293491 - DNA, 903 bp, Homo sapiens
  misc_feature: GYAE6OF01D3HSP.16.10.A10.1.454.CMB.1.raw
tcagtgtactactccacgaccggtgctcgatttagcgtcgatctcagggggtgggtccaggaggcagaactctgggtgtctcaccatggcctggatccctctacttctccccctcctcactctctgcacaggctctgaggccttcctttgagttgacacagcccaccctcggtgtcagtcgtccccaggacagacggccaggatcacctgctcttcagatgcattcgaccgaaggccaatatgtctttcgtggtaccagcaagaacgccgacggcccacggtccctggtcggtggtagtattaactaataaaacgacaacgaacgaggaaccggcccctacggaacggggtaccttccccggtaggggtccgtaacgtttccgtccgttacggtccctaccgtacggtaccgttaccggaacgggggaacccgtaaaccgtaacggttacccgtaaccgggtttacggaacccgtaacggttccggggttaacggggtaaccggttaccccggaaaggggtaccgaaaacggggtaaacgggtaaccggggtaagggggttacgttaaaccgtttaaacggttttaaccgttacggttaccgtaacggttaccgtacggtaaacccaaaaccgtaccccgtaacgttacggaccggtaacgggtaccgggtttacggggttaccggggtaaccgggggaacggggtaaccgaaacggttcccggttaaccgggtaaccccggttccggttaccgggtacccggtttaacccggaaccgggtacccccggtaaaccggggttccccgttacccccgggttacccccccggtttaccggggtaaccccgttaccccggttttaccccggtttacccggttttcccccccccgtaaaccccccggg

SEQ ID NO: 293492 - DNA, 653 bp, Homo sapiens
  misc_feature: GYAE6OF01DMS4X.16.10.A10.1.454.CMB.1.raw
  modified_base (203)..(203): a, c, t, g, unknown or other
  misc_feature (203)..(203): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccgaggggaaggggctggagtgggtctctaacttttagnggtagtggtggtcacgcctactacgcagagtccgtggaagggccattcaccatctccagagacacttccgagaacacgctgtatctgcgaatgaacagcctgagagtcgaggacacggccatatattactgtgacgaagactcctggaggcctaataacccacctcagtcaggtcctcgggtttacccgaccccgtcggggacccgacggggtaacccgtcgggtaccacccgtcctccctcgacgccctacccaccgaaccgggccctacgtccggttcccttcccccgtcggccctaccccttcccgtacccgaacgaccgaccacccgttccggtcgggggccacgaccggtccgggaccccggtcgggccgtccggtcccggttacgggtaccgtaaacgggtaccgttaacccgtttacccggaacggttacgtaccgtaaccgg

SEQ ID NO: 293493 - DNA, 570 bp, Homo sapiens
  misc_feature: GYAE6OF01EJVKR.16.10.A10.1.454.CMB.1.raw
tcagtgtactactccacgaccggtgctcgatttagcgtcgatctcagggggtgggtccaggaggcagaactctgggtgtctcaccatggcctggatccctctacttctccccctcctcactctctgcacaggctctgaggccttcctttgagttgacacagcccaccctcggtgtcagtgtccccaggacagacggccaggatcacctgctcttcagatgcattgccaaggcaatatgtcttcttggtaccagcagaagccaggccacggccctgtggtgtgatatataaagacacacgagacgccctgagggactcccgtgggacgtattctcgtcggctccgagctcgagggacacgagtctacgttcgaccagtcgggtaggacgtccgaggacaaggaagacggtagggtatacgtattacgtgtcagtctacgacaaacaccatcgcaggtcggtggtcggacggacggaccagcgtacggaccgtccgtacggccgtcgaccgacccggaacggccctccggacccccgttcggtaccaccgttccgtcccgtccccgtccccg

SEQ ID NO: 293494 - DNA, 715 bp, Homo sapiens
  misc_feature: GYAE6OF01DQ320.16.10.A10.1.454.CMB.1.raw
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtcgtcccaggacagacggccaggatcacctgctcttcagatgcattgaccaaggcaatatgctttctggtaccagcaagaacgccaaggcccaggccctgtcggtggtgagtataataaaagacaacacaggacggccctcgagggtactcccgtgggctacttctcgtggcctccagctcgagggacgacagtcacgttacgaccgtaagtcgggtaggacggttccgaagggccaaaggaacggaacggtaggggtcgaacttaacgtttaacgtcgggttacctaggttactacggaacctaaaccgaaccccgtaacgttacgggaccgaacgggttccgggtttacgggttaccgggggacggggtaaaccggggaacccgtaaggtccggttaaccggtaccccgggtccgtcgggtacccggttacggaacccggacccccggtaaacgggtccccgttacccggtacccccccggttacgggttaccctaacccggtttccttaccccggttaccccccgtaaccccccgg

SEQ ID NO: 293495 - DNA, 767 bp, Homo sapiens
  misc_feature: GYAE6OF01BVLXE.16.10.A10.1.454.CMB.1.raw
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtcgtccccaggacaggacggccaggatccacctgctcttcagatgctattcgaccgaaaggcctaaatatgtcctttcgttacggtacccagccgaagaacgccgacggtcccgaacggtcccctggtgggtggtagtaatataagtaaaacgacctaacgacgaggacggaccctacggaagggtactcccgtagggtaccgtactttccgtcgtcggacctccgagtcctacggagggaccgacgtacgtaccgtacggttcgaaccgacgttcgggtacgggacgtacccgagggaccaagggaacggtaccgggaagggtacgtaacttaagttaccgtagtacctacggttactacggaaccaaacccgtacctaccgtcggaacgtacgggtccggggttaccggttaccggggaccgggtaaccgggtaacccgacggtccgtaccgggtaaccccggttccgtaccgggtaccggtacccggtaacccgggtacccggtaaccgggtcccgttacccccgggccccccggtttacggacccttacccgttacccggttccccgtttaccccccgtaaccccgg

SEQ ID NO: 293496 - DNA, 1081 bp, Homo sapiens
  misc_feature: GYAE6OF01DEHBB.16.10.A10.1.454.CMB.1.raw
tcagtgtactactccacgaccggtgctcgatttagcgtcgatctcagggtcttcgtggctcacgtccaccaccacgcatgtgacctcgaggggtccctgagactctcctgtgcagcctcgtggacttccacccttaggcggtttatcgaccagtggacggtccgtcggggtccccgaccgagggcctaccggaaggggggaacgggggctggggaggttcgggtccttacgttaaacgtttttagggtgggttaggttggggttcggtccaaccgtccttaccgtaacggccgaggtacggttcccggtaggaaacggggtccccgtaatttccaacctacgttccctaccgaaggaacggaacctaaccgttcccggaaacgaaaccgaccggtcgttcggttaacttccgtacggacggtaaagttacggaaacgacggcccgttagggaacggtacgggttaccgggaacgggacccgaaccgggtaccctaaagtttaactttaacgttttaaccggttggtaacggaacggtaaaaacgtccgtttaccggtacggtaaccggggtacccctttaaactaaccccgacccgtttaccgtaacggttacccgtaacgggttccgttttacccgggggtttacccccggtaccccgggggttacccggggggacccgtaacccgggggttaaacccccggttcggggttaaccccgttacccccgttccgttaccccgtacccgaaccccggtacccccttaaccccggaaaccccgggtaaacccggggtccccctaacccggggtttccccgttttacccccccggttcccccggttaccggtacccccgtaaccccccgttaccccggttaacccaaaccgggtacccgtcccgttaaccccggggtccgggggttaccggggaccccgtaccggtacccgggcccccgggttacccgggtccggggtacccgtttcccgggcccgggttaacccggtacccggtaaaccggggtttaccccttaaccgggtttaccccggtaacggttaaacccgggttccgggtaaacccggg

SEQ ID NO: 293497 - DNA, 561 bp, Homo sapiens
  misc_feature: GYAE6OF01BUCW2.16.10.A10.1.454.CMB.1.raw
  modified_base (502)..(502): a, c, t, g, unknown or other
  misc_feature (502)..(502): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgaccaaggcaatatgtctttcttggtaccagcaagaagccgaggccacggccctggtggtggtgatataataaagacacacagacggcctcgagggactcccgtgggcgattctcgtggctccgagctcgagggacgacgagtcacgttcgaccagtcggtggtacgtccgaggcgaagaacggacggtagggtacgtaactagttacgtgtcagtctgaccaaacaccactgcgacggcggtcggttcgggacggacgggacacgcgtcgtaccgtcgngtcgtcgacgcccgagccgccgccccgtcggtcccacgtccttccgtccccgtaccccg

SEQ ID NO: 293498 - DNA, 601 bp, Homo sapiens
  misc_feature: GYAE6OF01C3T05.16.10.A10.1.454.CMB.1.raw
  modified_base (329)..(329): a, c, t, g, unknown or other
  misc_feature (329)..(329): n is a, c, g, or t
  modified_base (343)..(343): a, c, t, g, unknown or other
  misc_feature (343)..(343): n is a, c, g, or t
  modified_base (479)..(479): a, c, t, g, unknown or other
  misc_feature (479)..(479): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccgaggggaaggggctgggagtgggtctctaactttttagtggtagtggtggtcacgcctactacgcagagtccgtgaaggccgatcaccatctccagagacacttccgagaacacgctgtatctgcgaatgaacacgcctgagagtcgaggacacggccatatntactgtgacgaagntctggacgcctataccactcagtcagcttcgggtccgacccgtcgggcccgacgggaaccctcggtaccgcccgttcctcctccgctcccgaccacccgacggcccacgttccggtcccctttccccgtcgtcccnccccttcccacccgacgacgcctacccgtcggtcggggtccacggcgccggtcccggtcggtccgtggcccgtcggtacgaacgggtaccttaacgttccggtaacgtacgtacgtaaccgg

SEQ ID NO: 293499 - DNA, 668 bp, Homo sapiens
  misc_feature: GYAE6OF01A4AIK.16.10.A10.1.454.CMB.1.raw
tcagtgtactactccacgaccggtgctcgatttagcgtcgatctcgaggggggtgggtccaggaggcagaactctgggtgtctcaccatggcctggatccctctacttcctccccctcctcactctctgcacaggctctgaggcctcctttgagttgacacagcccaccctcggtgtcagtgtccccaggacagacggccaggatcacctgctcttcagatgcattgccaaggcaatatgtcttctggtaccagcaagagccaggccacggccctgtggtggtgatataataaagacacacagacggccctcgagggctacccgtgggcgtattctcgtggcctcgagctcggacgggacgacgtaggtcacgttcgacctagtcgggtaggacgtcgaggacgaagaacggacgggtaggggtataccgtaagtttacgtgtactaggttcctacggaacccaaaccctaccgtaaccgtacggccgtaacgggtccggggttgggtttacccgggggacggggtaacgggtaacccgaagggtccctacgggtaaccccggttccgtacggccgttaccgacccgggtacccggaacgggtcccgtccccggtaccccccggtcggtaccgtacccctccgttccccggttcccccctaacccccg

SEQ ID NO: 293500 - DNA, 742 bp, Homo sapiens
  misc_feature: GYAE6OF01A85WS.16.10.A10.1.454.CMB.1.raw
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagcccaccctcggtgtccgtggccccaggacagacggccagcataacctgtggggaaacgccttggacgtaaaagtgtgcactggtaccagcagaacgccgaggccacggcccctgtgcgtggtcgtctatgatgatagcgacccggccctcgagggtactcccgtgacgcgtattctctggtcctaccaactcgtacgggaaccgccggccccaccgtacgaccacgtccacggccgaacggggtcgaaacggtccgggggaatcgggacgggtccctaagttacgttacgtcggtaccgtagggttggtgggtaattagggtaagttaggtggaacttcgtaagtttacgttcggttcgttcggaattccgggtacggggaaccgttacggggttacccaccgggtttaccgtacgggtacccgaacccggtaccccgaaaccgggtacccccctaaaacccccggttcgtaccggttacccctaacccgtttcccggttaccccgtttacccccccgtaacccccgtttaccgtaacccgggttaagtttaaccccggttaacccgtacggttaaccgggg

SEQ ID NO: 293501 - DNA, 746 bp, Homo sapiens
  misc_feature: GYAE6OF01DUENJ.16.10.A10.1.454.CMB.1.raw
  modified_base (743)..(743): a, c, t, g, unknown or other
  misc_feature (743)..(743): n is a, c, g, or t
  modified_base (745)..(745): a, c, t, g, unknown or other
  misc_feature (745)..(745): n is a, c, g, or t
tcagtgtactactccacgaccggtgctcgatttagcgtcgatctcaggggtccctgagactctcctgtgcagcctctggattcacccttagcggttatgccatgagctgggtcccgccaggctccgagggaaggggctggagtgggtctctaacttttagtggtagtggtggtcacgcctactacgcagagtccgtggaacgggccgattccaccatctccagacgacacttccgagaaccacgctgtatctgacgaatgaacagcctagagagtcggaggacgacggccatatattactgtagacgaaagacttccgtaggacggacccttaactacccaccgttcacgtccgacgcgttcggttccgacccccggtgggacccgacgggaccctggtaccacccgttcctcctacaccgtccctacccgaaccgaccggaccctacgttcccggttacccctttccccccggtcggaccccttaccccctacccgttacccgaacgccgcccttacccgtccggtcggggacccacggtaccggccccggtacccggtcggggtcctcgggtacccggttacgggtaccgtaaccgggttaacccttacccggtttacccggtaagggttaacccggttaacccgtaccgggttacgggaccggggtacccgggttaccggggtaccgggttaaccggaaccgggggttcccgaggttaaccgtaacggcgactcgaccgngng

SEQ ID NO: 293502 - DNA, 608 bp, Homo sapiens
  misc_feature: GYAE6OF01D6ASJ.16.10.A10.1.454.CMB.1.raw
  modified_base (217)..(217): a, c, t, g, unknown or other
  misc_feature (217)..(217): n is a, c, g, or t
  modified_base (236)..(236): a, c, t, g, unknown or other
  misc_feature (236)..(236): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagcccaccctggtgtcagtcgtccccaggacagacggccaggatcacctgctcttcagntgcattgaccaaggcaatntgtcttcgtggtaccagcaagaacgccaggccgacggccctggtgggtcggtgaacttaataataaacgacacgacgaggacggccctcgagggactcccgtgggctattcgtcgtcggcctccgagctccggagggaccgacgacgtcctacggttcgaccgtagttcgggtggacgtccgaggtcgaaggaacggacggagggtcgaacttagttactgtactagtcgacgaccaactaccacgtgacgaggtcggttggtacgggacggacggaaccagtcgacggtacccgtcgtcggccgtacgaccgtacccgaacggccgtccccggccccgtggtaccctccgttctcccgtcccctaccccgg

SEQ ID NO: 293503 - DNA, 634 bp, Homo sapiens
  misc_feature: GYAE6OF01AQATG.16.10.A10.1.454.CMB.1.raw
  modified_base (204)..(204): a, c, t, g, unknown or other
  misc_feature (204)..(204): n is a, c, g, or t
  modified_base (504)..(504): a, c, t, g, unknown or other
  misc_feature (504)..(504): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccgaggggaaggggctgggagtgggtctctaacttttagnggtagtggtggtcacgcctactacgcagagtccggtgaacgggccgtattcaccatcctccagagacacttccgaagaacacgctgtactcgtagacgaatgaacacgtcctaggaacgaggtcggacggacacggcctaatattattactgtagacgaaagtctcgaggacgtacctaactacccactcacgtcacgtcgttacggttcccgacccggtggggacccgaacgggtaccctcgggtacctaccccgttcttcccgacaccgtccctacccgaaccggaacccgggtcccncgttcccgttcccttccccgacgcccctaccctcccgtaccaagccaccgtccgacggtcgggaccaccgcggcccggccgtggcctcggtccgaggtacgacggacttaccgtacgagtacgtagtacg

SEQ ID NO: 293504 - DNA, 570 bp, Homo sapiens
  misc_feature: GYAE6OF01E5MRW.16.10.A10.1.454.CMB.1.raw
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccgaggcccctgtggtggtgatatataaagacacacagacggccctgaggactcccgtgggcgtattctcgtggcctccagctcgagggacacagtcacgttgacagtcggtggacgtccgaggcaggaagacggagggtgactattactgtcagtctcgacaaacacccatcgcgacggcggtggttcggacggggaacggaccgaaggtccgtacgaccgtccgtgtccggtcacggacccgtaacggcccgtcccggtcccccgttcgggaccctaccgtccttcccggttcccccgtacccccgg

SEQ ID NO: 293505 - DNA, 547 bp, Homo sapiens
  misc_feature: GYAE6OF01EXLHV.16.10.A10.1.454.CMB.1.raw
  modified_base (340)..(340): a, c, t, g, unknown or other
  misc_feature (340)..(340): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagntcctgaggcctataccacctcagtcagctggttccgaccccgtgggccgagggaaccctggtccaccgtctcctcagccctccaccaaggcccatcggtccttccccgtgccaccctccctccaagacgcacctcgtcgggggcacgagccggcccgtcgggctgccctcggtcaacggaccttacttaccgaggttagtacgtacg

SEQ ID NO: 293506 - DNA, 762 bp, Homo sapiens
  misc_feature: GYAE6OF01CKWY4.16.10.A10.1.454.CMB.1.raw
  modified_base (293)..(293): a, c, t, g, unknown or other
  misc_feature (293)..(293): n is a, c, g, or t
tcagtgtactactccacgaccggtgctcgatttagcgtcgatctcagggggtgggtccaggaggcagaactctgggtgtctcaccatggcctggatccctctacttcctccccctcctcactctctgcacaggctctgaggcctcctttgagttgacacagccaccctcggtgtcagtcgtccccaggacagacggccaggatcacctgctcttcagatgcaattgccaaggcaatatgtcttacttggtaccagcaagaacgccaggccacggccctgtggtgtgatataanaaagacgacacgagacggaccgtcgaggactacccggtgggacgtacttccgtcgtcggccttccgacgtctacggaacgggaacacgtagtaccgtacgttacgaccgtagtcgggtaggacggtccgggacgaggaacggtacggtagggtacgaactttagtaccgttaggtacgtagtcctacggaacctaaacccgaacccgtacgtacgaccggtaacggtccggggttacgggttacccggggaacgggtaaccgggggaaaccgtaaccggtacccgggtaacccggttaaccccgggttacccggttaccggtaaccgggttacccggaaaccccgggaccccggtaaacccggggtaccccgttaccccccgggtaccccccccggtttacgggtacccccgttaccgttacccccggttaaccccgtttcccccccgtaaccccgtttaacccccggg

SEQ ID NO: 293507 - DNA, 590 bp, Homo sapiens
  misc_feature: GYAE6OF01ES6OP.16.10.A10.1.454.CMB.1.raw
  modified_base (421)..(421): a, c, t, g, unknown or other
  misc_feature (421)..(421): n is a, c, g, or t
  modified_base (474)..(474): a, c, t, g, unknown or other
  misc_feature (474)..(474): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccaggggaaggggctggagtgggtcgcagccattagtggtattcgtgatgccacatactacgcagactccgtggacggggccgttcaccatctccagcgactccttccgaggacgcacgtttgtatctgacaaatgaacacgcctggagagtcgacggacgaccggaccctattacttactgtagacgaaagataagtagtttcgggaccgtatgtactagtgagtagcgtaggggaccaagggacaagtcggtacnccgtcttcttacacgccaccaccgacgggtccctagtcccgtcccttccccgngccctaccctccgtaccaagccgcctaccgtcggtcgggaccacggccgccggtcccgtgggccgtcggtccgtcgggtacgtaacggtccttaccgttacgacgtagtcgtacgg

SEQ ID NO: 293508 - DNA, 916 bp, Homo sapiens
  misc_feature: GYAE6OF01BWPDN.16.10.A10.1.454.CMB.1.raw
tcagtgtactactccacgaccggtgctcgatttagcgtcgatctcagggtcttcgtggctcacgtccaccaccacgcatgtgacctcaggggtccctgagactctcctgtgcagcctctggattccacccttagcggttatgccatgagctgggtccgccaggctccgaaggggaggggctgggagtgggtctctaacttttaggtggtagtggtggtcacgcctactacgcagtagtccgtaggaacgggccattccaccatcctaccagacgacctaccttaccggaagaaaccaccggtcttaggttaacttccgtaggaccgtaaaagtcggaaaactacggtcccgttagggacgggtaccgggtaaacgggaccgaaccggtaccgaattaagttacgtttaactaggtacggtaacggaaaacgtacgtactacgggtacgggtacccttacctaaaccccgtacccgttaccaacggtaccgtaacgtccgttacggggttacccccggtaccccggttccgggggacccggtaacccggggaccccggttaaccgggttaccccgttacccggtccctttccgacctacccgggtacccccttacccgaaaccccggaaccggggtaccccctaaccggttccccgggtttacccgtttccccccgtaccggtccccgtaaccccccgttaccccgtaacccgaaaccgggtaacccgtcccggttaaccccgtaaccccgggggttcggggaaccccgtacggtaccccgggaccggggttccccccggttaccggggtcccgttacccggtccccggttagggtaaccccgttaaaccggggacccgttttaacccgttaaccgggttaacccgtaaacggttccccgggtaacggtacccgggg

SEQ ID NO: 293509 - DNA, 736 bp, Homo sapiens
  misc_feature: GYAE6OF01ALMVI.16.10.A10.1.454.CMB.1.raw
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagcccaccctcggtgtcagtcgtccccaggacagacggccaggatccacctgctcttcagatgcattgaccaaggcaattatgtctttacgtggtacccagtacagaacgccgacggcccgacggcccctggtgggtcggtagtaacgttagtaagtaaacgaacctaacgaccgaggacggccctacggacgggtactcccgtagggccttagttactcgtacgggtccctccgaacgtccgtaccgaacggggaccgtaacgtacgtaccggtacgtttacggaaccccgtaaggttcccggggttagggtaccgtacccgaggtaccgaagggtaacgaacggggtagggtacggtacttaacgttactacggttcgtaacgttacccgttacaaacctacccgacgtcggaccgtaaggtccggtttaggccggggtacggacggggtaccaacggtccgtaccgacccgtacgtccgtacggtcctacggaccccgacggtccctaccccggtacccccgtccggttacctaacccgttcccgttacccggtcccccttccccggttacccgg

SEQ ID NO: 293510 - DNA, 659 bp, Homo sapiens
  misc_feature: GYAE6OF01C0AEC.16.10.A10.1.454.CMB.1.raw
  modified_base (234)..(234): a, c, t, g, unknown or other
  misc_feature (234)..(234): n is a, c, g, or t
  modified_base (302)..(302): a, c, t, g, unknown or other
  misc_feature (302)..(302): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctctgaggccttcctttgagttgacacagccaccctggtgtcagtcgtccccaggacagacggccaggatcactgctctcagatgctatcgccaaggcaatntgtcttcgttggaccagcagaagccaggccacggccctggtcggtggtagataataataaagacacanaggacgcctgagggtactccgtgggcgtattctcgtcggctccagcgtcgagggtacacgtacgtcgtacgttcgaaccgtagttccgggtaggacgtaccgaaggggacgaaggaaacgggtaaccgggaagggttacggaaccgttaacgtttacgtaggtacgtaaggttcctagtaaccgaaaccacctacgtcgacgtaggtccggttggtccgggacgggaacggtaaccgaggtaccgtacgggtacccggtcgtacggaccgtaccgaccggacccggtacggcccggttacccgccccccggttaggtacccctaccgttcccggttcccgttcccccggtaccccgg

SEQ ID NO: 293511 - DNA, 601 bp, Homo sapiens
  misc_feature: GYAE6OF01CG0MT.16.10.A10.1.454.CMB.1.raw
  modified_base (275)..(275): a, c, t, g, unknown or other
  misc_feature (275)..(275): n is a, c, g, or t
  modified_base (283)..(283): a, c, t, g, unknown or other
  misc_feature (283)..(283): n is a, c, g, or t
  modified_base (296)..(296): a, c, t, g, unknown or other
  misc_feature (296)..(296): n is a, c, g, or t
  modified_base (334)..(334): a, c, t, g, unknown or other
  misc_feature (334)..(334): n is a, c, g, or t
  modified_base (344)..(344): a, c, t, g, unknown or other
  misc_feature (344)..(344): n is a, c, g, or t
  modified_base (363)..(363): a, c, t, g, unknown or other
  misc_feature (363)..(363): n is a, c, g, or t
  modified_base (407)..(407): a, c, t, g, unknown or other
  misc_feature (407)..(407): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccattcaccatctccagagacacttccgagaacncgctgtanctgcgaatgaacngcctgagagtcgaggaccacggccaatatattactgtnacgaaattcncctgacgctatacccactnagtcagtctggttccacccgtgggccgacgggacccgtggtccnccgtcctcctcgcgcctccaccgacggccacgtccggtcccttcccccgtcggcccacccctcccgtacccaacgaccgcctacccgtccggtcggggccaccgacggcccgggtcccgtcggggaccctcgggtcccgtacggtaccgtaacggtaccttacccggttaccgaacggttacgtaccgtaacgg

SEQ ID NO: 293512 - DNA, 749 bp, Homo sapiens
  misc_feature: GYAE6OF01CMHPM.16.10.A10.1.454.CMB.1.raw
tcagtgtactactccacgaccggtgctcgatttagcgtcgatctcgaggggggtgggtccagggaggcagaactctgggtgtctcaccatggcctggactccctctacttcctccccctcctcactctctgcacaggctctgaggccttccttttggagttgacacacgcccaccctcggtgtcaggtcgtcccgagggacaggaccggccaggactcacctgcttcttcagatgcattgaccaaggcaatagtgtcttcgttcgggaaccagaccgaagaacggaccgaacgggtaccgaacggtcccgtgggttaggtagggtagaagttaattaaacgaaaacggaccaacgaacgaacgggtacggaccccgtaggaacggggtacctccccggtaggggtcggtaactttccgtcgttacggacctccgtaaggtccctacggaacggggtaaccgaccgtaaggtccgttaaccggtacggtaaccgtacggttcgggtacgggtacgtaccggacgggacgaaggaacgaacgggagggtagaacttagttactgactagtctagacaaacgccaacgtgaccgtaggtcgggtacggtcgggaaccgggacgggtaaccgaggtccgtcgggtaaccgtccggtacgtccggtaacacccggggtaaacccggtcgaccccgttccggaccccccgtacgggttaccctacccgtccgttccccgggtccccgttaccccg

SEQ ID NO: 293513 - DNA, 616 bp, Homo sapiens
  misc_feature: GYAE6OF01CARTE.16.10.A10.1.454.CMB.1.raw
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggccctgtggtggtgatatataaagacacacagacggccctgaggggactccccgtggggacactttcctcgtcggcttccaggtctcgaaggggaccgaacgtacgtcacggtttacgaacctagtcgggtgggacgtccgagggccaagggaacgacggtaagggtgtaacttattaacgtgttaccgaggttccaggaccaaaacgtcccaactaggccaaggccgggttggttccgggacgggacggtaaccgaacgccgtaggacccgtcgacggtccgtaccgacgccccgaaggccctaccggccccccgttggacctaccgtccgttccgttccccctaccccg

SEQ ID NO: 293514 - DNA, 658 bp, Homo sapiens
  misc_feature: GYAE6OF01CZSYO.16.10.A10.1.454.CMB.1.raw
  modified_base (206)..(206): a, c, t, g, unknown or other
  misc_feature (206)..(206): n is a, c, g, or t
  modified_base (310)..(310): a, c, t, g, unknown or other
  misc_feature (310)..(310): n is a, c, g, or t
  modified_base (339)..(339): a, c, t, g, unknown or other
  misc_feature (339)..(339): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattccacccttagcggttatgccatgagcgtgggtccgccaggctccgaggggaaggggctggagtgggtctctaacttttaggnggtagtggtgtcacgcctactacgcagtagtccgtgaagggccgattccaccatctccgagacgactacttccgaagaaccacgtctgtatctgcgaatgaacngctgagagcgagacacgacatatagttcngtgacgaagtactcgtgacgacctaactaccacctcagtacacgtccgttcggtacccgccccggtcgggacccgacggtacccgtcggtaccctacccgtccgtcctaccgaccgccctacccgaaccgtaaccgggccctacgttcccggttaccccttcccccgtcggtccccaccccttccgtacccgaacgacgccctacccgtcggcggggtaccgacgacggtcccggtcccggtcgggtcctaccggtccgttacggtaccgtaacggttacccttaacccggttaccgtacggtaaccgtaccgtaccgg

SEQ ID NO: 293515 - DNA, 692 bp, Homo sapiens
  misc_feature: GYAE6OF01CMCOP.16.10.A10.1.454.CMB.1.raw
  modified_base (334)..(334): a, c, t, g, unknown or other
  misc_feature (334)..(334): n is a, c, g, or t
  modified_base (354)..(354): a, c, t, g, unknown or other
  misc_feature (354)..(354): n is a, c, g, or t
  modified_base (358)..(358): a, c, t, g, unknown or other
  misc_feature (358)..(358): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagcccaccctcggtgtcaggtcgtccccaggacaggacggccaggatcacctgctcttcagatgcattgaccgaaaggcaatatgccttcttggtaccagacgagaacgccaggccgacggcccgtgtggtggtagataataagtaaagacacacgagacgccctgaggtctccgnggcgattctcgtggctacgngtcncggaggacacgacgtcacgttacgacgtacgttcggtcggacgtaccggaagggacgtaaggaacggaaccgggtaggggttacgtaacgttaaagtttaccgtggtaccgtagttcccgtagaaccgaaaacctacccgaacgtacgtaccgtacgggtaccgggttcgggttaccgggaccggggtaacggaacccgaaggtcccgtacggacccgttacccggttcggacccgtacccggtacggaacccccggacggttaccccgtccccggtaccccccgttccggtacccttaccgttaccccgttccggtcccccccgttaaccccg

SEQ ID NO: 293516 - DNA, 624 bp, Homo sapiens
  misc_feature: GYAE6OF01AQD7P.16.10.A10.1.454.CMB.1.raw
  modified_base (355)..(355): a, c, t, g, unknown or other
  misc_feature (355)..(355): n is a, c, g, or t
tcagtgtactactccacgaccggtgctcgatttagcgtcgatctcaagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgtcttctggtaccagcaagaacgccaggccacggccctggtggtggtgatataataaagacacaacagacgccctacgagggactcccgtgggcgtacttctcgtcggcctaccgtacncgtcgaaggggacaacgacggtctacgttcgaccgagttacgggtggtacgtccgacggagaacggaacggacgggagggtacgaacttattaaccgtgtacgtacgtccgtagaccaaacaccgtacgtcgaccgtaggcgggttacggttacgggacgggaacgggaccacggtcgtccggtacctaccgtcggacgtccgacgacccgaggtcccgtacccgtcccccggtcgtaccctacccgttcgttcccgtccccgtccccg

SEQ ID NO: 293517 - DNA, 792 bp, Homo sapiens
  misc_feature: GYAE6OF01D4S6E.16.10.A10.1.454.CMB.1.raw
tcagtgtactactccacgaccggtgctcgatttagcgtcgatctcagggggtgggtccaggaggcagaactctgggtgtctcaccatggcctggatccctctacttctccccctcctcactctctgcacaggctctgaggccttccttttgagttgacacacgcccaccctcggtgtcacgtcgtcccccaggacaggaccggccaaggatccacctgcttcttcaagatgactatcgaccgaaggacaagtatgtacttcgtcgtaccagacgagaacgaccgacggcccgacggtcccgtggtggtggtagtattaataaagtaaacgaccaacgacgaacggaccggcccgtacggaacggtacctacccggtgggtaccgttacttccgtccgtacggtcctaccgtacgtacctacggaacggggtaaccgaacgtacggtcgtacgttacgtaccgtacgttacgggtaaggtaccggtaccgaacgggacggaaacggtaagggtacgggtaagggttacgtaacgttaacgtttacgtacgtacgtacggttaccaacggtaaacccgtaaaccgaacccgtaccgacggtaccgtacgggtaccgggttacggggttaacccggggtacgggaaccgggtaacggaacggttccggtaccgggtacccgtcccggtacggcccggtaaaccgacccgggtacccgaccggtcccgttacccccggtacccccgttaccggtaccctacccgttacccgttcccgttaccccccgtaaccccgg

SEQ ID NO: 293518 - DNA, 708 bp, Homo sapiens
  misc_feature: GYAE6OF01DDNY2.16.10.A10.1.454.CMB.1.raw
  modified_base (203)..(203): a, c, t, g, unknown or other
  misc_feature (203)..(203): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcaccttagcggttatgccatgagctgggtccgccaggctccgaggggaaggggctggagtgggtctctaacttttaggnggtagtggtggtcacgcctactacgcagagtccgtgaagggccattcacatctccagagactacgttccgaagaaccacgctgtactctgacgaatcgaaacacgcctaggagaggtcgaggacacggaccataactattaactgtgacgaaagctccgtagacgtcctaactaccacctcagtacagtcgttcggtacccgacccgtcggggacccgacgggtaaccctcggtacctacccgttcctccctacaccgtcccctacccgaaccgaaccgggcccctacgttcccggttccccgtttcccccgtcggacccctaccccgttcccgacccgtaaaggccgtaccctacccggttaccggtacgggggaccctaaccggaccggccccgggtccccggtcgggggtcccgttccggtcccgttacgggtaaccgtaaacccggggttaccctttaaccgtttacccgggtaacgttaaccggttacccgtaaaccggg

SEQ ID NO: 293519 - DNA, 593 bp, Homo sapiens
  misc_feature: GYAE6OF01ESKVU.16.10.A10.1.454.CMB.1.raw
  modified_base (237)..(237): a, c, t, g, unknown or other
  misc_feature (237)..(237): n is a, c, g, or t
  modified_base (255)..(255): a, c, t, g, unknown or other
  misc_feature (255)..(255): n is a, c, g, or t
  modified_base (303)..(303): a, c, t, g, unknown or other
  misc_feature (303)..(303): n is a, c, g, or t
  modified_base (326)..(326): a, c, t, g, unknown or other
  misc_feature (326)..(326): n is a, c, g, or t
  modified_base (337)..(337): a, c, t, g, unknown or other
  misc_feature (337)..(337): n is a, c, g, or t
  modified_base (341)..(341): a, c, t, g, unknown or other
  misc_feature (341)..(341): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccgaggggaaggggctggagtgggtctctaacttttgtggtagtggtggtcacgcctactacgcagagtccgngaaggccattcaccatcncagagacacttccgagaacacgctgtatctgcaatgaacagcctgagngtcgagacacggcatatattacngtgacgaaagntccngacgcctataccacctacagtcaggtctcgggttcccgaccccggtcggggacccgacgggaacccgtcggtacctaccgtcctcctcacgcctcccaccgaacggccctacgtccgtcccttccccgtcgccctaccctccctccgaacgcgacctaccgtccgtcggggccaccgacgccgggtcccgtcgggcctcggccgtcgggtacgaacggtaccttaccgtaccggtaacgttagtacgtacgg

SEQ ID NO: 293520 - DNA, 817 bp, Homo sapiens
  misc_feature: GYAE6OF01DOXRN.16.10.A10.1.454.CMB.1.raw
tcagtgtactactccacgaccggtgctcgatttagcgtcgatctcagggggtgggtccaggaggcagaactctgggtgtctcaccatggcctggatccctctacttcctccccctcctcactctctgcacaggctctggacggccttcgtttgagttcgacacgacgcccacccgtcggtgtcagtcgtccccgaggacaggacggccaggactcacctgcttctcagatgactagttcgaccgaaggactaattacgtggttcctttcggttacggaccgagacgaacgaacgccgaacggccgacggtcccgtggtgggtacggtgaattaagtaagtaaacgactaacgaacgacggaccggacccgttacggaacggggtaccttccccggtaggggtaccgttaacttcccggtcgttccgggtaccctacccgaggtcccggtacggaacggggtaccgaaccgtacggtacgtaaccggttcggaaccgtacgggttccgggtacgggtaccgaggggtacaaagggtaacggacgggtaagggtacgtaacgttaacgttcgacgtacgtcgtacgtacgaaccaaacccgtctaaggtccgacggtacgggtcgggtaccgggtaccggggaacgggtaaccgggaaaccgttacggtcccggtaaccggttcccgggtcgttaccgggtaaccggtccggtaaccccggtaccggtaacgggtccccgttccccggtacccccggttacgggtaccccttcccggttaccccgtccccgtttaacccccgtccgtttaaccccgggg

SEQ ID NO: 293521 - DNA, 604 bp, Homo sapiens
  misc_feature: GYAE6OF01EEYYP.16.10.A10.1.454.CMB.1.raw
tcagtgtactactccacgaccggtgctcgattttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgtcttcttggtaccagcaagaacgccaggccacggccctgtggtggtgatatataaagacacacgagacggccctcgagggactcccgtgggccgtattctcgtggctccgagctacgagggacgacgagtcacgttacgaccagtcgggtaggacgtccgaggacaaggaacgacggaggtagacttagttactgtcagtctacgaccaaacaccacgtcgcaacggtcggttaggttccgggacgggtaacgggaccaacggtcgtaccggaccgtcccgtaggtccgtacgaccgacccggaggtcccgtcccggtaccccccgttcggtaccctaccgttccgttcccggttcccccgtccccg

SEQ ID NO: 293522 - DNA, 711 bp, Homo sapiens
  misc_feature: GYAE6OF01EMNVR.16.10.A10.1.454.CMB.1.raw
  modified_base (406)..(406): a, c, t, g, unknown or other
  misc_feature (406)..(406): n is a, c, g, or t
  modified_base (641)..(641): a, c, t, g, unknown or other
  misc_feature (641)..(641): n is a, c, g, or t
tcagtgtactactccacgaccggtgctcgatttagcgtcgatctcaggggggtgggtccaggaggcagaactctgggtgtctcaccatggcctggatccctctacttcctcccctcctcactctctgcacaggctctgacggccttcctttgagttgacacacgccaccgtcggtgtcagtcgtcccaggacgacgacggaccaggactccacctgctcttcagatcgctagttcgaccgaaggactaatatcgtctttcgttacggtaccagacaacgaacgaccgaacggccgacggcccgttggtacggttggtacgtaattaagtaagtaaaacgacaacacgacggaccggcctacggacggtactccggtagggacgtacgttccgtacgtccggtaccncgacgtctacggacggacgtacgcggtaccgtacgtacggacctaggtacggtacggacgtacggacggtaacaagggtaacggacgggtagggtacgtaacgttattacgttagacgtagtaccgtaagaaccctaaacgaccacgtacgaacgtcgggtaccgggtacggttccgggaacgggtaaccgaccggtaacgtccgggttacgaccgttcgccggtacgtacccgnggtaacccggcgtacccgttacccggcccgttaccggaccttaccgtcccgttacccgtcccgttacccg

SEQ ID NO: 293523 - DNA, 621 bp, Homo sapiens
  misc_feature: GYAE6OF01DBD2G.16.10.A10.1.454.CMB.1.raw
  modified_base (202)..(202): a, c, t, g, unknown or other
  misc_feature (202)..(202): n is a, c, g, or t
  modified_base (241)..(241): a, c, t, g, unknown or other
  misc_feature (241)..(241): n is a, c, g, or t
  modified_base (453)..(453): a, c, t, g, unknown or other
  misc_feature (453)..(453): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagcccaccctcggtgtcagtcgtccccaggacagacggccaggntcacctgctcttcagatcgctattcgaccaaggcaaatntgtcttcttaggtaccagcgaagaacggccacggcccgacggtcccgtggtcggtggtagataataataaagacacacgagacggccctgaggactcccgtggacattctcgtgcctcgcgctacgacgggacacgagtaccgacgttacgaccgtagtcgggacggacgtaccgaggcaagggaagacgggaggtgtaacgtattaccgtntacgtagttccgacgaaccaaacgacccagtcgcgacggtcggtcggtgggaccggacggacacggcgtacgtaccgtccgcggtccgcgtaacgccggtaacggtcccgtaccccggtcccccgttccgtacctacccgttcccgttcccgttcccccgtaccccgg

SEQ ID NO: 293524 - DNA, 701 bp, Homo sapiens
  misc_feature: GYAE6OF01B7C31.16.10.A10.1.454.CMB.1.raw
  modified_base (176)..(176): a, c, t, g, unknown or other
  misc_feature (176)..(176): n is a, c, g, or t
  modified_base (206)..(206): a, c, t, g, unknown or other
  misc_feature (206)..(206): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctctgacggccttcctttgagttgacacacgcccaccctcggtntcagtcgtccccaaggacagacggccaggntcacctgctcttcagatgcattgccaaggcaatatcgtctttcgttacggtaaccagccaaggaacgcccgacggcccgacggtccccgtggttgggtcggtagaactaagttaaagtaaaacggaacctaaccgaaccgacgggacgtacccctacggaacgggtacttccccggtagggccgtacgtttccgtcgtcggaccttccgacgccgttacggaacgggaccgacacggtctaccggttacgaacccgtaggtcgggttacgggtacgtcccgaagggtacgaaggaacggtacggtagggtaccgatttaacgtttacgtgtaccgtagttacgtacgaaccaaaccgacctaacgtacggccgtacggtcggtcgggttccgggacgggacgaccgtaacgccgtacggcccgtccgtcgcgtccgacgtcccggacggtccgtacccgtcccgtacgtccacttcgtccccgtcccgtaccccg

SEQ ID NO: 293525 - DNA, 594 bp, Homo sapiens
  misc_feature: GYAE6OF01DI6DS.16.10.A10.1.454.CMB.1.raw
  modified_base (263)..(263): a, c, t, g, unknown or other
  misc_feature (263)..(263): n is a, c, g, or t
  modified_base (445)..(445): a, c, t, g, unknown or other
  misc_feature (445)..(445): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcaccctttagcggttatgccatgagctgggtccgccaggcctccgagggaaggggctggagtgggtctctaattttagtggtagtggtgtcacgcctactacgcagagtccgtggaagggccattccaccatctccagngacaccttccgagaacacgtctgtactcgtgacgaatgaaacacgcctggagagtcggaggacgacggaccatatattactgtgacgaaagctctaggacgtcctaactacccacctcagtccagtcgttcgggttaccgacccgtcgggccgacgggaccgtcggtctaccgtcctcctcncgcccgtccaccgacggccctacgtccgtcccttccccgtcggccctaccctccctaccaacgacgcctaccgtcggtcggggccacgccgccggccgtcggtctcggcgtacggtcgaacggtcctactacggacgtacgtcgtacgg

SEQ ID NO: 293526 - DNA, 637 bp, Homo sapiens
  misc_feature: GYAE6OF01EQDW7.16.10.A10.1.454.CMB.1.raw
  modified_base (380)..(380): a, c, t, g, unknown or other
  misc_feature (380)..(380): n is a, c, g, or t
  modified_base (628)..(628): a, c, t, g, unknown or other
  misc_feature (628)..(628): n is a, c, g, or t
  modified_base (631)..(631): a, c, t, g, unknown or other
  misc_feature (631)..(631): n is a, c, g, or t
  modified_base (633)..(634): a, c, t, g, unknown or other
  misc_feature (633)..(634): n is a, c, g, or t
  modified_base (636)..(636): a, c, t, g, unknown or other
  misc_feature (636)..(636): n is a, c, g, or t
tcagtgtactactccacgaccggtgctcgatttagcgtcgatctcaggggtccctgagactctcctgtgcagcctctggattcacccttagcggttatgccatgagctgggtcccgccaggctccgagggaaggggctggagtgggtctcaacttttagtggtagtggtggtcacgcctactacgcagagtccgtgaagggccgattcaccatctccagagacacttccgaagaacacgctgtatctgacgaatgaacagcctgagagtcgaggacacggccatatattactgtgacgaaagatcctgacggcctatacccactcagtcagcgtcggttccgacccgtcgggccaggggtacccctggtcccaccgttcncctcacgccctcccaaccgaacgggcccacgttccggtcccttcccccgtcgtccctacccctccctaccgaacgacgcccacccttcggtacgggggccgaaccgccggccggtccccgtcggggtccgtcggtcccgttcgggtaccgtaaacgggtacccttaaccgtttacccggaacgttaacgtaacccgtcgtacgggacgggtcgggtacggtacgggacggaacggccgacaagtacgngangnngng

SEQ ID NO: 293527 - DNA, 730 bp, Homo sapiens
  misc_feature: GYAE6OF01CEFAO.16.10.A10.1.454.CMB.1.raw
  modified_base (209)..(209): a, c, t, g, unknown or other
  misc_feature (209)..(209): n is a, c, g, or t
  modified_base (291)..(291): a, c, t, g, unknown or other
  misc_feature (291)..(291): n is a, c, g, or t
  modified_base (320)..(320): a, c, t, g, unknown or other
  misc_feature (320)..(320): n is a, c, g, or t
  modified_base (405)..(405): a, c, t, g, unknown or other
  misc_feature (405)..(405): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcaccttagcggttatgccatgagcgtgggtcccgccaggcctccgaaggggaggggctgggagtgggtctactaacgttttaggnggtagtggtggtccacgtcctactacgcaaggcgtccgtaggaacgggcctattccacatctaccagacgacacttccgaanaaccacgctagtatcgtgacgaatgaacncgcctagaggacgtcggaacggacacggctaatatattacgtgtacgaacgaaagtctccgtaggacgtcctaactacccacctnaagtcagtcgtcggtccgacccgtcgggaccgacgggtaccgtcggtaccaccgtcctccgtacaccgtccctacccgaaccgtaacccggtccctaccgttcccggttcccttacccccgtcggtaccccttaccccgtaccccgtaaccgtaaccggaccgtcccgtaacccggttcgggtaaccggggcccgtaccggaccgggtccccgggtacccggttccggggtaccgttcccgggtccggttaccgggtaaccgtaacccgggttaacccgtttaaccggttacccgggtaaagttaccggttaaccggtaaccggg

SEQ ID NO: 293528 - DNA, 624 bp, Homo sapiens
  misc_feature: GYAE6OF01BNH7Z.16.10.A10.1.454.CMB.1.raw
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagcccaccctcggtgtcagtcgtccccaggacagacggccaggatcacctgctcttcagatgctattgaccaaggcaatatgtctttcgttaggtaccagcagaacgccgacggccacggccctggtggtggtagatatataaagacacacagacgccctagacggactccgtgggcgtacttcgtcgtcgtcctcgagctcgagggaccacgtagtccgacgttacgacctagtcggtggacgtaccgaggcgaaggaacggacggtaggtacgaacgttattacgtgtacgtagtctagaccaaacaccgacgtcgacgacggtcggtacgggttccggacgggaccgggacgacgtacgtaccggaccgttccgtacgccgtaccgaccggacccggtaacggcccttccccggcccccgttcggtacctacccgttcccgttcccgttcccccgtacccccg

SEQ ID NO: 293529 - DNA, 721 bp, Homo sapiens
  misc_feature: GYAE6OF01B55TA.16.10.A10.1.454.CMB.1.raw
  modified_base (224)..(224): a, c, t, g, unknown or other
  misc_feature (224)..(224): n is a, c, g, or t
  modified_base (245)..(245): a, c, t, g, unknown or other
  misc_feature (245)..(245): n is a, c, g, or t
tcagtgtactactccacgaccggtgctcgatttagcgtcgatctcagggggtgggtccaggaggcagaactctgggtgtctcaccatggcctggatccctctacttcctccccctcctcactctctgcacaggctctgacggccttccttttgagttgacacacgcccaccctggtgtccagtcgtccccaggaccaggaccggccaggactcacctgctcttnagatgcatcgaccaagcaatntcgcttcgttaggaccacgcaagaacgccacggccgacggtcccgtggtgggtggtagataataagtaaacgacacacagacgcctacgaggtactcccgtgggactacgttcgtacgtcggtactacgacggtctacggaacgggactacgacgtactaaccgttacgaccgtaggtcgggtacggacgtaccgacggaccgaagggaacggtacgggtaggtacgtaacgttaacgttacgtcgtacgtacgttcgaccgaaaccaaaccgtaccgtaacgtcggacgtacgggtccggtacgggttaccgggaaccggtaacgggaaccctaacggtccgtaaacccggtcccggttaccgtacgggtacccggttaaccgacccggtccccggtaaacggtcccgtaccccgtacccccggttcggtacccttacccggttcccgttccccggttcccccggttaaccccgg

SEQ ID NO: 293530 - DNA, 973 bp, Homo sapiens
  misc_feature: GYAE6OF01DWX7F.16.10.A10.1.454.CMB.1.raw
tcagtgtactactccacgaccggtgctcgatttagcgtcgatctcagggggtgggtccaggaggcagaactctgggtgtctcaccatggcctggatccctctacttcctccccctcctcactctctgcacaggctctgaggccctcctttgagttgacacagcccaccctcggtcgtcagtgtccccaggacagacggccaggactccacctgcttcttacgagtatgctagttcgcccgaaaggcaaattagtcgtcctttacgttacggtaccagacgaacgaacgacccgaacggaccgacggtccccttgggtcggtgggtagaataacgtaaataaacggaaccacaacgaacggaccggtaccctacggaacggactcccgtggtacgtacttcgtcgtcggtcctaccgacgtccgttacggaacgggaacggtaaccgacggttaaccgtaaccggtttacggaacccgttacggtaccggggttacgggtaaccggttacccggaacgggaaccgttaaacggggaaacgggtaaccggggtaaaggggttacgtaacgttaacgttttaaacggtcgtaaccgtaaacgttccgttaacggaaacccgtaaaaccctaaccgtaaccgttacgggaaccgtttaacggggtacccgggtttacggggtttaacccggggtaacccgggggtaacgggggaaaccccggttaacggggtaaaccccgttccccgggggttaaaccccgggttttccccccgttaacgggggtaaccccggtttaacccccgggtaaaccccgggaaaccccgggtaaaacccggggttccccccgtttaccccccggggaaccccccccccggggttttaacccggttttaacccccgggttaaaccccccggtttttacccccgggtttcccccccgggttttaaccccccccggttttaacccccccccggg

SEQ ID NO: 293531 - DNA, 790 bp, Homo sapiens
  misc_feature: GYAE6OF01BTDIU.16.10.A10.1.454.CMB.1.raw
  modified_base (157)..(157): a, c, t, g, unknown or other
  misc_feature (157)..(157): n is a, c, g, or t
  modified_base (201)..(201): a, c, t, g, unknown or other
  misc_feature (201)..(201): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccnccaggctcagggaagggctggagtgggtctctaacgtttttagnggtagtgggtggtcacgcctactacgcagagtccgtggaagggccgattcaccatctccagagacacttccgagaacacgctgtatctgcgaatgaacagcctgagagtcgaggacacggcatatattactgtagacgaaagctccgtagacggtcctaaagtacccacccttacgtaacggtcctaaggccgttcggggtttacccgacccccggttcgggggaccccgaacggggtaaacccccgttcgggtaccccgtacccgggttacccttaccccgtaccgaccgtacccgttacccccgaacccggaaacccgggggttccccctaaccggtttaccccggggtttaccccttttaccccccccggttacgggtacccctaaccccccttacccccggttaaccccgaaaccgggtaccgaacccgtaaccccggttcccgggggttaccgggggacctaacggacccgggtcccgggtcccggtcggggtcgtacccgggttccgggtaccgggttaaccggaaaccgggttaccgttaacccggttaccggtaaccgggttaacgtaacccggtaaccgg

SEQ ID NO: 293532 - DNA, 756 bp, Homo sapiens
  misc_feature: GYAE6OF01BKCWS.16.10.A10.1.454.CMB.1.raw
tcagtgtactactccacgaccggtgctcgatttagcgtcgatctcgaggggggtgggtccaggaggcagaactctgggtgtctcaccatggcctggactccctctacttcctcccctcctcactctctgcacaggctctggacggtccttcctttgtagttcgacacacgccctacccgtcggtgtctagtccgtccccgaggacgaggaccggaccgaggactccaccgtcgccttacttacagtatcgactagttcgaccgaaggactaattatcgttctttacgttacggtaccagacgaacggacgccgacggacccgtaccggtcccgttggtgggtacggtagtaagtaataaacgtaaacgaccaacgaacggaacggtaccggtacccgtacggacgggttaccttcccggtcgggtacgttacgtttccgtccggtcggtacctaccgacgtacgtacggacgggaccgaacgtacgtacgtacgtacgacgtcggtacgggtacggtacgtaccggaggacgtaagggaacggtaagggtacgggtaaccgttaacgttaagttacgttcgtacgtaggtacctacgtaaccaaacctccgtacgtcggacgtacgggtaccgggtacggggtaccgggacgggaacgaaccggtagtccgtaccgaccggtcgccgtacggccgacggacccgtcgtcccgtaccgtccccgtcgtaccctacgttcccttcccgtcccgtaccg

SEQ ID NO: 293533 - DNA, 681 bp, Homo sapiens
  misc_feature: GYAE6OF01BUJX2.16.10.A10.1.454.CMB.1.raw
tcagtgtactactccacgaccggtgctcgatttagcgtcgatctcagggggtgggtccaggaggcagaactctgggtgtctcaccatggcctggatccctctacttctcccctctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggccctgtcggtggtgatatataaagacacacagacggccctgagggactcccgtgggctacttctcgtcggctaccgagtccgtcgacgggaccgtacagttccaaccggtttgaacctagtccgggtaggacgttccgaagggaccaagggaacggaacgggagggtacgaaccgttaagttaaccgtggtaccgtaaggttcctacggaacccaaaactacccctaacgtgaccgtaacggggtcgggttacgggttaccgggaccgggttaaccggggaaccctaaacgggtcctacgggtaccccggttccgtacgggccggttacccgacgtaccccggaaacgggtcccctaccgggacccccccgttgggtacccctaccgttcccgtttccgggtccccccgttaccccg

SEQ ID NO: 293534 - DNA, 651 bp, Homo sapiens
  misc_feature: GYAE6OF01BFUJ3.16.10.A10.1.454.CMB.1.raw
  modified_base (345)..(345): a, c, t, g, unknown or other
  misc_feature (345)..(345): n is a, c, g, or t
tcagtgtactactccacgaccggtgctcgatttagcgtcgatctcagggggtgggtccaggaggcagaactctgggtgtctcaccatggcctggatccctctacttcctccccctcctcactctctgcacaggctctgaggccttcctttgagttgacacagcccacccgtcggtgtcagtcgtccccaggacagacggccaggatcacctgctcttcagatcgcagttcgaccgaaggacaatagtcgctttcgttacggtaccagcgaagaacgccgacggccacggtccctggtcggtggtgatataataacgacacgacgagacgccctgacggactccgnggctacttctacgtcggacctcgacgtcgtacggaacgggacgtacgacgtaccgtacgttacgaccgtagtcgggtacggcgtacgacggtacgaaggaacggacgggtaggtacgtaacgttaacgttacgtacgtcgtaacggttctacgaaccgtaaaccaccgtacgtacggcgtaacgggtcggttagggtaccgggacgggtacgaacgtacgaccgtacgcccgtcgtacggcgacgacgaccggcgtaccgtcccgtccccgttcggacctaccgtccgtccgttccccgtaccccg

SEQ ID NO: 293535 - DNA, 802 bp, Homo sapiens
  misc_feature: GYAE6OF01BPY07.16.10.A10.1.454.CMB.1.raw
  modified_base (239)..(239): a, c, t, g, unknown or other
  misc_feature (239)..(239): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattccacccttagcggttatgccatgagctgggtccgccaggctccgaggggaaggggctgggagtgggtctctaacttttgtggtagtggtggtcacgcctactacgcagcgtccgnggaagggccgattccaccatctaccagacgacacttccgaagaacacgctgtatctgacgaatagaacacgcctaggaggtacgtcggaacggaccaccgggacctaagttagttaactttaacgtggtacggtaacggaaaacgtacgttaccgtacgggaacggtacccttaactaacccctaccgtacgtacgttccaacggttccgttcgggttaccccggtaccccgggtcggggacccggtaccggggtaaccccgttcggtacccgtaccccgttccctcccgtacgacccgtcccgtaccccgaacccgaaccgggtacccctacgtcccggttccccgtttacccccccgtcggtacccctaacccccttacccgtacccgaacggtaccgtaccccgtacccggttccggtaccggggcccgaaccggtacccgggccccgggtaccccgggttccgggtaccggttcccgggtcccggttccgggtaaccggtaacccggttacccgtttaacccggttaacccggtaacggttaaccggtaccttaccggg

SEQ ID NO: 293536 - DNA, 805 bp, Homo sapiens
  misc_feature: GYAE6OF01BQ8GR.16.10.A10.1.454.CMB.1.raw
  modified_base (220)..(220): a, c, t, g, unknown or other
  misc_feature (220)..(220): n is a, c, g, or t
tcagtgtactactccacgaccggtgctcgatttagcgtcgatctcagggggtgggtccaggaggcagaactctgggtgtctcaccatggcctggatccctctacttcctcccctcctcactctctgcacaggctctgaggccttcctttgagttgacacagccaccctcggtgtcagtcgtccccaggacagaccggccaggactcacctgctcttcagntgctattgacctaaggacaattactcggtactttcgttacgggtaccagaccgaaggaacggcccgaacggtccgaaccgggtcccgttgggtggtggtagtaagttaacgtaaataaaacggacaacaacggacggtaccggtaccctacggaacgggtacctcccgggtgggacgttaacgtttccgtcggtacggtccgtaccgaacgtccgtaacggacgggaccacgtacggtacctacggtgaaccgtaggtcgggtagggaccgtaccggaacggtacggaaacgggaacggtaacgggtagggttaacctaacgtttaacgttaacgtcggtactaacggtacctaccggaactaaaacccgtctaccggtacggacccggtaacgggttccgggttaacccggggttcggggaacccggggtaaccggtaacccggtacggtaccgtacccgggttacccggtccggtaccgggtacccgtaccgggaaccgacccgggtacccgtccccgttacccccggccccggttacggtacccctacggtttaccccttccccggttaaccccgtccccgg

SEQ ID NO: 293537 - DNA, 649 bp, Homo sapiens
  misc_feature: GYAE6OF01DCEA0.16.10.A10.1.454.CMB.1.raw
  modified_base (237)..(237): a, c, t, g, unknown or other
  misc_feature (237)..(237): n is a, c, g, or t
tcagtgtactactccacgaccggtgctcgatttagcgtcgatctcagggggtgggtccaggaggcagaactctgggtgtctcaccatggcctggatccctctacttcctccccctcctcactctctgcacaggctctgaggcctcctttgagttgacacacgcccaccctcggtgtcagtcgtccccaggacagacggccaggatcacctgctctcagatgcattgccaaggcaatntgcttcgtggtaccagcagacgccgaggccacggccctggtggtggtgatataagtaaacgacacaacgagacggccctacgagggacctcccggtgggactattctcgtcggctccgagctacgacggacgacagtcgtacgttcgaacctagtcggtaggacgtccgaggacgaacggaacgacgggtaggtacgtaacgtagttacgtcgtacgtagtccgtacgaaccaaaccgactacgtacggaccgtacggtaccgggttacggtccgggaccgggaacggtaccgaacggtccgtaccggtacccgtccgtcggaccgtaccggaccgtacccggacggtcccgtccccggtccccggttaccggtaccgcccgtttacccgttcccgttcccccgtacccccg

SEQ ID NO: 293538 - DNA, 847 bp, Homo sapiens
  misc_feature: GYAE6OF01C2T5S.16.10.A10.1.454.CMB.1.raw
  modified_base (206)..(206): a, c, t, g, unknown or other
  misc_feature (206)..(206): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctcgtggacttccacccttagcggttatgccatgagcgtgggtccgccaggctccgaggggagggctggagtggtctactaacgttttggnggtagtggtgtcaccgctactacgcagacgtccggtagaacgggcctattccactactctaccagacgacctaccgttaccgaagtaacacgacttgtatcgtaggacgaatagaaaccacgtccgtaggacgtacggacggaaccggacgaccggacctaattacttacgttaccgtggtacgaaacggtaaacgtactccgtagaacggtccctaactacccgtacctcgagttaccacggtcgttccgggttaacccgcccggtacggggtaccccgaaccgggtaaccccgtcggtaccccgtacccgttccgttaccctaccgtaccgtcccccgtaacccggtaaccccggtaacccgggtaccccgtaaccggtttcccccggttaccccgtttaccccccggtaccgggtaccccctaacccccgttaccccgtaacccgtaaacccggtaccgacccgttacccgggtacgggtacccgggggacccaacccgggtaccccggtacccgggtaccccggggttccgggtaacccggttcccggtaccccgggttaccggtaacccggttaaacccgggttaccgtttaaccccggttacggtaaaccggttaaccggtaccgtaacccgggg

SEQ ID NO: 293539 - DNA, 665 bp, Homo sapiens
  misc_feature: GYAE6OF01A3P23.16.10.A10.1.454.CMB.1.raw
  modified_base (303)..(303): a, c, t, g, unknown or other
  misc_feature (303)..(303): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccgagggaaggggctggagtgggtctctaacttttagtggtagtggtgtcacgctactacgcagagtccgtgaacgggccgattcacatctccagacgacacttccgagaacacgctgtatctgcatgaacagcctganagtcgaggacacgcatatattactgtgacgaaagatctgacggtcctacgtaaccacctacacgttcagtccttggttcccgaccccgtggggcccgtaacgggaccccgttggtcccaaccgtcctcccgtacgacgcccctacccgacccgaacggtccccgtaactcccggttcccttacccccggtcggtacccctaccccttcccctacccgaacgacccgtactaccccgtcgggtcggggtccaaccggacggacccgggttccccgtcgggggtaccctccggccccggtttacgggaacccgtaaacgggtaccttacccggtttacgaaccggttaacgtaccgtaacccgg

SEQ ID NO: 293540 - DNA, 812 bp, Homo sapiens
  misc_feature: GYAE6OF01B2ZEV.16.10.A10.1.454.CMB.1.raw
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggcctccgaggggaaggggctggagtgggtctctaacttttaggtggtagtggtggtcacgcctactacgcagagtccgtgaagggccgattcaccatctccagagacaccttccgagaacacgctgtatctgacgaatcgaaacacggcctaggacgtaggtacggaacggtaccaaccggcctaattaagttaactttacgtggtacgaaccggtaaaagtccgtacccgtagggaaccggtacccttaacgttaacccctaacccgttctaccgggtcctaaccgggtcgttacccggggtttaccccggaacccccggggttccggggggaccccggtaaccgggggtaacccccgtcgggtaccccgtaaccccgttcccgttcccgttaccgacccgtccccgttaaccccgaaccccggaacccgggtccccgtaaccgttcccgggttaccccctttccccccggtcggtccccctacccccgttaccccgtacccgtaacggacctccggtaaccccttcgggtaccgggggccaccggaaccggtcccgggtaccccggtcggggtcccgtacgggttacccggtcggtaccgaaccgggtacttacccggtttaccggtacgttaaccggtacgtaccggg

SEQ ID NO: 293541 - DNA, 677 bp, Homo sapiens
  misc_feature: GYAE6OF01BNLC3.16.10.A10.1.454.CMB.1.raw
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagcccaccctcggtgtcagtcgtccccgaggacagacggccaggatccacctgctcttcagatgcattgaccaaggcaatatcgtctttacgtcggtaccagacaagaacgccgacggccgacggcccgtggtcgggtggtagataagtaataaagacacacgaggacgccctcgaggacgtcccgtgggactacgttctcgtcggcctccgacgtccgtacggacgggaacgacgtacggtaccgtacggttacgaacgtacggtacgggtcggtaacgtaccggaggacgaaggaacggacgggtaagggtacgtaacgttacgttacgtcgtacgtacgttcgtacgaacctaaccgaccgacgtcgaccgtacgggtcgggttagggtaccgggacggacgggaaccgacgtccgtacggtcccgttccgtcggtcgtaccgaccggacccgtacggacccgtccccggtaccccgtccggtacctaccgttccgttccccgtccccgtaccccg

SEQ ID NO: 293542 - DNA, 778 bp, Homo sapiens
  misc_feature: GYAE6OF01DGJY7.16.10.A10.1.454.CMB.1.raw
  modified_base (774)..(774): a, c, t, g, unknown or other
  misc_feature (774)..(774): n is a, c, g, or t
  modified_base (776)..(776): a, c, t, g, unknown or other
  misc_feature (776)..(776): n is a, c, g, or t
  modified_base (778)..(778): a, c, t, g, unknown or other
  misc_feature (778)..(778): n is a, c, g, or t
tcagtgtactactccacgaccggtgctcgatttagcgtcgatctcaggggtccctgagactctcctgtgcagcctctggattcacccttagcggttatgccatgagctgggtccgccaggctccgagggaaggggctggagtggtctcaacttttagtggtagtggtggtcacgcctactacgcagagtccgtgaagggccattcaccatctccagagacacttccgagaacacgctgtatctgcgaatgaacagcctgagagtcgaggacacggcatatattactgtgacgaaagtctccgtggacggacctactaccaccctacgagtccagtccgttcgggttccgaaccccgttcgggggaccctaacgggggtaaaccccttcgggtaccctaacccggttccctcccgttaccgaccgtcccccttaaccccgaaacccgggtaacccggggtaccccctaacgtttccccgggtttcccccgtttacccccccgttaccgggtaccccctaaccccctttcccccgtacccgtaaacggaaccgtaccctaaccccgttacgggtccggggggacccaccggtaaccgggccccgggtcccccggtcgggggtcctaccggtcccggttacgggtaccgtaaacgggttaaccctttaccggtttacccggtagttaaccggtaaccgtacggtaccggaacggggtcccggggtacgtacggggaaccgtaaacggggcccgacggtaacgttaacgcgagtacgngngn

SEQ ID NO: 293543 - DNA, 586 bp, Homo sapiens
  misc_feature: GYAE6OF01AJ31Y.16.10.A10.1.454.CMB.1.raw
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgtcttcttggtaccagcagaacgccaggccacggccctggtggtggtgatataataaagacacacagacggccctcgagggactcccgtgggcgtattcctcgtggccttccgagtctcgacggggacgacgagttccacggttcgaacctagtcgggtagggtacgtccgagggccaaggaacgacgggtagggtacgacgttattacgtgtcagtctcgaccaacacactgcaggtcggtcggtcggacgggacgggaccaggccgtacgcccgtcgcgccgtcgaccggacccgtaggcccgtacccgccccgtacggtcctaccgtccgttccggtccccgtccccg

SEQ ID NO: 293544 - DNA, 820 bp, Homo sapiens
  misc_feature: GYAE6OF01D4DGW.16.10.A10.1.454.CMB.1.raw
  modified_base (381)..(381): a, c, t, g, unknown or other
  misc_feature (381)..(381): n is a, c, g, or t
tcagtgtactactccacgaccggtgctcgatttagcgtcgatctcagggggtgggtccaggaggcagaactctgggtgtctcaccatggcctggatccctctacttcctcccctcctcactctctgcacaggctctgaggccttctttgagttgacacacgccacccgtcggtgtcagtcgtaccccaggacaggacggccaggactccacctgtctcttcagatgctattgaccaaggactaatattcgtctttcgtcggtaaccagtacgaaggaacgccgaaggcccacggtcccgttaggtgggttggtcgaattaagtaagtaaaacggaccaacgacgaacggaccgggtcccctacggacgggtaccttcccgnggggtactactttctcgtacgggcctaccggacgcgttacggacgggtaacgaacgtacgtacgtaccggttacgaacccggtaaggttccgggaacggtacgtaccgaacgggacgtaaacggaaggtaacgtagggtacgggtaagtaacgttacgtttacgtggtacgtacgttaccgttacgaaacctaaaacccgaccctacgacgggtaccgtacggggttacggggtttcgggtacgggggtaaccggggaaccgggtaaccggtaaccgggtacccggttacccggttacccggtacggttaccgtacccgggttaacccggaacccgggtaccccggtaaaccgggccccttaccccccggggtaccccccgttttacggggttacccctttaccgggttcccccggttttcccggttacccccccccgg

SEQ ID NO: 293545 - DNA, 642 bp, Homo sapiens
  misc_feature: GYAE6OF01DGN2P.16.10.A10.1.454.CMB.1.raw
  modified_base (342)..(342): a, c, t, g, unknown or other
  misc_feature (342)..(342): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtcgtccccaggacagacggccaggatcacctgctcttcagatgcattgaccaaggctaatatgtcttcttggtaccagcaagaacgccacggccgacggccctggtcggtggtagtatataataaaacgacacaacagacggccctcgaggtactcccgtgggctnttctcgtcgctcgagtccgtcgacgggtacacgtacggtacacggtttacgacctagtcgggtaggacgttccggaaggtaccgaaggaacggacggaaggggttacgacgtttaagttacgttcggtacgtaggtccgtacgaacctaaaccacccgtagtacgaccgtaggtcggtagggttccgggacgggacggaacctagccgtacggaccgtccgtaggcccgtacgacgacccgtacgggtcctcccgtccccgttcggtaccctccgttccgtcccggttccccctaccccg

SEQ ID NO: 293546 - DNA, 695 bp, Homo sapiens
  misc_feature: GYAE6OF01C0SE2.16.10.A10.1.454.CMB.1.raw
  modified_base (262)..(262): a, c, t, g, unknown or other
  misc_feature (262)..(262): n is a, c, g, or t
  modified_base (272)..(272): a, c, t, g, unknown or other
  misc_feature (272)..(272): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccgagggaagggctggagtgggtctctaacttttagtggtagtgggtggtcacgcctactacgcagagtcgtgaagggccgattcaccatctccaganacacttcganaacacgctgtatcctgcgaatgaacagcctagagagtcgaggacacggccaatactaattactgtgaccgaaaagatccgtaggaacggtacctaactaaccctacctacaaaggtcaacggcgttcgggtttaccggacccccggttcgggggcccgtaacggggaaccccgttgggtaccctaccccgttcccgtacctcgacgtccctacccgaacccgaaccggccccaagttcccgttcccttcccccgtacggtcccccaacccttccccgtaccgaaacgaccgtaccgacccgtaccggttcggggacctaccgacggtacccgggtcccgttgggggaccttcggtccccgttacgggtacccgaaacgggtaaccctttaaccgttaccggacgttaacggtactaacccggg

SEQ ID NO: 293547 - DNA, 801 bp, Homo sapiens
  misc_feature: GYAE6OF01EU13C.16.10.A10.1.454.CMB.1.raw
tcagtgtactactccacgaccggtgctcgatttagcgtcgatctcaggggggtgggtccaggaggcagaactctgggtgtctcaccatggcctggatccctctacttcctcccctcctcactctctgcacgaggctctggaggtcccttccttttggagtttcgaacacacgcccacccgtcggtagtcagtcgtccccgaggacagacggccgaggactcacctgcctcttacagtatcgctagttcgaccgaaggccaaattatcgttacctttcgttacgggtaaccgagacgaacggaaccggaccgacggcccgaccgggtcccgtggttcgggtggtagtaacttagtaagttaaacgaacgaaccaacgtaacggaccggtacccgttacgggaacgggtaccgttacccgggtcgggtaccgttagtttcccggtacgtccgggtccttaccgtaacggccgtaacggacgggaaccgtaacgtacgtcgtaccggtacgaccgtacggtcgggtcgaacgtccgacgacgaaggaacggtacgggtagggtaactagttactacgtcgtacgtcgtacgtacaaccgaactaccgacgtagaccgtacgggttacgggtcggggttccgggaacgggtacgggaaccgtaccggtaacgtcccggtaacccggttccgaaccggtacggttcccgaaccggacccggttacgggtccccgtcccccggttcccccggtaccggtacccgtttaccggttccccggtttcccccggtaccccgttaccccggg

SEQ ID NO: 293548 - DNA, 915 bp, Homo sapiens
  misc_feature: GYAE6OF01AYY2C.16.10.A10.1.454.CMB.1.raw
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtcgtccccaggacagacggccaggactcacctgctcttcagtatgctattcgacctaaggcctaaatatcggtcctttaccgtttagggtaacccacggaccgaaacggaaaacggccccgtaacgggtcccccgaacgggtcccccgttggggttgggttacggggttcgtaaagttaaacgttaaacgttaaaaacggaaccaaccgaaacgaacggaaccgggtaccccttacggaacggggtaaccgttaccccggtacgggggtacccgttaaacgttttccgttcccggtaaccgggtcccttaaccccggaacggtacccgtttaaccggaaacgggggtaaaccccggtaaccgttaacgggttaccctaaaccgggtttaccggtaaaccccgtaggttacccggggtacgggtaacggttaccccgaggggaaccctaaaggggaaacgtaccggggtaaaggtacggtaactttaacgttaccgtggtacctaacgtctaaccgaaccgtaaaccaacctacgttacgggcctaggtcccggggttagtaacccgggggtcggaaacggggtaccctaaggtacccggtacccgtacccggttcccggtaccggtaccggttaccgaccccgggtaacccgaccgggttaccccggtacccgggtccccccgttaggttacccccgtaaccgtttccccgtttccccggtaccccccgttaaccccgg

SEQ ID NO: 293549 - DNA, 687 bp, Homo sapiens
  misc_feature: GYAE6OF01EV7AC.16.10.A10.1.454.CMB.1.raw
  modified_base (444)..(444): a, c, t, g, unknown or other
  misc_feature (444)..(444): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctccttttgagttgacacagccaccctcggtgtcagtgtcccccaggacagacggccaggatcacctgctcttcagatgcattgccaaggcaatatgtctcttggtaccagcagaagccaggccaggccctggtggtcggtgtataataataaacgacaaccgacgacggaccgtcccgtacgacggtaccgtccggtcggcgtcttctcgtcgtcgacgcgtcgtacgacggacgacgtacgtacgtacgtacgacgtacgtacggctcggacggtccgacgacgaacgaaggtaacggtanacggtagtacctacgttaccgtacgtacgtacgtacctaacgaacccgaaccgtaaccgtaccgtacggtaccggtacggtaccgggtaccgggtaccgggtaccgggtaaccggtaccgtaccggtaccgttaccggtacccggtacccggtaccggtacccggtacccgtacccggaccccggtacccggttaccccggtacccccggttacccccggttaccccggttccccgttacccg

SEQ ID NO: 293550 - DNA, 710 bp, Homo sapiens
  misc_feature: GYAE6OF01C27DY.16.10.A10.1.454.CMB.1.raw
  modified_base (165)..(165): a, c, t, g, unknown or other
  misc_feature (165)..(165): n is a, c, g, or t
  modified_base (271)..(271): a, c, t, g, unknown or other
  misc_feature (271)..(271): n is a, c, g, or t
  modified_base (705)..(706): a, c, t, g, unknown or other
  misc_feature (705)..(706): n is a, c, g, or t
  modified_base (708)..(710): a, c, t, g, unknown or other
  misc_feature (708)..(710): n is a, c, g, or t
tcagtgtactactccacgaccggtgctcgatttagcgtcgatctcaggggtccctgagactctcctgtgcagcctctggattcacccttagcggttatgtcatgagcgtgggtcccgccaggctccgagggaaggggctgggagtgggtctctaacgtttttagnggtagtgggtgtcacgcctactacgcagacgtccgtgaaggggccattccaccatcctaccagacactaccttccgagaaccacgctgtatcctgcgaaatgaacngactggaagacggtacgaacggaaccacggtacctaagtacttaactttacgtggttagaaccggtaaaatacgttcccgtaggaaccgtccttaacgtaacccacccttagacgttcgacgtcggtttaccggtacccggacccccggttggggaccccgtaaccgggggtaaaccccgtcggttaccccgacccggttccctcccgtaccgccgtacccaccccgaaccgtaacgggccccttagtcccggttccccgtcccccgtacgcccctacccctccgtaccaagtaccgcctaccgttcgggacggggccacgccggtccggccgtcgggcctcgtccgtggtaacgtacgtaccttacgttacggtacgtaacgtccgacgtggtacggccgggtcgaccgggcggaacggcccgaagagtcgcnngnnn

SEQ ID NO: 293551 - DNA, 683 bp, Homo sapiens
  misc_feature: GYAE6OF01B7JJB.16.10.A10.1.454.CMB.1.raw
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtcgtccccaggacagaccggccaggatcacctgcctcttcagatcgcattgaccaaggcaaagtatgtcttcttggtaccagcaacgaacgccgacggaccgacggcccctggtcggtggtagatataataaacgacacacagacggcctgacggctcccgtgggctagttcgtcgtggtcctccgagctacgacgggaccgacgtagtacctacgtcgaaccgtagtcgggtaggaacgtccgacggacgaacggaacggtaacgggaagggttacgtacttacgttacgtcgtctaacggttcgacgtaaccaaacgaccctacgtacgacgtaccgggtaccggttcggggttaccgggaccgggtaacgggaacccgtaaggtcccgtacggtacccgttccggtacggtaccggtccgaaccggtccccgaacgggtcctaccccgggtaccccccgtacggttacccacccggtttaccctcccggttccccctaccccgg

SEQ ID NO: 293552 - DNA, 600 bp, Homo sapiens
  misc_feature: GYAE6OF01AXJKG.16.10.A10.1.454.CMB.1.raw
  modified_base (220)..(220): a, c, t, g, unknown or other
  misc_feature (220)..(220): n is a, c, g, or t
  modified_base (584)..(584): a, c, t, g, unknown or other
  misc_feature (584)..(584): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctcgtgaggcctcctttgagttgacacagccaccctggtcgtcagtgtccccaggacacgacggccaggactcacctgctcttcgagntgcattgccaaggcaatatgcttcttacggaccaggcaggacgccaggccaaggccctagtggtggtcgagtataataaagactacacagaacggccctagacgggactcccgtgggccgatttcctcgtggtcctccgacgtcctcggaggacgacctagtcacggttgaacctagtcgggtggacgtcccgagggtccaaggaacggacgggagggtacgtactagttaaccgttgtacgtagtactagacctaaaacgccaacgtgaccgaggtcgggtagttcccgggaggtacgggaccaagcgtcgaccgtccgtgaccgtcacgcccgaggcctcccgccccgtcggtcacccttcnccgttccccgtacccc

SEQ ID NO: 293553 - DNA, 765 bp, Homo sapiens
  misc_feature: GYAE6OF01AO67Q.16.10.A10.1.454.CMB.1.raw
  modified_base (221)..(221): a, c, t, g, unknown or other
  misc_feature (221)..(221): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctctgaggccttcctttgagttgacacacgcccaccctcggtgtcagtcgtccccaggacagacggccaggatccacctgctcttcganatgctatcgaccaaggacaatagtgtcttcgttggtaccagacaagaacgccgacggccgacggtccctggtgggtggtagtaacttaagtaacgtaaacgacacaccgaagaccggccctagaacgggtactccccgtagggactacgtttctcgtcggacctaccgacgtcgtacggagggaccgacgtacggttaccgacggttacgaacccgtaggtcggggtacggtacggtaccgacgggaccgaagggaacggacgggtaacgggtacgtaaccgtttaagttacttacggtacgtacgttacgtacgaaacccgtaaaccgaccgtaacgtcggaacggtacgggtaccggggttcggttaccggggacggggaacgggtaaccggaagttccccggtaggtaaccccggtccggttaccggacccggttacccgacggtaaccccgggtaacggttcccccgtccccggttacccccggttaaccggttcccgtacccgtttccccggtaccccggtttcccccgtaaccccggg

SEQ ID NO: 293554 - DNA, 694 bp, Homo sapiens
  misc_feature: GYAE6OF01EG0CT.16.10.A10.1.454.CMB.1.raw
  modified_base (201)..(201): a, c, t, g, unknown or other
  misc_feature (201)..(201): n is a, c, g, or t
  modified_base (222)..(222): a, c, t, g, unknown or other
  misc_feature (222)..(222): n is a, c, g, or t
  modified_base (345)..(345): a, c, t, g, unknown or other
  misc_feature (345)..(345): n is a, c, g, or t
  modified_base (437)..(437): a, c, t, g, unknown or other
  misc_feature (437)..(437): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccaggggaggggctggagtgggtctctaacttttagnggtagtggtggtcacgcctanacgcagagtccgtgaagggccattcacctatcctccagagacaccttccgaagaaccacgctgtatctgcgaatgaacacgctaggagagtcgaggacacggcatatatacgtgtgcgaaggnggaattgggtggcggtgaacgttgacttagttcgaagtacggtcggggtaccgaacgggtacccgttcggtaccacccgtccttcccgtacnccggtaccctacccgtaacccggaaccggggacccctaacccggttcccgggttacccctttcccccccggtaccggaccccgtaccccccttccccgttaaccgaaccgtaccgacccgtacccgttcggtacgggggcccgaccgtacggacccgggcccggttccgggcgttcccggtccgttacgggtaccgaacgggtaacccttaccgttacccggtagtaacgttaccgtaaccgtggacgggtccgggg

SEQ ID NO: 293555 - DNA, 692 bp, Homo sapiens
  misc_feature: GYAE6OF01EYGNU.16.10.A10.1.454.CMB.1.raw
  modified_base (571)..(571): a, c, t, g, unknown or other
  misc_feature (571)..(571): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctctgaggccttcctttgagttgacacacgcccaccctcggtgtcagtcgtccccaggacagacggccaggactcacctgctcttcagatgcagttcgaccaaggactaatatgtactttcgttagtaccagacagaagccgacggcccacggccctgtacggtggtagataagtaataaacggcaaccacgagaccggccctacgagggtaccttcccggtgggtaccgtacttcgttccgtcggtcctaccgaacgtccgtaccggaacggggacccgtacgtaacggttacccgtaccggtttaccgaacccgtacggttaccgggggtacgggtaaccggttcccggaacgggtacgaacgggtaacgggtaacgggtaacggggtaacgtaacgttaagttaccgtcggtacctaggttccacgacctaaaccnccgaacgtcgcgtacggtcgggtgtacggacgggacggaccgaggacctcgccgtcgcgtacgccacgaccgtacgccgtcccgaccccgtcggtcaccgtcccgttcgtcccccgtaccg

SEQ ID NO: 293556 - DNA, 673 bp, Homo sapiens
  misc_feature: GYAE6OF01EHKIP.16.10.A10.1.454.CMB.1.raw
  modified_base (403)..(403): a, c, t, g, unknown or other
  misc_feature (403)..(403): n is a, c, g, or t
tcagtgtactactccacgaccggtgctcgatttagcgtcgatctcagggggtgggtccaggaggcagaactctgggtgtctcaccatggcctggatccttctacttctcccctcctcactctctgcacaggctctgaggccttcctttgagttgacacagcccacccgtcggtcgtcagtcgtaccccgaggacagacggccaggactccacctgctcttcagtatgctattcgaccgaaggactaatatcgtctttcgttacggtaccgacgacgaacggaacgaccgacggaccgaccggtccgtggtggtaggtagtaattaactaaacgaaacgaccaacgacgacggaccgtaccgtacggacggtacgtccggtacggtactactcgtcgtcgtccncgtacgtcgtacggacggtaccgtacgtcgtacgtacgtacgacgtacggtcggtacgtacgtacgagacgaacggacggtacgggtacggtacttaagtacgttacgtcgtacgtacgtcgtaacaacaaccacgtgacggtacggtcggtacggtcggtacgggaccggacgtacgacgtccgtacggtccgtcgacggtaccgcgaccggtaccgtcgtcccgtacccgtccggtacaccttaccgtcccgttcccgtcccgtaccg

SEQ ID NO: 293557 - DNA, 741 bp, Homo sapiens
  misc_feature: GYAE6OF01CFE49.16.10.A10.1.454.CMB.1.raw
  modified_base (322)..(322): a, c, t, g, unknown or other
  misc_feature (322)..(322): n is a, c, g, or t
tcagtgtactactccacgaccggtgctcgatttagcgtcgatctcagggggtgggtccaggaggcagaactctgggtgtctcaccatggcctggatccctctacttctcccctctcactctctgcacaggctctggacggtccttcctttggagttgacacacgcccacccgtcggtgtcaggtcgtaccccgaggacgaggaccggccaggactccacctcgcttccttacagtatgctatcgaccgaagcaatctgtcttcgtacggtacacgacgaagaacgccgaggcccaccggtccctggtcgtccgtggtccgtntagtcgtagtacgagacgggcccgaccggtccgtacggacgggtacctccggtgacggctacttccgtcgtcgtcctaccacgtcggtacgggaccgccggtacccacccgtagacctacgtacgacgggtacggtaacggggtccgggtaacggggccggggaatccgggggaacggtacccgttaacgttacgttaccggtggtaacgggttagggtgggtagggtaagttacggtaggtacgttgtaacgttacgttacgttagttccggttaggttccggtacgtccgggtacgggtaccggtacgggttcccgtaaccggttaccggtacggtacccgaacccggtaccccgaaaccggaccccctacccggtcgttacccgttcgtaaccttccccgggtacccttcccccgg

SEQ ID NO: 293558 - DNA, 729 bp, Homo sapiens
  misc_feature: GYAE6OF01BZU7Q.16.10.A10.1.454.CMB.1.raw
  modified_base (110)..(110): a, c, t, g, unknown or other
  misc_feature (110)..(110): n is a, c, g, or t
  modified_base (595)..(595): a, c, t, g, unknown or other
  misc_feature (595)..(595): n is a, c, g, or t
  modified_base (674)..(674): a, c, t, g, unknown or other
  misc_feature (674)..(674): n is a, c, g, or t
  modified_base (720)..(720): a, c, t, g, unknown or other
  misc_feature (720)..(720): n is a, c, g, or t
  modified_base (722)..(722): a, c, t, g, unknown or other
  misc_feature (722)..(722): n is a, c, g, or t
  modified_base (725)..(726): a, c, t, g, unknown or other
  misc_feature (725)..(726): n is a, c, g, or t
  modified_base (728)..(729): a, c, t, g, unknown or other
  misc_feature (728)..(729): n is a, c, g, or t
tcagtgtactactccacgaccggtgctcgatttagcgtcgatctcgagggggtccctgagactctcctgtgcagcctcgtggattcacccttagcggttatcgccatggngtcgtcgggtcccgaccgagggccttcccggaaggggaacgggggtctggggaggtcggggtctacgtaacttttaggtcggttagtgggtacgtcgaccgtcctaacgtccgacaggtacggtccgtaggaacgggtccattccacctatcctaccgaggacgtaacctaccttaccgggaaccgaaacgtaccgcgttacgtgttacgtcggaacggtaataacgaacgaacgcgtaggtagacggtacgacggacccgacggacctactaattacgttacgttagtcggaagttaacggattcccgttacggcgtactaccgtaccaccgtctacgtcgacgtcgtcggtaccgtcccggtcggccggtacggacccgtcgacctccgctcctcacgtccacgtaccacggcccttacgtccgtcccgtcccgtccgcccgtccctaccttccgactcgacctccgtacggtccgggtaacnccgtacggccggtccgtaccggcgtacccggtccgtacgtacggaaccgttccttaaccggttactacggagttaaccncggtacgtcggtacgggtccggaggcgtaaggccctagggacacgngnttnntnn

SEQ ID NO: 293559 - DNA, 1006 bp, Homo sapiens
  misc_feature: GYAE6OF01C1WR3.16.10.A10.1.454.CMB.1.raw
tcagtgtactactccacgaccggtgctcgatttagcgtcgatctcagggtcttcgtggctcacgtccaccaccacgcatgtgacctcaggggtccctgagactctcctgtgcagcctctggacttcacccttagcggttatgccatgagcgtgggtccgccaggcctcgagggagggctgggagtgggtctctaacttttaggtggtagtggtggtcacgcctacgtacgcagtacgtccgtgaacgggcctattccacctatctaccgagacgacacttccgaagaaccacgtcttagtatctacggtacgaatacgaacgcgtaccgtagaggtaacggttaccggacgggaaccaccgggtaacccttaagttaacttaacgttaaccgttacgggtacgtaaaccggtaaagttaccgtacccggtaagggtacccggttaacccctttaaacggttaaccccctaacccgttaccgtacgtttaaccggaaccggtttacccggttttaccccggggttaaccccccggtacccccgggggttaccggggggtaacccccgggtaaacccgggggttaaccccccggtttacccggggttaacccgttacccccggtttacccttaccccggttaacccgtaaccccgtaccccccgtttaaccccggaaaccccgggtaaccccgggtaaccccgttaaccccggtttcccgggtttccccccgtttaccccccgttacccgggtacccccttaccccccgttaaccccgttaaccccgggtaaccgtaacccgtaccccgtacccccggttaccggggtaccgggggtaacccctaacccgggacccggggtaccccgggttccccgggggtaccgggttccccgggtttaccgggtaccccgggttacccgggtaaacccggtaaaccgggttaaaccccgtttaacccgggttacccgggttaaaccggttaacggtaaccggttaaaccccggggg

SEQ ID NO: 293560 - DNA, 782 bp, Homo sapiens
  misc_feature: GYAE6OF01DLN35.16.10.A10.1.454.CMB.1.raw
  modified_base (125)..(125): a, c, t, g, unknown or other
  misc_feature (125)..(125): n is a, c, g, or t
tcagtgtactactccacgaccggtgctcgatttagcgtcgatctcagggggtgggtccaggaggcagaactctgggtgtctcaccatggcctggatccctctacttcctcccctcctcactctcngcacaggctctgacggccttcctttgagttgacacacgccctaccgtcggtgtactagtcgtcccaggcaacggcggccaggatcactcgctcttcagctgcctagtccaacgagacatactcgtcttacgtcgacacgcgaagaacgaccgaggcccgaccggtccgttggtcggtagcgattaataacaaacgacactagacggaccgcctaggacggtactccggacggtcgttactcgtaccgtccgtccgtaccgtagtccctaacgggacgggtaacgtacgtaaccggtacttacggtaacccgaacggttacgttacgggtaacggtacggtaccgaacgggacgaaacgggtaacgggaacgggtaggtacgtaaacgtttaacgtacgttacggtacgtacgttacgtaccgtaaccgtaaacctacccgtacggtacgtaaccgggtacggttaccgggggttaccgggttacggggaaccgggtaaccgggaaccggtaccggttaccgtacccggttaccggtccggtcgtaaccggtacccggaacccggtacccggaaacggtccccggttacccccggttaccccggtacccgttaaccgttaccccggttacccccgttccgtttccccccggtaccccg

SEQ ID NO: 293561 - DNA, 568 bp, Homo sapiens
  misc_feature: GYAE6OF01BJ2N4.16.10.A10.1.454.CMB.1.raw
  modified_base (431)..(431): a, c, t, g, unknown or other
  misc_feature (431)..(431): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagcccaccctcggtgtcagtgtccccaggacagacggccaggatcacctgctcttcagatgcattgccaaggcaatatgcttcttggaccagcagaagccgaggccacggccctgtggtggtgatatataaagacacacagaggccctcgagggactcccgtgggcgtattctcgtggctccagctcgaggacgacagtcacgttcgacctagtcggtggacgtcgaggcaggaagacggagggtgactattactgtcagtctacgacaaacnccacgtgcgagtcgggtcgttcgggcgggacgggaccgaggccgtcggaacccgtcgtcggccgtccgacggacccgtaaggcccgtcccgcccccgtcggtacctacccgttccgttccggttccccctaccccgg

SEQ ID NO: 293562 - DNA, 719 bp, Homo sapiens
  misc_feature: GYAE6OF01CCXW4.16.10.A10.1.454.CMB.1.raw
  modified_base (658)..(658): a, c, t, g, unknown or other
  misc_feature (658)..(658): n is a, c, g, or t
tcagtgtactactccacgaccggtgctcgatttagcgtcgatctcgagggggtgggtccaggaggcagaactctgggtgtctcaccatggcctggatccctctacttcctccccctctcactctctgcacagctctgacgtcctcttgagttgacacacgccctaccgtcggtgtctaggtccgtccccaggacacggaccggccaggactcacctgcctcttcagatgctattcgacgaaggctaatgtcgtacttcggttacggaccagtcgaacgaacgccgacggtacccgaccggtcccgttggtgggttggtatacgtaagttaaacgaaaacgaaccaccgtaacgaacgggtacggaccccctaggacgggtaaccgttcccgggtcgggtaaccgtctttccggtcggtccgaccttccgagtccgtacggacggtaccgacgtaggtaccgtacgttcgaacccgtaggtcgggtaacggtcgtaccggacgaaccgaagggtaacggtacgggaacgggttaacgtaacgttacgtttaacgtcgttacgaccgttccgtaaccaaacgaaacccgtacgactagcgacgtcgggtacgggtcggaggaacgaccgtagcggtactccgtaccgcggtcgcggaccncggtccgtacccgccccggtaaccgtcccgtaactccgtacccgttccgtaccccgtcccg

SEQ ID NO: 293563 - DNA, 692 bp, Homo sapiens
  misc_feature: GYAE6OF01C2W6T.16.10.A10.1.454.CMB.1.raw
  modified_base (203)..(203): a, c, t, g, unknown or other
  misc_feature (203)..(203): n is a, c, g, or t
  modified_base (327)..(327): a, c, t, g, unknown or other
  misc_feature (327)..(327): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattccacccttagcggttatgccatgagcgtgggtccgcaggctcgaggggagggctggagtgggtctactaagttttaggnggtagtggtggtcacgtcctacgtacgcagtacgtccgtaggaacgggcctattccaacctatcctaccgaagagacctaccgttaccgaacgaacacgtctagtatcgtgagaagtcgaaacncgtccgtagagacggtacggacgaacgaccggactaagtatattacgtgtagaaccgaaatctacgtaggaccgtacctaactacccgacctacgtacgtacgacgtacgttcggtcccgaacccggtcgggacccggaacggtacccgtcggtaccctccgttccgtacctcgaccgtccctacccgaaccgtaccggaccctacgttcccgtcccgttccccgtaccgtacccacccctacccgtaacgtaaccgccgaccgtacccggtcgggaccggggaccaccggacggccccggtccggtcggtccgtacggtccgtacgtacgaacgtaccgtacgttacggactacgtacgtacgg

SEQ ID NO: 293564 - DNA, 610 bp, Homo sapiens
  misc_feature: GYAE6OF01EWY3L.16.10.A10.1.454.CMB.1.raw
  modified_base (431)..(431): a, c, t, g, unknown or other
  misc_feature (431)..(431): n is a, c, g, or t
  modified_base (573)..(573): a, c, t, g, unknown or other
  misc_feature (573)..(573): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctctgaggccttcctttgagttgacacagccaccctcggtgtcagtcgtccccaggacagacggcaggatcacctgctcttcagatgcattgcaaggcaatatgtctttcttggtaccagacaagaagccaaggccacggccctgtggtggtgatataataagacacacgagacggccctgagggactcccgtgggctattcctcgtggcctaccgagctacggacgggaacgacgacgtcgtacgttaggaccaggttcgggtagggacgtcccgaagggccaaagggaggaaccggnggtagaacttagttaccgtgtctaacgctacggaaccaaaccacgactggacgtacgggtcggttcgggttacggggcgggtaaggaacccgtacggctaccggcccgttgtcggccgtcgacgacccgacggcccgtaccnccccgttcggacctacctccgttccgtccctacccgg

SEQ ID NO: 293565 - DNA, 1003 bp, Homo sapiens
  misc_feature: GYAE6OF01BVOBZ.16.10.A10.1.454.CMB.1.raw
  modified_base (151)..(151): a, c, t, g, unknown or other
  misc_feature (151)..(151): n is a, c, g, or t
tcagtgtactactccacgaccggtgctcgatttagcgtcgatctcagggggtgggtccaggaggcagaactctgggtgtctcaccatggcctggatccctctacttcctccccctcctcactctctgcacaggctctgaggcctcctttgngttgacacagcccacccgtcggtgtcaggtcgtcccccgaggacaggaccggccaggactccaccgtgccttccttacgagtatcggctagttacggacccaaaggactaaatcgtacggttccgtttacgtttccgggtaacccgaggacaacggtaaaccgcccgaacgggtcccgaccgggtccccgttgggttacgggtaggttcgtaattaacgttaaacgtaaaacggaccgaccgaaccggtacggaaccgggtaccctacgggaacgggtacccgttccccgggtacggggtaccgtacgttttacccgttcgggttaccggtcccgtacccgtacgggtcccggttaccgggaaaccgggggtaaccgtaacccggttaacgggttaccccggttaaaccgggtttaccgggtaaacccgttacggggttacggggggttaccgggttaaccgtacccgggtaacggggaacccgaaaggggaaacccggggtaaacggggtaaccggggttacggttaacccgttttaaggtaacccggttttacgggtaaccggttaccggttaccggaccggaaaccccgtaaaacccgtaccctaccgggttaccggaaccggttacggggttccgggtttacggggttacccgggggacggggaaccggggtaacccgtaacggggtcccgttacccggggtaaccccgtttccggttaccggggaccccgttccgggtaaccccgggtaaccccggacggttaccccggttaccccggtacccccccggttcggtaaccccggttaccccgttccccgtttccccggttcccccccggttaccccgg

SEQ ID NO: 293566 - DNA, 814 bp, Homo sapiens
  misc_feature: GYAE6OF01CRZY3.16.10.A10.1.454.CMB.1.raw
  modified_base (177)..(177): a, c, t, g, unknown or other
  misc_feature (177)..(177): n is a, c, g, or t
tcagtgtactactccacgaccggtgctcgatttagcgtcgatctcaggggggtgggtccaggaggcagaactctgggtgtctcaccatggcctggatccctctacttcctccccctctcactctctgcacaggctctgacggccttcctttgagttgacacacgcccaccctcggtntcagtcgtccccaggacaggaccggccgaggactccacctgcctcttcagatcgctatcgaccgaaggacaaattgtcgtcctttcgttacggtaaccagacgaaggaacgccgaacggccgaccggtcccgttggttcgggtaggtagtaattaagtaaacgtaaaacgaacaacaaccgaacggaccggtacccgtacggacgggtaccttcccgggagggtaccgttaacttccgtcggttccggtcctacccgacggtcccgtacgggaacggggtaaccgtaacgtacggttaccgtacgggttaacgaacccggtaggtccggggtacggtacgttaccggacgggacgaacgggaacgggaacggggtacgggttacgtaagtttacgttaccgtacggtacgttacggtaccgtaacaacccgtaaacctaccgtacgtcggacggtacgggttacgggttacgggtaccgggaacgggtaacggaacccgtacggtacccggaccgttcccggtaccggtcgtacccgggtaccgtaacccgggacccggtaccggtccccggttaacccccggccccgttacccgaccctttcccggtacccggttccccgttcccccgtaccccgg

SEQ ID NO: 293567 - DNA, 866 bp, Homo sapiens
  misc_feature: GYAE6OF01DQMTE.16.10.A10.1.454.CMB.1.raw
  modified_base (185)..(185): a, c, t, g, unknown or other
  misc_feature (185)..(185): n is a, c, g, or t
tcagtgtactactccacgaccggtgctcgatttagcgtcgatctcgaggggggtgggtccagggaggcagaactctgggtgtctcaccatggcctggatccctctacttcctcccctctcactctctgcacaggctcgtggacgccttcttggagttgacacacgccctacccgtggtgttaccngttccgtaccccgaggaccacggaccgggtccaagggtattaccgcctcgtccttcctttaccgagtacgttcgacttaacgtcgaaccggaaaggtacctaaaagttacgttcggttcccttttaggtttaaccggggaacccaaggtaaccggaacggtaaccggaacccgtacgggaccccgtaaccgggtcccggttaagggttggggttacgtaggtaagttaataaaccgtaacggacaacgtacgacggtaccggacccgtaggtaaccgggccttaccgggacggttaccgtacgttaccgtcggtccgtactacccggacgtacgtacggaacgggtcgaactacgttaccgtacggttacgaccggttacggttccgggaggtaccgaccggaccggaacgaacggggaaccgggtaaggggtacggttaacgtaccgggttatttaccgggtagtacggtttaccgaccgtaccggtaaccaaaccggttaccgaaggtccggaccgtaccggggttcggtaccggggtacggaccgggtaacggagtaaccggtccggttacggcccgttagttcccggacggtaccctacggggaaccctcgggtacccccgtccgggtacccctcggttacccttcccgtcccgggtttcccctcccctaacccggg

SEQ ID NO: 293568 - DNA, 993 bp, Homo sapiens
  misc_feature: GYAE6OF01BGVB3.16.10.A10.1.454.CMB.1.raw
tcagtgtactactccacgaccggtgctcgatttagcgtcgatctcaggggggtgggtccagggaggcagaactctgggtgtctcaccatggcctggatccctctacttcctccccctctcactctctgcagacgtctctggacgtccttcgtttagagttgaccaccacgccctacccgtggggttctaccgtaaggtccgttaccccggaaggacgacgggaccggaccgaaggactccacctcggtccttctacgaagtacgttaggcctagttacgaaccgtaaggactaaacgttcttcggtacctttacggttaccggtaaccgacggacgtaacggaaccggaccggtaaccggaaccggtaccgggcccggttgggttacggggttacggtaggtaatttaacgtaaaagttaaaacggaacctaacgaaacgacggtaaccggtacccgttacggaaaccgggttaccgtcccgggttacgggtacccggttaagttttaccggtccgtacgggtaacccctccggtaacggtacccggtaacggggaaccgggaaccggtaaccgttaacgggttaaccccggttaacgggtttaaccgaaccggttaacgggggttcccgggttaacgggttaccggaaccgggttacccggtaaagggaaacgggaacgggtttaacgggtaacgggttacgttaaacggtttacttaaccgggtacttaaccgggttaacgttaccggaaaccaaccgtttaaaaccccgcggtaaaaccccgtgggtaacccggttaggggtaaccgggttaaccggggttacccggggaaagggttaaccgggaacccggtaacggtcccggtaaccggtacgggttaccctagggggttaccccgaccgaccgggttaccccggaaccggttcccgttaaccccggtcccggttaccgtacccgttaccgttccgtacccccggttcccgtaccccgg

SEQ ID NO: 293569 - DNA, 1153 bp, Homo sapiens
  misc_feature: GYAE6OF01CQJ0J.16.10.A10.1.454.CMB.1.raw
tcagtgtactactccacgaccggtgctcgatttagcgtcgatctcagggtcttcgtggctcacgtccaccaccacgcatgtgacctcgaggggtccctgagactctcctgtgcagcctcgtggtacttcctacccttagcggtttatcgcctagtgagccgttcgggtcccgccgaggcctaccggaggggaaggggcgttgggaggttcgggtctacgtttaacgttttgggtgggttaggttggtcggtaccaccggtccttaacgtacgccgaaggtacggtcccggtaggaaacgggtcctatttacccaacctactccgttaccgaaaggtaccgtaaccgtaacccgtttacccggaaaagaaacccgtaccggtacctttacgtacgttaccgtacgggtaaccgtaacgttaaaccgaaaccggtaaaccggtaccgttacgggggaaaaccggttacgggtaaccgggtaaaccggggaacccggtaaccccgggtaacctttaaacgtttaaccttttaacgtttaaccggttacgggtaacggaaaaccggtaaacggttacctaacccgggttcgggaaaacccgggttacccctttaacctaaaccccgtacccgttacgtaaggttacccgtaacggttcccggggttttacccggggtacccccggtaacccggggttaacccggggaaccccgggttaaaccggggtaacccccgggtttacggttaccccgtaacccccgtttcccgttaccccgtaacccgtaccccggttaccccgtaaacccccggaaccccgggtaaacccgggtacccccgtacccgggttttacccccggttaccccccggttaccccccggtttaccccggtacccccctttaccccccgggttaacccccgtaacccccggtaaccccggtacccgtacccccggttaacccggggttcccggggtaacccggggtaccccggaaaccccgggttcccggggcccccggggttaacccgggttcccgggtaccccgggttacccgggttacccgggtacccggttaaaccggttaaccccgggttaacccgtttaaccccgggttaacccggtaaaccgggttaaccgtaaccccgggttaacccggg

SEQ ID NO: 293570 - DNA, 609 bp, Homo sapiens
  misc_feature: GYAE6OF01CEJH4.16.10.A10.1.454.CMB.1.raw
  modified_base (159)..(159): a, c, t, g, unknown or other
  misc_feature (159)..(159): n is a, c, g, or t
  modified_base (602)..(604): a, c, t, g, unknown or other
  misc_feature (602)..(604): n is a, c, g, or t
  modified_base (606)..(606): a, c, t, g, unknown or other
  misc_feature (606)..(606): n is a, c, g, or t
tcagtgtactactccacgaccggtgctcgatttagcgtcgatctcaggggtccctgagactctcctgtgcagcctctggattcacccttagcggttatgccatgagctgggtccgccaggctccgagggaaggggctgggagtggtctcaacttttagnggtagtggtggtcacgcctactacgcagagtccgtggaagggccattcaccatctccagagacacttccgaagaacacgctgtatctgacgaatgaacagcctggagagtcgaggacacggccaatatattactgtgacgaaagactcctgacggcctaataccacctcagtcaggctggttccgacccgtgggaccacgggaaccctggtccaccgttctcctcacgccctaccaaccgagggccctagtccggtccttcccccgtgtaccctacccctccctacccaacgtacgccctaccgtccggtcgggggaccaccgacggcccgggtcccgtacgggcctcggaccgtcggtacgtaacggtaccttaccgttacggacgtaacgtacgacgtggacggtcgggtaccgtgggacgcgggtaccgacgagtacgannngnacg

SEQ ID NO: 293571 - DNA, 740 bp, Homo sapiens
  misc_feature: GYAE6OF01D00TQ.16.10.A10.1.454.CMB.1.raw
  modified_base (120)..(120): a, c, t, g, unknown or other
  misc_feature (120)..(120): n is a, c, g, or t
  modified_base (161)..(161): a, c, t, g, unknown or other
  misc_feature (161)..(161): n is a, c, g, or t
tcagtgtactactccacgaccggtgctcgatttagcgtcgatctcagggtcttcgtggctcacgtccaccaccacgcatgtcgacctcgaggggtccctgagactctcctgtgcagcctntggattcaccttagcggttatgccagtcgagctcgggtccncgaggtcctcgaggggagggctgggagtggtctacgtaaacgttttggcggtagtggtcggtaccaccgtcctaacgtacgcgtaaggacgttccggtaggaacgggccctaattaccgacctaattcctccgaaaggtacgtacctaccgttaccggaacgtaaccgtacgtcttagtactcgtagacgtaatacgaacgacgtcgtagacgacgtacggagaccgacgtactaattattacttacgtgtacgaacgtaagtcgtaccgtagaccgtacctaactaccaccgtacgcgtacgtacggtccgttaccgggtacccgtaccgggtacggaccggtaaccggtaccgtcgtacccgtacccgttcctaccgtaccgaccgtcccgaccgaccggaccggtccctaccgttcccgtcccctcccgcgtaccctaccccgtaccgaacgtacgtcgtaccgtaccggtcggtacggaccgacgtccgggccggtccggtcgggtccgtccggtccggtaccggtaccgtaaccggttacccgttaccgttaccggtaacgttacgtacgtacg

SEQ ID NO: 293572 - DNA, 892 bp, Homo sapiens
  misc_feature: GYAE6OF01CS2YU.16.10.A10.1.454.CMB.1.raw
tcagtgtactactccacgaccggtgctcgatttagcgtcgatctcagggggtgggtccaggaggcagaactctgggtgtctcaccatggcctggatccctctacttcctccccctcctcactctctgcacaggctctgacggccttcctttgagttgacacacgcccacccgtcggtgtcgagtcgtccccgaggacacggaccggccgaggactccactcgctcttcagatgctagtacgacgaaggactaatacgtcgtcttcgttacgacgacgacgaacggaaccgccggaccggaccgaccgggtcccgttgggtagggttacggttagaagttaaacgtaaacgtaaaacgaaccaacgaacggaaccggtacccggtacccgtaacgggaccgggtaccgttcccgggtaggggtaccttacgtttcccgtacgtccggtcctaccggacgtccgtacggaacgggaacccgtagtaccgtacgttaacgttaccgtaaccgtagggtcgggtacgggtaccgtaccgggacggaacggaacgggtaagggtacgggtaacgggtttagtaaccgttttaacgtaacgttcgtaaccgttacggttaccggaacccgtaaccgaaaccgtacgtacgtcggtaacccggtacggggttccgggttaccgggtaccgggggaaccggtaaacggggtaacccgacgggtttacccggtaccggttaacccccggtcggttacccggtacccggtaaacccggacccccggaaccccgggttaaccgggttcccccccggtacccccgggttccccggttaaaccccggttccccttaccccggttttaacccccgtccccccgtttacccccggtttaaacccccg

SEQ ID NO: 293573 - DNA, 900 bp, Homo sapiens
  misc_feature: GYAE6OF01CIC9J.16.10.A10.1.454.CMB.1.raw
  modified_base (362)..(362): a, c, t, g, unknown or other
  misc_feature (362)..(362): n is a, c, g, or t
  modified_base (382)..(382): a, c, t, g, unknown or other
  misc_feature (382)..(382): n is a, c, g, or t
tcagtgtactactccacgaccggtgctcgatttagcgtcgatctcagggtcttcgtggctcacgtccaccaccacgcatgtgacctcaggggtccctgagactctcctgtcgcacgcctctggacttcctacccgttaggtcggttatcgacctagtgacgtcgtcggggtcccgaccgacggtccgtaccggaaggggaacggggtctgggtaggttcgggtcttacgttaaacgtttttagggtggttacggttgggtcggtacctaaccgccttaacgtacgacgacggtacggtcccggtagggaacgggcctaacttaccaacctatcctaccgaagacgtactaccgttaccgaanaaccgtacgtcgtagttacnctacgacgtaaagtagaaccgacgtaccgtaggaccgaggtacggaacggaccggtaacgtactaagtacgttaagttacggttagacggtaacgaacggttacctaccggtacggtaaccggtaccctaccgtaacccgttacgtacgtacgtacgtacggttccgggttaaccggttacccgggtacccggtacggggaccgtacccgggtaaccgtccggtaccgacccgttaaccttccgtacctacccgtacccgaacccgtaaccggaacccggtcccttaccggtccccggtttaccccgtccccgtaacgtacccccgtacccgttacccgaaccgtaccgaccgtaccctacccgggtacggggtacccggtacgaccggtacccggtacccgggtcccggttacgggcccggtttccgggtcccgggttaccgggtaacccggttaaacgggtaaccctttaccccgggttaaaccggtttaaccgggttacggtaaccgggtccggg

SEQ ID NO: 293574 - DNA, 891 bp, Homo sapiens
  misc_feature: GYAE6OF01EOMKH.16.10.A10.1.454.CMB.1.raw
  modified_base (183)..(183): a, c, t, g, unknown or other
  misc_feature (183)..(183): n is a, c, g, or t
  modified_base (273)..(273): a, c, t, g, unknown or other
  misc_feature (273)..(273): n is a, c, g, or t
tcagtgtactactccacgaccggtgctcgattttagcgtcgatctcagggtcttcgtggctcacgtccaccaccacgcatgtgacctcaggggtccctgagactctcctgtgcagcctctggattcacccttagcggttatgccatgagcgtgggtccgccaggctccgaggggagggctggngtgggtctactaacttttagtggtagtggtggtcacgcctactacgcaggagtccgtaggaacgggccgtattccaccatcctaccaganacaccttccgaacgaacacgtcgttagtactcgtaggacgtaataggaaccgacgtcccgtaggaacggtaggtaccggaacggaaccgaccggtaccaattaattactttaacctggtagaaccggaaaagtcgttaccgtaggaacggtacccttaactaacccgtaccctcgaacgttccgaacggtccggtttacgggttaccccggaaccccggttccggggacccggtaacccggggtaaccccgtcgggttaccccgtaacccggttcccgttccccgtaccgtacccggtccccgtaacccgaaccccggtaaccgggtaccccgtaaccggtttcccggtttacccccgtttccccccggttaccgggacccccttacccccgttaccccgtaacccgtaaacggtacccggaccccgtacccggttccgggtaccggggggtacccctaaccgggtacccgggacccccggggtccccgggttcggggtaccccggttcccgggtcccccgggtttaacggggttacccggtaaacccgggttaacccgttttaacccgggttaacccggttaacgggttttaaacccggtaacccggttaacccggg

SEQ ID NO: 293575 - DNA, 669 bp, Homo sapiens
  misc_feature: GYAE6OF01BLB48.16.10.A10.1.454.CMB.1.raw
  modified_base (302)..(302): a, c, t, g, unknown or other
  misc_feature (302)..(302): n is a, c, g, or t
  modified_base (666)..(666): a, c, t, g, unknown or other
  misc_feature (666)..(666): n is a, c, g, or t
  modified_base (668)..(669): a, c, t, g, unknown or other
  misc_feature (668)..(669): n is a, c, g, or t
tcagtgtactactccacgaccggtgctcgatttagcgtcgatctcaggggtccctgagactctcctgtgcagcctctggattccacccttagcggttatgccatgagctgggtccgccaggcctcccagggaagggctggagtgggtctcaacttttagtggtagtggtggtcacgcctactacgcagagtccgtgaagggccattccaccatctccagagacacttccgagaacacgctgtatctgcgaatgaacagcctagagagtcggaggacacggccatatattactgtgacgaaanactcctgacggcctatacccacctcagtcagtcgttcggttcccgaccccggtggggacccaacggggtaaccccgtgggtacccacccgttccgtcccctacgtaccgtcccctacccaacccggaaccgggcccctacgttccccggttacccctttccccccggtcggaccccctacccccttcccctacccgaacgaccgaccctacccgtcgggtccggggaccaccgaccggcccggcccgtggggcctcgaccgttacgggtaccgtaacggtaccttaccgtacccggtacgtacgtacctacggtacggacgggacgggtccgttagggaccggtacgggcgtacagttagcatngnn

SEQ ID NO: 293576 - DNA, 632 bp, Homo sapiens
  misc_feature: GYAE6OF01CL7RN.16.10.A10.1.454.CMB.1.raw
  modified_base (308)..(308): a, c, t, g, unknown or other
  misc_feature (308)..(308): n is a, c, g, or t
  modified_base (344)..(344): a, c, t, g, unknown or other
  misc_feature (344)..(344): n is a, c, g, or t
  modified_base (401)..(401): a, c, t, g, unknown or other
  misc_feature (401)..(401): n is a, c, g, or t
  modified_base (484)..(484): a, c, t, g, unknown or other
  misc_feature (484)..(484): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctctgacggcctcctttgagttgacacagcccaccctcggtgtcagtgtccccaggacagacggccaggatcacctgctcttcagatgctattgccaaggcaaatatgctttcgttggaaccagcaaggaacgccgaggccacggccctggtgggtgtgaatataataaagacaanacaagacggtcccagagggactcccgtgggcattcnctcggctccgagctacgaggggactacgagtacgtacgttacgaacctagtccgggnggacgtcacgggctaaggaagaacggtagggtactaacgttaagttacgtcgtactacggtactagaaccaaacaacctaccncggaccgagggtacccgggtgttccggggacgggaacgggaacccgaacgccggtacgacccggttccgtaggccgtacacggaccctaaggggccctaccgggcccccgtaccggtcaaccgttccctccggttcccccggtacccc

SEQ ID NO: 293577 - DNA, 778 bp, Homo sapiens
  misc_feature: GYAE6OF01BBMVQ.16.10.A10.1.454.CMB.1.raw
  modified_base (281)..(281): a, c, t, g, unknown or other
  misc_feature (281)..(281): n is a, c, g, or t
  modified_base (286)..(286): a, c, t, g, unknown or other
  misc_feature (286)..(286): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagcgtgggtccgcaggctaccgaggggaagggctggagtggtctctaactttagtggtagtggtgtcacgcctacgtacgcagacgtccgtgaacgggcctatccaccatctaccagacgaccacgttaccgganaaccncgcttgtactctgacgtaatcgaacagccctaggagtagtcggaacggaccacggacctaatattacttacgtaggtacgaacgtaaaagtccgtccgtaggaaccgtcccttaaacgtacccaccttacgaacgttccgtaacggtccgtttacgggttaccccggaaccccggttacggggacccgaacgggtaaccccgtcggtaccccgaacccgttcccgtcccgtaccacccgtccccgtaacccgtaacccggaaccgggtcccctaacggtttcccccggttcccccgtttccccccggtaacggcccccctaaccccgttacccctaacccggtaaccgtaccgtaccctaacccggttcgggacccggggtacaccgggacccggtcccgggcccggtcgggtacccgttccggtcccggttacgggtaacgtaaccgggttaccttacccggtaccggtaacggttaacgtaccggtacgg

SEQ ID NO: 293578 - DNA, 707 bp, Homo sapiens
  misc_feature: GYAE6OF01CVTL2.16.10.A10.1.454.CMB.1.raw
  modified_base (239)..(239): a, c, t, g, unknown or other
  misc_feature (239)..(239): n is a, c, g, or t
tcagtgtactactccacgaccggtgctcgatttagcgtcgatctcgaggggggtgggtccaggaggcagaactctgggtgtctcaccatggcctggatccctctacttctccccctctcactctctgcacaggctctgacggtcctcctttgagttgacacacgtcccacccgtcggtgtcaggtccgtccccgaggacaggaccggccgaggtactccaccgttcgccttcttcaagntacgctattccgaccgaaaggactaatacgttcgtactttcgttacggaccagaccgaagacgaccgacggccgaaccggtcccgtggtcggtaggtagtaattaacgtaaagtaaacgaaccgacacgaacggaccgggccctacggacgggtacgtacccggtcgggtactaccgttcgtccgtcggtacctcgaacgtccgtacggacgggtaacaccgtagtacgtaccggttacacggtacggttacgggcggtacgtaccgacggagtaacggaacggtaaggggtaacgtaggtaacttagttacgtcgtatcgtacgtacgaaccaactaccgacgtcgtacgtacggtcgggttacggtaccgggtaagggacggttaaccgagttccgccgtacgtccgtcggacgtcgaaccgcgtacgcccgaccgtccgtcgtcaccgtccgtaccgtcccgtcg

SEQ ID NO: 293579 - DNA, 890 bp, Homo sapiens
  misc_feature: GYAE6OF01DQADL.16.10.A10.1.454.CMB.1.raw
  modified_base (295)..(295): a, c, t, g, unknown or other
  misc_feature (295)..(295): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagcgtgggtcccgccgaggcctccgaggggaaggggctgggaggtgggtctctaacgttttaggtggtagtggtggtcacgcctacgtacgcaggacgtccgtggaacgggccgtattccaccactcctccagacacctacttccgaanaaccacgtcttgtactcgtgacgaatagaaccaggccgtaggacggtacggtacggaacggtaccgaccgggtacctaattacgtttaagttaccgtaggttacgaaacggtaaagtcgtaccgttagggaccgtacccttaacctaacccgtacccttacgacgttaccgacggttccgtttaccgggttaccccgggacccccgggttacggggaccccggtaaacccggggtaaccccgttccgggttaccccgttaccccgggtttcccttaccccgtccgtacccgtaccccctaccccgaaacccggtaaaccccggtaccccgttacccggttcccccggtttaccccgtttccccccggtcggtacccccctaacccccgttaccccgtaacccggtaaccgacccggttacccctaacccggggttccgggtaccgggggtaccctaacccggtacccggggccccgggttacccgggtccggggtcccggttccgggtcccgttaaccgggtaaaccccgtaacccgggttaacccgttaacccggttacccgggttaaaccgttaccggtaaccggtacccggg

SEQ ID NO: 293580 - DNA, 779 bp, Homo sapiens
  misc_feature: GYAE6OF01DETAB.16.10.A10.1.454.CMB.1.raw
  modified_base (737)..(737): a, c, t, g, unknown or other
  misc_feature (737)..(737): n is a, c, g, or t
tcagtgtactactccacgaccggtgctcgatttagcgtcgatctcagggtcttcgtggctcacgtccaccaccacgcatgtgacctcaggggtccctgagactctcctgtgcacgcctctggacttcaccgttagcggttatcgccatgagcgtcggggtcccgccgtacggcctaccggagggggaacggggtcgtagggaggtgggtcttacttaacgtttttaggtgggttaggtggtggttaccaccggtcctacgtaccgcgtaggtaacgttccggtaggaacggggtcctattccaaccacgtcctccgaagacgtacctaaccgttaccgaaggaaacctaccgtcttacgtataccgtaggacgtaaacgttacgaaacgacggtaccgtagggacgtacggtaccgaggtacgacggactaagttatactacgtgtagaacgtaacgtcctacggttaggaaccctacgtttaacaccccgtactacgtacgtaacgccgtggtttacccgggtaccccggtccgggtaccgggacccgacgggttaacccttccggtaccctaccccggttccttacccgacgtacccgtaccctacccggtaaccgtacccggtaccttccggttcccttacccccggtttcccgcgacccccgtaaccctccaaccggacaccgtccgaccgtcgggaccggtaccacggacgcccggtcggccgtcggtaccnccgtagtccgtacggtacttacctcgggtaatcgtcgtacgg

SEQ ID NO: 293581 - DNA, 779 bp, Homo sapiens
  misc_feature: GYAE6OF01BQ10X.16.10.A10.1.454.CMB.1.raw
  modified_base (401)..(401): a, c, t, g, unknown or other
  misc_feature (401)..(401): n is a, c, g, or t
tcagtgtactactccacgaccggtgctcgatttagcgtcgatctcagggggtgggtccagggagggcagaactctggggtgtctcaccatggcctggatccctctacttcctccccctcctcactctctgcacaggctctgacggccttccgttggagttcgacacgacgcccacccgtgggtctcgtagtccgtccccgaggaccgaggacggccgaggacttaccacgtcgtctcttacgagtattcgctagttcgaccgaaggactaatatcgtcttcgttacggtacacgctaacggacgccggacggaccgtcgggtcccgtggtcgggtggtagtaagtaagtaaataaacggaccaacgaaccgaggccgtaccgtacgacgggtacctccggngggacgttacttcgtcgccgtactaccgacgtccgtacggacgggtacgaacgcggtactacggtacgaccggtcgtcgggacggtacgtccggaagggtaccaagggaacggtaacggggtagggtaacttaacgtaacgttacggttacgtacgtacggttacacgggtaacccaaacttacggagtcgttaacggacgggttccgggttagggacccggacgggaaccgggtaaccgtaacggtccggtaaccgggttacccttacgggacccgttaccggacttaccccgggaaccggtacgggcccccttaccccggttccccggttaacggccttaaccccggtcccggttcccccgttccccggtaccccg

SEQ ID NO: 293582 - DNA, 826 bp, Homo sapiens
  misc_feature: GYAE6OF01AY2WU.16.10.A10.1.454.CMB.1.raw
  modified_base (128)..(128): a, c, t, g, unknown or other
  misc_feature (128)..(128): n is a, c, g, or t
  modified_base (131)..(131): a, c, t, g, unknown or other
  misc_feature (131)..(131): n is a, c, g, or t
  modified_base (186)..(186): a, c, t, g, unknown or other
  misc_feature (186)..(186): n is a, c, g, or t
  modified_base (251)..(251): a, c, t, g, unknown or other
  misc_feature (251)..(251): n is a, c, g, or t
tcagtgtactactccacgaccggtgctcgattttagcgtcgatctcagggggtgggtccaggaggcagaactcgtgggtgtctcaccatggcctgaatccctctacttcctccccctctcactctctncanagctcgtggacggtcccttccgtttgagttgaacacgacgcccctacccgtggtntcgagtccgtccccgaaggtaccaggaccggccgaaggtactccgaccgtgtccttcttacaagntgctattcgaccgaaggactaagttgtcgttctttacgttacgaccagcgaaggacgccgaacggcccgacggtccgtggttaggtggtacgtaataaataacgaaacgaccaacgacgacggtaccgcccgtaggaacggtaccgtcccggtgggaccgttactttccgtacggtcgtacctccggagcccggtaggaaccgggtactacgtaacgtccgtaacggtacgtaaaccggtcggtacgggtacggaccgtacggacgggaacgaaacgggaaggtaccggggttagggtaacttaccttaaacggttgtacggttaacgtacgtaaccgtacgaaaaccccgtaaccaccggttacgtacccggacggtacggggttacgggtttaccggggaccgggacgggttaacccgaaggtacccgttccggtaaccgtaaccggttccggtaacccggttccgaacccggtacccggaccccggtaaccgggttcccccttaccccggggtccccgttccgtaccccgtttacccgtcccggtttccccccggtacccccggttaccccg

SEQ ID NO: 293583 - DNA, 506 bp, Homo sapiens
  misc_feature: GYAE6OF02HMUT1.16.10.A10.1.454.CMB.1.raw
  modified_base (324)..(324): a, c, t, g, unknown or other
  misc_feature (324)..(324): n is a, c, g, or t
tcagtgtactactccacgaccggtgctcgatttagcgtcgatctcaggggtgggtccaggaggcagaactctgggtgtctcaccatggcctggatccctctacttctcccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggcccctgtggtggtgatatataaagacacacagaggccctcagggatccctgggcgattcnctggctccagctcagggacgacagtcacgttgaccatcggtggagtccaggcagaagacgagggtgactattactgtcagttctgcaaacaccactgcagcggtgttcggcggaggaccaagctgaccgtctgcgtcacgcccaaggcctcgcccccgtcggcacctctcgttccctacccc

SEQ ID NO: 293584 - DNA, 505 bp, Homo sapiens
  misc_feature: GYAE6OF02FVKLH.16.10.A10.1.454.CMB.1.raw
tcagtgtactactccacgaccggtgctcgatttagcgtcgatctcagggggtgggtccaggaggcagaactctgggtgtctcaccatggcctggatccctctacttctcccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggcccctgtggtggtgatatataaagacacacagaggccctcagggatccctgggcgattctctggctccagctcagggacgacagtcacgttgaccatcggtggagtccaggcagaagacgagggtgactattactgtcagtctgcaaacaccactgcagcggtgttcggcggagggaccaagctgaccgtccgtgcgtcagcccaaggcctcgcccctcggtccactctcgtcccgtccc

SEQ ID NO: 293585 - DNA, 562 bp, Homo sapiens
  misc_feature: GYAE6OF02G94UM.16.10.A10.1.454.CMB.1.raw
  modified_base (361)..(361): a, c, t, g, unknown or other
  misc_feature (361)..(361): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctnagtcagctggttcaccctgggccagggaaccctggtcaccgtctcctcacgcctccaccaacgggcccatccggtccttccccgtcggccaccctccctccaacgacgccacctccgtcggggccacgacgccggcccgtcggggcctcggcccgttcggtccgaacgggtacctaccgttcccggaggttacgtactacg

SEQ ID NO: 293586 - DNA, 499 bp, Homo sapiens
  misc_feature: GYAE6OF02JCPH8.16.10.A10.1.454.CMB.1.raw
  modified_base (327)..(327): a, c, t, g, unknown or other
  misc_feature (327)..(327): n is a, c, g, or t
  modified_base (368)..(368): a, c, t, g, unknown or other
  misc_feature (368)..(368): n is a, c, g, or t
  modified_base (398)..(398): a, c, t, g, unknown or other
  misc_feature (398)..(398): n is a, c, g, or t
  modified_base (444)..(444): a, c, t, g, unknown or other
  misc_feature (444)..(444): n is a, c, g, or t
  modified_base (495)..(495): a, c, t, g, unknown or other
  misc_feature (495)..(495): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaaggcaatatgcttcttggtaccagcagaagccaggccaggccccctgtggtggtgatatataaagacacacagaggccctcagggatccctggcgattcnctggctccagctcagggacgacagtcacgttgaccatcggngagtccaggcagaagcgaggtgactatacngtcagtctgcaacaccactgcagcggtgtcggcggaggaccaagcngaccgtctggcgtcagccaaggcctagcccctgggtccactctcgttcccncccg

SEQ ID NO: 293587 - DNA, 502 bp, Homo sapiens
  misc_feature: GYAE6OF02GMJF8.16.10.A10.1.454.CMB.1.raw
  modified_base (458)..(458): a, c, t, g, unknown or other
  misc_feature (458)..(458): n is a, c, g, or t
tcagtgtactactccacgaccggtgctcgatttagcgtcgatctcagggggtgggtccaggaggcagaactctgggtgtctcaccatggcctggatccctctacttctcccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggccccctgtggtggtgatatataaagacacacagaggccctcaggggatccctgggcgattctctggctccagctcagggacgacagtcacgttgaccatcggtggagtccaggcagaagacgagggtgactattactgtcagtctgcaaacaccactgcagcgtgttcggcggagggaccaagctgaccgtcngcgtcagcccaaggctgcccctggtccactctcgttcccgcccc

SEQ ID NO: 293588 - DNA, 502 bp, Homo sapiens
  misc_feature: GYAE6OF02F9SHG.16.10.A10.1.454.CMB.1.raw
  modified_base (415)..(415): a, c, t, g, unknown or other
  misc_feature (415)..(415): n is a, c, g, or t
tcagtgtactactccacgaccggtgctcgatttagcgtcgatctcagggggtgggtccaggaggcagaactctgggtgtctcaccatggcctggatccctctacttctcccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggcccctgtggtggtgatatataaagacacacagaggccctcaggggatccctgggcgattctctggctccagctcagggacacagtcacgttgaccatcggtggagtccaggcagaagacgagggtgactattactgtcagtctgcaaacnccactgcagcggtgttcggcggagggaccaagctgaccgtctgcgtcagcccaaggcctgcccctcggtccactctcgtcccgtccc

SEQ ID NO: 293589 - DNA, 515 bp, Homo sapiens
  misc_feature: GYAE6OF02ISL1T.16.10.A10.1.454.CMB.1.raw
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggccccctgtggtggtgatatataaagacacacagaggccctcagggatccctgggcgattctctggctccagctcagggacgacagtcacgttgaccagtcgggtggagtccaggcagaagacggagggtgacgtattactgtcagtctgacaaacaccactgcagcggtgttcggcggagggaccaagctgaccgtctgcgtcacgccaaggcctcgcccccgtcggccactcgtcgtccccgtccccg

SEQ ID NO: 293590 - DNA, 507 bp, Homo sapiens
  misc_feature: GYAE6OF02F1MK7.16.10.A10.1.454.CMB.1.raw
  modified_base (390)..(390): a, c, t, g, unknown or other
  misc_feature (390)..(390): n is a, c, g, or t
  modified_base (400)..(400): a, c, t, g, unknown or other
  misc_feature (400)..(400): n is a, c, g, or t
  modified_base (416)..(416): a, c, t, g, unknown or other
  misc_feature (416)..(416): n is a, c, g, or t
tcagtgtactactccacgaccggtgctcgatttagcgtcgatctcagggggtgggtccaggaggcagaactctgggtgtctcaccatggcctggatccctctacttctcccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggcccctgtggtggtgatatataaagacacacagaggccctcagggatccctgggcgattctctggctccagctcagggacgacagtcacgttgaccatcggtgagtccaggcagaagacgagggtnactagttacngtcagtctgacaaacnccactgcagcggtgttcggcggagggaccaagctgaccgtctgcgtcacgtcccgaagctcgcccctcggtccactcgtcgtcccgtcccg

SEQ ID NO: 293591 - DNA, 562 bp, Homo sapiens
  misc_feature: GYAE6OF02JA5BE.16.10.A10.1.454.CMB.1.raw
  modified_base (400)..(400): a, c, t, g, unknown or other
  misc_feature (400)..(400): n is a, c, g, or t
  modified_base (426)..(426): a, c, t, g, unknown or other
  misc_feature (426)..(426): n is a, c, g, or t
tcagtgtactactccacgaccggtgctcgatttagcgtcgatctcagggggtgggtccaggaggcagaacttcttgggtgtctcaccagtggcctggactccctctacttctcccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggcccaggccccctgtggtggtgatatataaaagacacacagaggccctcagggatccctgggcgattctctggctccagcctcgagggacgacagtcacgttgaccatccgggtgagtccaggcagaagagagggtnactattactgtcagtctagacaaacnccactgcagcggtagtcggcgggaggaccgaaagcgtcgaccgtcctacggccgtccgaacggccccgaaaggtccctaccggccccccgttaccgggtccctaacccgttccgttcccggttacccctacccccg

SEQ ID NO: 293592 - DNA, 527 bp, Homo sapiens
  misc_feature: GYAE6OF02FZ1ND.16.10.A10.1.454.CMB.1.raw
  modified_base (306)..(306): a, c, t, g, unknown or other
  misc_feature (306)..(306): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggcccctgtggtggtgatatataaagacacacagaggccctnagggatccctgggcgattctctggctccagctcagggacgacagtcacgttgaccagtcggtggagtccaggcagaagacgagggtgactattactgtcagtctgacaaacaccactgcagcggtgttcgggcggagggaccaaggctgacccgtctggccgtcgacgcccgaaggcctacggccccctcggtccaccgtccgttccgttcccctaccccg

SEQ ID NO: 293593 - DNA, 551 bp, Homo sapiens
  misc_feature: GYAE6OF02JUL21.16.10.A10.1.454.CMB.1.raw
  modified_base (377)..(377): a, c, t, g, unknown or other
  misc_feature (377)..(377): n is a, c, g, or t
  modified_base (406)..(406): a, c, t, g, unknown or other
  misc_feature (406)..(406): n is a, c, g, or t
  modified_base (504)..(504): a, c, t, g, unknown or other
  misc_feature (504)..(504): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggcccctggtggtggtgatatataaaggactacacagacggcccctcgagggacttcccgtggggcgtaacttctcgtggcctccagctcgaggacgacagtcacgttgaccngtcggtgagtccaggcagagatggaggtnactagtacgtgctagtcgtgactaaacaccgactcggacacggcggttggtaccgggacgggtacggaccaagtcgtacgtaccgttacgcgtccgtnaccgaccgtacggccgccgcccgtcggtcacgtccgttcccgtcccg

SEQ ID NO: 293594 - DNA, 505 bp, Homo sapiens
  misc_feature: GYAE6OF02G0X5S.16.10.A10.1.454.CMB.1.raw
  modified_base (390)..(390): a, c, t, g, unknown or other
  misc_feature (390)..(390): n is a, c, g, or t
  modified_base (490)..(490): a, c, t, g, unknown or other
  misc_feature (490)..(490): n is a, c, g, or t
tcagtgtactactccacgaccggtgctcgatttagcgtcgatctcagggggtgggtccaggaggcagaactctgggtgtctcaccatggcctggatccctctacttcctccccctcctcactctctgcacaggctctgaggcctcctttgagttgacacagccaccctcggtgtcagtgtcccccaggacagacggccaggatcacctgctcttcagatgcattgccaaaggcaatatgcttcttggaccagcagaagccaggccaggccccctgtggtggtgatatataaagacacacagaggcctcaggatccctgggcgattctctggctccagctcaggacgacagtcacgttgaccagtcggtgacgtcaggcagaagacgaggngactatactgtcgagtctgcaaacacactgcagcggtgtcggcgaggaccaagctgaccgtctgcgtcgagcccgaaggcctcgccccgtacgccgtacnctcgtccgtaccccg

SEQ ID NO: 293595 - DNA, 506 bp, Homo sapiens
  misc_feature: GYAE6OF02HC7H2.16.10.A10.1.454.CMB.1.raw
  modified_base (394)..(394): a, c, t, g, unknown or other
  misc_feature (394)..(394): n is a, c, g, or t
  modified_base (449)..(449): a, c, t, g, unknown or other
  misc_feature (449)..(449): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaaggccccctgtggtggtgatatataaagacacacagaggccctcagggatccctgggcgattctctggctccagctcagggacgacagtcacgttgaccatcggtggagtccaggcagaagacgagggtnactattactgtcagtctgcaaacaccatgcagcgtgttcggcggaggaccaagcngaccgtctgcgtcacgccaaggcctcggccccctcggccacgtctcgttcccgcccg

SEQ ID NO: 293596 - DNA, 563 bp, Homo sapiens
  misc_feature: GYAE6OF02JBMFZ.16.10.A10.1.454.CMB.1.raw
  modified_base (298)..(298): a, c, t, g, unknown or other
  misc_feature (298)..(298): n is a, c, g, or t
  modified_base (367)..(367): a, c, t, g, unknown or other
  misc_feature (367)..(367): n is a, c, g, or t
  modified_base (558)..(562): a, c, t, g, unknown or other
  misc_feature (558)..(562): n is a, c, g, or t
tcagtgtactactccacgaccggtgctcgatttagcgtcgatctcaggggtccctgagactctcctgtgcagcctctggattcacccttagcggttatgtcatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagntcctgaggcctataccactcagtcagctggttcgacccctgggccagggaaccctggtcaccgtctccncagccctccaccagggcccatcgtccttcccctggccaccctccctccaacgacgccaccctcgtcggggccacgacgccggcccgtcgggcctcggcccgtggtaccgaacgggtaccttaccgttaccggaacgttaacgtaccacgtggacggcggggtctcgggaccgaacggccgacgacgtacgnnnnnc

SEQ ID NO: 293597 - DNA, 522 bp, Homo sapiens
  misc_feature: GYAE6OF02IUSBV.16.10.A10.1.454.CMB.1.raw
  modified_base (307)..(307): a, c, t, g, unknown or other
  misc_feature (307)..(307): n is a, c, g, or t
  modified_base (327)..(327): a, c, t, g, unknown or other
  misc_feature (327)..(327): n is a, c, g, or t
  modified_base (400)..(400): a, c, t, g, unknown or other
  misc_feature (400)..(400): n is a, c, g, or t
tcagtgtactactccacgaccggtgctcgatttagcgtcgatctcaggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaaggcaaatatgcttcttggtaccagcagaagccaggccaggcccctgtggtggtgatatataaaagcacacagaggccctnagggatccctgggcgattcnctggctccagctcagggacacagtcacgttgaccatcggtagatccaggcagaagacgagggtgactattacngtcagtctgcaaacaccactgcagcggtgttcggcggaaggccaaagctagaccgtctgccgtcacgccccaaagggcctcggcccccctgggtacctaacgtccttagttcccccaacccg

SEQ ID NO: 293598 - DNA, 504 bp, Homo sapiens
  misc_feature: GYAE6OF02GFBGH.16.10.A10.1.454.CMB.1.raw
  modified_base (400)..(400): a, c, t, g, unknown or other
  misc_feature (400)..(400): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttctggtaccagcagaagccaggccaggcccctgtggtggtgatatataaagacacacagaggccctcagggatccctgggcgattctctggctccagctcaagggacgacagtcacgttgaccatcggtgagtccaggcagaagacgagggtgactattacngtcagtctgacaaacaccactgcagcggtgttcggcggagggacaagctgaccgtctgcgtcagcccaagcctgcccctcggtccacctctcgttcccaccccg

SEQ ID NO: 293599 - DNA, 550 bp, Homo sapiens
  misc_feature: GYAE6OF02GWH8Q.16.10.A10.1.454.CMB.1.raw
  modified_base (297)..(297): a, c, t, g, unknown or other
  misc_feature (297)..(297): n is a, c, g, or t
  modified_base (340)..(340): a, c, t, g, unknown or other
  misc_feature (340)..(340): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacngcctgagagtcgaggacacggccatatattactgtgcgaaagntcctgacggcctataccactcagtcagctggttccgaccccgtgggccgacgggaaccctcggtccgaccgtctcctcacgcctccaccgaacggcccactcgtccttccccgtcgccaccctcctaccaacgcgccacctcgtcgggcacgcgcggccgtcgggctcgccgtcgtcgacggtacgtaccgttccggagtacgtactacg

SEQ ID NO: 293600 - DNA, 584 bp, Homo sapiens
  misc_feature: GYAE6OF02F638T.16.10.A10.1.454.CMB.1.raw
  modified_base (157)..(157): a, c, t, g, unknown or other
  misc_feature (157)..(157): n is a, c, g, or t
  modified_base (200)..(200): a, c, t, g, unknown or other
  misc_feature (200)..(200): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccnccaggctccagggaagggctggagtgggtctcaactttttagnggtagtggtggtcacgcctactacgcagagtccgtgaagggccgattcaccatctccagagacacttccgagaacacgctgtatctgcgaaatgaacagcctgagagtcgaggacacggccatatattactgtgcgaaagatcctgaggcctataccactcagtcagctggttcgaccccgtgggccgacgggaaccctggtcaccgtctcctcacgccctccaccgaacggcccacgtccggtccttccccgtcggccctacccgtccctaccgaacgacgacctacccgtcgtcggggccacgacgccggcccgtcgggcctcggcccgttcggtaccgaacggtaccttaccgttacccggacggttacgtacgtaaccgg

SEQ ID NO: 293601 - DNA, 530 bp, Homo sapiens
  misc_feature: GYAE6OF02GMHXL.16.10.A10.1.454.CMB.1.raw
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggcccctgtggtggtgatatataaagacacacagaggccctcagggatcccgtgggcgattctctggctccagctcgagggacacagtcacgttgaccatcgggtggagtccaggcagaagacgagggtgactagttactgtcagtctgacaaacaccactgcagcggtgttcggcggacgggaccaagctacgaccgtcctgccgtcgacgcccgaaggtcctccgcccccgtcggtccaccgtccgttccgttccccgtccccg

SEQ ID NO: 293602 - DNA, 505 bp, Homo sapiens
  misc_feature: GYAE6OF02I2HS4.16.10.A10.1.454.CMB.1.raw
  modified_base (408)..(408): a, c, t, g, unknown or other
  misc_feature (408)..(408): n is a, c, g, or t
  modified_base (415)..(415): a, c, t, g, unknown or other
  misc_feature (415)..(415): n is a, c, g, or t
  modified_base (447)..(447): a, c, t, g, unknown or other
  misc_feature (447)..(447): n is a, c, g, or t
tcagtgtactactccacgaccggtgctcgatttagcgtcgatctcagggggtgggtccaggaggcagaactctgggtgtctcaccatggcctggatccctctacttctcccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggccccctgtggtggtgatatataaagacacacagaggccctcagggatcccgtgggcgattctctggctccagctcagggacgacagtcacgttgaccatcggtgagtccaggcagaagacgagggtgactatactgtcagtcngcaaacnccactgcagcggtgttcggcggagggacagcngaccgtctgcgtcacgccgaaggctcgccccgtcggtccactcctcgtcccctacccg

SEQ ID NO: 293603 - DNA, 540 bp, Homo sapiens
  misc_feature: GYAE6OF02HWRZ2.16.10.A10.1.454.CMB.1.raw
  modified_base (535)..(540): a, c, t, g, unknown or other
  misc_feature (535)..(540): n is a, c, g, or t
tcagtgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaaacacgctgtatctgcgaatgaacagcctgagagtcgaggacacggccatatattactgtgcgaaagatcctgaggcctataccactcagtcagctggttcgacccgtgggccagggaaccctggtcaccgtctcctcacgcctccaccgaacgggcccatccggtcctttccccctcggccacccctcctccaaacgacgccacctccgtcgggggcacgacgccgggccctcgggctcgccgtggtcaacggacttaccttccagtagtacacgtgacgcgggctggacgaaggcgcagtgnnnnnn

SEQ ID NO: 293604 - DNA, 524 bp, Homo sapiens
  misc_feature: GYAE6OF02IO66M.16.10.A10.1.454.CMB.1.raw
  modified_base (398)..(398): a, c, t, g, unknown or other
  misc_feature (398)..(398): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggccccctgtggtggtgatatataaagacaacacagaggccctcgagggatcccgtgggcgattctctggctccagctcagggacgacagtcacgttgaccagtcggtggagtccgaggcagaagacgagggtnactattactgtcagtctgactaaacaccactgcagcggtgttcggcggagggaccagctacgaccgtctgcgtcacgcccaaggcctacgcccccgtacggtccacgtcgtccgttcccgtccccg

SEQ ID NO: 293605 - DNA, 565 bp, Homo sapiens
  misc_feature: GYAE6OF02H91CO.16.10.A10.1.454.CMB.1.raw
  modified_base (353)..(353): a, c, t, g, unknown or other
  misc_feature (353)..(353): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcaccttagcggttatgccatgagctgggtccgccaggctccagggaaggggctggagtgggtctcaacttttagtggtagtgggtggtcacgcctactacgcagagtccgtgaagggccgattcaccatctccagagacacttccgagaacacgctgtatctgcgaatgaacagcctgagagtcgaggacacggcatatattactgtgacgaaagctctgacggcctanaccacctcagtcagctcgggttccgaccccgtcgggccgacgggacccgtcggtcaccgtctcctcacgcctccgggggaccacggccactccgtcctcccctcggccaccctccctccaacgacgccaccctcgtcggggcacgacggccggcccgtcgggccgtcgccgtcggtcgacggtacctaccgttccggacgttacgtactacg

SEQ ID NO: 293606 - DNA, 537 bp, Homo sapiens
  misc_feature: GYAE6OF02IQ2X7.16.10.A10.1.454.CMB.1.raw
  modified_base (358)..(358): a, c, t, g, unknown or other
  misc_feature (358)..(358): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccgagggaaggggctggagtgggtctcaacttttagtggtagtggtggtcacgcctactacgcagagtccgtgaagggccattcaccatctccagagacacttccgagaaacacgctgtatctgcgaatgaacagcctgagagtcgaggacacgccatatatactgtgcgaaagatcctgagctataccacctnagtcagctggttcacccgtgggccacgggaaccctggtcaccgtctctcacgcctccacgaacggcccatcggtcctccctgccaccctcctaccaacgacgcacctcgtcggggcaacgcgcggcccgtgggcctggtccctggtacaacggtactacctccggacgttacgactacg

SEQ ID NO: 293607 - DNA, 552 bp, Homo sapiens
  misc_feature: GYAE6OF02HJB5G.16.10.A10.1.454.CMB.1.raw
  modified_base (547)..(547): a, c, t, g, unknown or other
  misc_feature (547)..(547): n is a, c, g, or t
  modified_base (549)..(552): a, c, t, g, unknown or other
  misc_feature (549)..(552): n is a, c, g, or t
tcagtgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcacccgtgggccaggggaaccctggtccaccgtctcctcacgcctccacccgaagggcccagtccggtccttccccctcggccacccctcctcccaacgacgcaccctcgtcggggcaccgacgccgcccgtgggctcggccgtcggtcgaacggtacctaccttaccgacgttagtacacgtgaggccgggtctcggcgaaggcgacgactagangnnnn

SEQ ID NO: 293608 - DNA, 516 bp, Homo sapiens
  misc_feature: GYAE6OF02HX6GV.16.10.A10.1.454.CMB.1.raw
  modified_base (419)..(419): a, c, t, g, unknown or other
  misc_feature (419)..(419): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctccttttgagttgacacagccaccctcggtgtcagtgtccccaggacagacggccaggatcacctgctcttcagatgcattgccaaggcaatatgcttcttggtaccagcagaagccaggccaggcccctgtggtggtgatatataaagacacacagaggccctcagggatccctgggcgattctctggcctccagctcagggacgacagtcacgttgaccagtcggtggagtccaggcagaagacgaggtgactattactgtacagtctgcaaacnccactgcagcggtgtcggcggagggaccaagcgtgaccgtctgcgtcgacgcccgaaggcctcgcccccgtcggtccacgtctcgttccctaccccg

SEQ ID NO: 293609 - DNA, 609 bp, Homo sapiens
  misc_feature: GYAE6OF02ITPDS.16.10.A10.1.454.CMB.1.raw
tcagtgtactactccacgaccggtgctcgatttagcgtcgatctcagggggtgggtccaggaggcagaactctgggtgtctcaccatggcctggatccctctacttctcccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggcccctgtggtggtgatatataaagacacacagaggccctcagggactcccgtgggcgtattcctctggctccagctcgagggacgacagtcacgttgaccagtcgggtaggacgtccgaggacaaggaacggacggtagggtagtaacgttaacgttacgtgtacgtagtctacgaaaccaaaccaccacgtgaccgtaggtccgggtttggtccggggacgggaaccgggaaccgaacggtacgtaccggtacccgttcgtcggtaccggtcgaacccggaccgaacggtcccgcccgtccccggttcggtccctaccgttccgttcccgtccccgtaccccg

SEQ ID NO: 293610 - DNA, 510 bp, Homo sapiens
  misc_feature: GYAE6OF02GFBOS.16.10.A10.1.454.CMB.1.raw
  modified_base (398)..(398): a, c, t, g, unknown or other
  misc_feature (398)..(398): n is a, c, g, or t
  modified_base (423)..(423): a, c, t, g, unknown or other
  misc_feature (423)..(423): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggcccctgtggtggtgatatataaagacacacagaggccctgagggactccccgtgggcgattctctggactccagctcgagggacgacagtcacgttgacctagtcggtgagtccaggcagaagacgagggtnactattactgtcagtctgacaaacnccatgcagcgtgtcggcggaggaccagctagaccgtctgcgtcacgcccaagcctcgccccgtggtccacgtcctccgtcccgtccc

SEQ ID NO: 293611 - DNA, 529 bp, Homo sapiens
  misc_feature: GYAE6OF02G2BCZ.16.10.A10.1.454.CMB.1.raw
  modified_base (410)..(410): a, c, t, g, unknown or other
  misc_feature (410)..(410): n is a, c, g, or t
  modified_base (429)..(429): a, c, t, g, unknown or other
  misc_feature (429)..(429): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggcccctgtggtggtgatatataaagacacacagacggccctacgagggatccccgtgggcgtattctctggctccagctcgagggacgacagtcacgttgaccagtcggtggagtccgaggcaagagacgagggagactattacngtacagtctagaccaaacncactgcaggtcgtgtccggaggacgggacaagcgtacgaccgtcgtgcgcgacgccaaggcctcggccccgtcggtccaccgtccgtcgtcccctacccg

SEQ ID NO: 293612 - DNA, 636 bp, Homo sapiens
  misc_feature: GYAE6OF02HHGKS.16.10.A10.1.454.CMB.1.raw
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttctggtaccagcagaagccaggccaggcccctgtcggtgtgatatataaagacacacagacgcctcaggctcctgggctatctcgtgctcagctcgagggacgacgacgtacacgttcgaccgtagtcggtcggacgtccgacggacgaaggaaacggacggagggtacgaacgttaacgttacgtgtaccgtagttccgttagaaccaaacgtacccaaccgttcgaccgtacggtccgggttcggttccggggaccgggaacggggtaacccgaaacggtccgtacggacccgttcccgtaggccggttacgaccggtacccggaacggtcccgttacccgaccccccggttcggtccccgtaaccgttccggttacccgttcccccgtacccccg

SEQ ID NO: 293613 - DNA, 592 bp, Homo sapiens
  misc_feature: GYAE6OF02FJS4N.16.10.A10.1.454.CMB.1.raw
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaactttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgacggcctatacccacctcagtcagtctggttccgaccccgtcggggccgacgggtaaccccgtcggtaccgacccgtcctccctccacgccctcccaccgaacgggcccaacgtccggtcccttcccccgtcggccaccccttccctacccaacgacgccacctcgtcggggccacgacgccggcccgtcgggcctcggccgtcggtaccgaacggtacctaccgttccgacgttacgtacgtacg

SEQ ID NO: 293614 - DNA, 557 bp, Homo sapiens
  misc_feature: GYAE6OF02II40N.16.10.A10.1.454.CMB.1.raw
  modified_base (407)..(407): a, c, t, g, unknown or other
  misc_feature (407)..(407): n is a, c, g, or t
  modified_base (426)..(426): a, c, t, g, unknown or other
  misc_feature (426)..(426): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggcccctgtggtggtgatatataaagacacacagacggccctcgagggactcccgtgggcgtattcgtctggctccagcctcgagggacgacagtcacgttcgaccagtcggtggacgtccgaggacagaaagacggagggtnactattacgtgtacagtcngacaaacaccactgcagcgtggttcggcgggacgaccgaaggcctaggacccgtctcggccgtacgacgcccgtaaggcccgtcggccccccgtcgggtcccaccgttccgttacccgttccctacccccg

SEQ ID NO: 293615 - DNA, 513 bp, Homo sapiens
  misc_feature: GYAE6OF02GYM3C.16.10.A10.1.454.CMB.1.raw
  modified_base (469)..(469): a, c, t, g, unknown or other
  misc_feature (469)..(469): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggcccctgtgtggtgatatataaagacacacagaggcctcgagggatccctgggcgattctctggctcagctcagggacgacagtcacgttgaccatcggtggagtccagccaagaagacgagggtgactaattactgtcagtctgacaaacaccactgcagcggtgttcgggcgggagggaccaaagctgaccgtcctgccgtnacgccaaaggcctcgccccctcggtccactcttcgtccccaccc

SEQ ID NO: 293616 - DNA, 593 bp, Homo sapiens
  misc_feature: GYAE6OF02FHPDO.16.10.A10.1.454.CMB.1.raw
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtcccccaggacagacggccaggatcacctgctcttcagatgcattgccaaggcaatatgcttcttggtaccagcagaagccaggccaggccccctggtaggtggtgatataataaagacacacagacggcccttcgacgggactcccgtgggcgtacttctcgtcggcctccgagcctcgaaggggaccgaacgagtccaacggtttcgaccagtcgggtggacgtccgaaggcgaagaaaggacggagggtacgacttattactgttcagtctgaccaacaccactgcaggcggtgttcggacggagggaccaagctcgaccgtcacgccgtcacggaccccgaacggtccgtacccggtccccccgttcgggtaccctaccgttccccgttacgttaccccccgttacccccg

SEQ ID NO: 293617 - DNA, 697 bp, Homo sapiens
  misc_feature: GYAE6OF02GJX5E.16.10.A10.1.454.CMB.1.raw
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaaggggccgattcaccatctccagagacacttccgagaacacgctgtatctgcgaatgaacagcctgagagtcgggagacgcgactatattatcgtgtcgaacgaatacctcgaggaccgtacttaaccaccgtacctacgtacgtcgacgtcggttcggtaccccgtccgggtacgggaccggtaaccggtaccggttcgtacccgaccgttccctacccgtacgacccgtccccgtaccgaaccgggacccggtaccctacggttcccgttacccccttcccgggtcgtacccctaccccttcccgtaaccgaaacggtccgtacccctacccggttcgggggaccgggtaccacgggtaccgggccccggtccgggtcgggtaccgtccggttccggttacgggtaaccggtaaccgttaccgttacccggtaccggtaaggttaccctagtaccggg

SEQ ID NO: 293618 - DNA, 541 bp, Homo sapiens
  misc_feature: GYAE6OF02FPP6Z.16.10.A10.1.454.CMB.1.raw
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactttgcgaaagatctgaggcctataccactcagtcagctggttcgaccctggggccagggaccctggtcaccgtctcctcacgcctccaccaacgggcccactccggtccttcccccgtgccaccctcctccaagcgcaccctctcggggcacgacgccggccctgggctcgcctcggtacgacggactacgttccgagtacgtacactacgg

SEQ ID NO: 293619 - DNA, 557 bp, Homo sapiens
  misc_feature: GYAE6OF02FSW98.16.10.A10.1.454.CMB.1.raw
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctgggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgacggcctataccacctcagtcagctggttcgacccctggggccagggaccctggtcaccgtctcctcacgcctccaccaagggcccagtccggtccttccccctggccaccctccctcccaagacgccacctcgtcggggcacacgcggcccgtcgggcctcggcccgtggtccgaacgggtactaccgttccgtacgttacgtactaccg

SEQ ID NO: 293620 - DNA, 582 bp, Homo sapiens
  misc_feature: GYAE6OF02GPCDN.16.10.A10.1.454.CMB.1.raw
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgacgaaagatcctagacggcctataccactcagtcagctggttccgaccccgtgggccgacgggaaccctggtccaccgtcctcctcacgccctccaccgaacgggcccacgtccggtccttcccccgtcggcccacccctccctaccaacgacgaccaccgtcgtcggggccacgacgccggcccgtcgggccgtcggccgttcggtacgaacggtaccttaccgttccggaacgttacgtacctacgg

SEQ ID NO: 293621 - DNA, 596 bp, Homo sapiens
  misc_feature: GYAE6OF02I9NK1.16.10.A10.1.454.CMB.1.raw
  modified_base (297)..(297): a, c, t, g, unknown or other
  misc_feature (297)..(297): n is a, c, g, or t
  modified_base (330)..(330): a, c, t, g, unknown or other
  misc_feature (330)..(330): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatcctccagagacacttccgagaacacgctgtatctgcaatgaacngcctgagagtcgaggacacggccatatattacngtgacgaaagatcctgacgcctaatacccacctcagtcagtctggttcccgaccccgtgggccgaacgggaaccctcggtccaccgtcctcctccacgccctaccaccgaacggcccacgtccgtcccttccccgtcggcctacccctcccgtaccgaacgaccgacctacccgtcgtcggggccaccgacggccggtcccgtcggggcctcggccgtcggtaccgaacggtaccttaccgttacccggtacgtacgtaccgtacg

SEQ ID NO: 293622 - DNA, 868 bp, Homo sapiens
  misc_feature: GYAE6OF02HYHM2.16.10.A10.1.454.CMB.1.raw
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtcgtccccaggacagacggccaggactcacctgctcttcagatgcattgccaaggcaatagtcgtcttcgttggtaaccagccaagaacgccaggccgacggcccctggtggtcggtggaactaagtaataaaaggacctaacgaacgaagacggaccctcgaacgggtactcccggtggggaccgtaacgtttccgtacggtcggtaccctacccgtacggtaccgttacggaacgggggaaccgtaaaccggtaacggtttacccgtaaaccgggttttacccggaaaccccgtaacgggtttaccgggggtaaccgggttaaccggtttacccgggaacgggttaaccgaaacggggttaaaacccgggaaacggggtaacggggggttacgtaaaccgtttaaaccggtttaacgtacggttacgtaaacgggttacccttaaacgaaaacccaccgttaaccgtacggtaccgtacggtccggggttacggtttaccggggaccggggtaacggggaaacctaccgggtaccgttaaccgggtaccccgttaccgtacgggtacccgtaaccggaaccggtaaccccggtaacggtccccgttacccggccccccggtttacgggtaccccgtaaaccgtttcccggttacccggttttacccccccggccccgttttaaccccggg

SEQ ID NO: 293623 - DNA, 596 bp, Homo sapiens
  misc_feature: GYAE6OF02ITX1M.16.10.A10.1.454.CMB.1.raw
tcagtgtactactccacgaccggtgctcgatttagcgtcgatctcagggggtgggtccaggaggcagaactctgggtgtctcaccatggcctggatccctctacttctcccctcctcactctctgcacaggctctgaggcctcctttgagttgacacagccaccctcggtgtcagtgtccccaggacagacggccaggatcacctgctcttcagatgcattgccaaggcaatatgtcttcttggtaccagcaagaagccgaggccacggcccctggtggtggtgatataataaagacacacaggacggccctgagggactcccgtagggcgtattctcgtggcctccgagctcgacgggacgacgtagtcgacgttcgaccgtagtcgggtaggacgtacccgaagggacaaggaaacggacgggtagggtagtaacttaagtttacgtggttacctagttacctacggtaaccaaaaccgaccacgtcgacgtaggtcgggtcggttcgggacgggacgggaaccagcgtacgaccgtcgtgcgtcacgacccgaagccgtccgccccgtcgtaccacgtcttccgtccctcccg

SEQ ID NO: 293624 - DNA, 545 bp, Homo sapiens
  misc_feature: GYAE6OF02FRF92.16.10.A10.1.454.CMB.1.raw
  modified_base (308)..(308): a, c, t, g, unknown or other
  misc_feature (308)..(308): n is a, c, g, or t
  modified_base (373)..(373): a, c, t, g, unknown or other
  misc_feature (373)..(373): n is a, c, g, or t
  modified_base (439)..(439): a, c, t, g, unknown or other
  misc_feature (439)..(439): n is a, c, g, or t
tcagtgtactactccacgaccggtgctcgatttagcgtcgatctcagggggtggggtccaggaggcagaactctgggtgtctcaccatggcctggatcccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggccccctgtcggtggtgatatataaagacacacagagcctnaggatcccgtggcgattctctggactccagctcgaggacgacgacgtctacgttcgacatcgggngagtccagccgagaagacgagggtgactatacgtgtcgagtctgaccgaaacaccactgacgaggnggtcgttcgggacgggtacggaaccgaacgctacgaccgttccacggcgtcgacgcccgaaggcctaccgccccgtcggacctacgtccttccgtcccctaccccg

SEQ ID NO: 293625 - DNA, 583 bp, Homo sapiens
  misc_feature: GYAE6OF02GKLHL.16.10.A10.1.454.CMB.1.raw
  modified_base (200)..(200): a, c, t, g, unknown or other
  misc_feature (200)..(200): n is a, c, g, or t
  modified_base (340)..(340): a, c, t, g, unknown or other
  misc_feature (340)..(340): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagnggtagtggtggtcacgcctactacgcagagtccgtgaagggccgattcaccatctccagagacacttccgagaacacgctgtatctgcgaatgaacagcctgagagtcgaggacacggccatatattactgtgcgaaagntcctgaggcctataccacctcagtcagctgggttcgaccccgtgggccgacgggaaccctggtcaccgtctcctcacgccctccaccgaacgggcccacgtccggtccttccccgtcggccaccctccctacccaacgacgccacccgtcgtcgggggccacgacggccggcccgtcgggccttcggcccgttcggtccgaacggtaccttaccgttacccggtacggttacgtactaaccgg

SEQ ID NO: 293626 - DNA, 520 bp, Homo sapiens
  misc_feature: GYAE6OF02I6EMK.16.10.A10.1.454.CMB.1.raw
  modified_base (437)..(437): a, c, t, g, unknown or other
  misc_feature (437)..(437): n is a, c, g, or t
  modified_base (492)..(492): a, c, t, g, unknown or other
  misc_feature (492)..(492): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccacggccccctgtggtggtgagtatataaagacacacagacggccctacgagggactcccgtgggcgtattctcgtcggctccagctcgaagggacacgagtcacgttgaccagtcgggtggacgtccgaggcagaaagacggagggtagactagttactgtcagtctgacaacnccatgcagcgtgtcggcgagggacagcgcgacgctgcgtcacgcgtaagccgtcnccccgtcggccacgtctcgtcccctccc

SEQ ID NO: 293627 - DNA, 534 bp, Homo sapiens
  misc_feature: GYAE6OF02GLCKD.16.10.A10.1.454.CMB.1.raw
  modified_base (422)..(422): a, c, t, g, unknown or other
  misc_feature (422)..(422): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaaggcaatatgcttctcggtaccagcagaagccaggccaggcccctgtggtggtgatatataaagacacacagaggccctgagggatccctgggcgattctctggctccagctcgagggacgacagtcacgttgaccagtcggtggagtccgaggcagaagacggagggtgactattactgtcagtctgacaaacnccactgcagcggtgttcggcggacgggaccaagcgtagaccgtccgtgccgtcgacgcccgaaggcctccggcccccttcggtccaccgttccgttaccgtccccgtccccg

SEQ ID NO: 293628 - DNA, 573 bp, Homo sapiens
  misc_feature: GYAE6OF02HGYET.16.10.A10.1.454.CMB.1.raw
  modified_base (546)..(546): a, c, t, g, unknown or other
  misc_feature (546)..(546): n is a, c, g, or t
  modified_base (568)..(568): a, c, t, g, unknown or other
  misc_feature (568)..(568): n is a, c, g, or t
  modified_base (571)..(573): a, c, t, g, unknown or other
  misc_feature (571)..(573): n is a, c, g, or t
tcagtgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattccaccatctccagagacacttccgagaacacgctgtatctgcgaatgaacagcctgagagtcgaggacacggccatatattactgtgacgaaagatcctgacggcctataccactcagtcagctggttccgaccccgtgggcccagggtaaccctgggtccaccgttctccgtcacgtccctccaaccgaacgggccccagtccggttcctttcctccccgtcggccctaccccgtccctaccaacgacgccacccgttccgtcggggccacgacgccggcccgtgggcctcgccgtgcgaaggtacctacgtccgtagtacgtacacgtgacggcgggcngggccgaacggcgacacgtcgngcnnn

SEQ ID NO: 293629 - DNA, 583 bp, Homo sapiens
  misc_feature: GYAE6OF02F7OJS.16.10.A10.1.454.CMB.1.raw
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggcccctgtggtggtgatatataaagacacacagagccctcgagggatcccgtgggcgattctctggctccagctcgagggacgacagtcacgttgacctatcggtggagtccagggtcaggaacgacggagggtgactagttactgtacgtagtctgacaaacaccacgtgcgaggccggttggttccgggacgggtacgggacccacggcgtaccggaccgttccctcggccgtccgaacggaccccgaacgggtcccttccggccccccggttccggtcccgtaaccgttcccgttcccggttcccccgtcccccg

SEQ ID NO: 293630 - DNA, 584 bp, Homo sapiens
  misc_feature: GYAE6OF02JCH6O.16.10.A10.1.454.CMB.1.raw
  modified_base (201)..(201): a, c, t, g, unknown or other
  misc_feature (201)..(201): n is a, c, g, or t
  modified_base (298)..(298): a, c, t, g, unknown or other
  misc_feature (298)..(298): n is a, c, g, or t
  modified_base (331)..(331): a, c, t, g, unknown or other
  misc_feature (331)..(331): n is a, c, g, or t
  modified_base (368)..(368): a, c, t, g, unknown or other
  misc_feature (368)..(368): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccgagggaaggggctggagtgggtctcaacttttagnggtagtggtggtcacgcctactacgcagagtccgtgaagggccattccaccatctccagagacacttccgagaacacgctgtatctgcgaatgaacngcctgagagtcgaggacacggccatatattacngtgacgaaagctccgtagacggcctaatacccacctnaagtcagtctggttccgaccccgtgggccacgggaaccctcggtcaccgtctcctcacgccctccaaccgaacggccctacgtccggtccctccccgtcggccaccctccctaccgaacgacaccaccgtcgtcggggccacgacgccggcccgtcgggcctcggcccgttcggtaccgaacggtaccttaccttccggtaacgtacgtacctacg

SEQ ID NO: 293631 - DNA, 581 bp, Homo sapiens
  misc_feature: GYAE6OF02GU9L5.16.10.A10.1.454.CMB.1.raw
  modified_base (273)..(273): a, c, t, g, unknown or other
  misc_feature (273)..(273): n is a, c, g, or t
  modified_base (294)..(294): a, c, t, g, unknown or other
  misc_feature (294)..(294): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggcccctgnggtggtgatatataaagacanacagaggccctacgagggactcccgtgggcgtattctctggctccagctcgagggacgacagtcacgtcgacagtcggtaggacgtaccgaggcgaaggaagacggagggtagacgttagttaactgtctacgtcacgacaaaccacacgtgacgacgtcggtgttcgggcggacgggaccgaagcgtacgaccgtcgtcgccgttacgaccgtacccggaacggtcccgtaccggtccccccgtacgggttcctaacccgtccgttacccgttacccctacccccg

SEQ ID NO: 293632 - DNA, 562 bp, Homo sapiens
  misc_feature: GYAE6OF02IWURS.16.10.A10.1.454.CMB.1.raw
  modified_base (418)..(418): a, c, t, g, unknown or other
  misc_feature (418)..(418): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctctaacttttagtggtagtggtggtcacgcctactacgcagagtccgtgaagggccattcaccatctccagagacacttccgagaacacgctgtatctgcgaatgaacagcctgagagtcgaggacacggccatatattactgtgacgaaagatcctgagcctataccacctcaagtcagctcggttccgacccgtcgggccgacgggacccgtggtcaccgtctcctcncgccctccaccacggcccactccgtcctcccctcgccaccctcctccagacgcctacctcgtcggggcacgacgccggcccgtgggcctcggccgtcggtaccgaacggtacttaccgttaccggaacgttacgtactaaccgg

SEQ ID NO: 293633 - DNA, 582 bp, Homo sapiens
  misc_feature: GYAE6OF02FNO2I.16.10.A10.1.454.CMB.1.raw
  modified_base (283)..(283): a, c, t, g, unknown or other
  misc_feature (283)..(283): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaactttttagtggtagtggtggtcacgcctactacgcagagtccgtgaagggccattcaccatctccagagacacttccgagaacacgctgtntaaaactgcgaatgaacagcctgagagtcgaggacacggccatatattactgtgcgaaagatcctgaggcctataccacctcagtcagctggttccgaccccgtcggggccgacgggaaccccgtcgggtccacccgtctccctcacgcctccaccaacgggcccactcgtccttcccctcggtccaccctccctcccaacgacgccaccctcgtcgggggcaccgacgccggcccgtcgggcctcggcccgtcggtacgaacggtacctaccgttacccgacggttacgtactaccgg

SEQ ID NO: 293634 - DNA, 537 bp, Homo sapiens
  misc_feature: GYAE6OF02FHID1.16.10.A10.1.454.CMB.1.raw
  modified_base (354)..(354): a, c, t, g, unknown or other
  misc_feature (354)..(354): n is a, c, g, or t
  modified_base (475)..(475): a, c, t, g, unknown or other
  misc_feature (475)..(475): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctccttttgagttgacacagccaccctcggtgtcagtgtccccaggacagacggccaggatcacctgctcttcagatgcattgccaaggcaatatgcttcttggtaccagcagaacgccaggccaggcccctgtggtggtgatatataaagacacacagacggccctgagggactcccgtgggctattctcgtggctcagctcgagggacacngtacacgttcgaccagtcggtgacgtccgaggcgagaaggacggagggtagacttacttacgtgtcagtctgaccaaacaccactgcaggcggtgtcggacggaggacaagctgaccgtcnggcgtcgacgacccgaaggccgtccgcccccgtcggtccacctcctccgttccccgtccccg

SEQ ID NO: 293635 - DNA, 660 bp, Homo sapiens
  misc_feature: GYAE6OF02I1ZRJ.16.10.A10.1.454.CMB.1.raw
  modified_base (272)..(272): a, c, t, g, unknown or other
  misc_feature (272)..(272): n is a, c, g, or t
  modified_base (331)..(331): a, c, t, g, unknown or other
  misc_feature (331)..(331): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctgggagtgggtctcaacttttagtggtagtggtggtcacgcctactacgcagagtccgtgaagggccattcaccatctccagagacacttccganaacacgctgtatctgcgaatgaacagcctgagagtcgaggacacggcatattatactgngcaaagatcctagacggaccttaatacccgaccttacagttccagtccgttggtttacccggaccccgtagggggacccgaacgggaacccgtcgggtaccgacccgtccgtcccgtccgacgcccgttaccaacccgaacgggtacccctacgtcccggttcccgttccccgtccggtcccgtaccccgtcccctaccgtaaccggtaccgtccaacccgttccgtcgggggcctaccgacggcccggcccggtacgggtccctcggtccgttacggtacccgtaacggtacccggtacttacccggtacgttaccggtactaaccgg

SEQ ID NO: 293636 - DNA, 564 bp, Homo sapiens
  misc_feature: GYAE6OF02GY497.16.10.A10.1.454.CMB.1.raw
  modified_base (341)..(341): a, c, t, g, unknown or other
  misc_feature (341)..(341): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaaacacgctgtatctgcgaatgaacagcctgagagtcgaggacacggccatatattactgtgcgaaagntcctgagcctataccactcagtcagctggttcgacccgtgggccacgggaccctcggtcaccgtctcctcacgcctccaccaacggcccacgtccgtccttccccctcggccaccctcctccaacgacgccacctcgtcggggcacgcgccggcccgtgggcctcggcccgtcggtaccgaacggtaccgttaccgttcccggacggttacgtaccgtaccgg

SEQ ID NO: 293637 - DNA, 581 bp, Homo sapiens
  misc_feature: GYAE6OF02JAAC3.16.10.A10.1.454.CMB.1.raw
  modified_base (425)..(425): a, c, t, g, unknown or other
  misc_feature (425)..(425): n is a, c, g, or t
  modified_base (447)..(447): a, c, t, g, unknown or other
  misc_feature (447)..(447): n is a, c, g, or t
tcagtgtactactccacgaccggtgctcgatttagcgtcgatctcagggggtgggtccaggaggcagaactctgggtgtctcaccatggcctggatccctctacttctcccctcctcactctctgcacaggctctgaggcctcctttgagttgacacagccaccctcggtgtcagtcgtcccaggacagacggccaggatcacctgctctcagatgcattcgccaaaggcaatatcgtccttcttggtacccagacgagaacgccacggccacggcccctgtcggtggtgatataagtaaagacacgacagaggccctgagggactcccgtgggcgattctcgtggctacgacgctcgagggacacagtaccacgttagaccagtccgggtggagtccgaggacaaggaacggacggtagggtanacttaagttacgtgtcaggttncgacgtaaacaccagtcgacgaggtcggtggtcggcggaacggacgacgcgcgtaccgcgtggaccgtcgacggccgtaacggccgttccggaccccgtaccggtccctacgttccgtccgttaccccgtcccg

SEQ ID NO: 293638 - DNA, 718 bp, Homo sapiens
  misc_feature: GYAE6OF02G5C1O.16.10.A10.1.454.CMB.1.raw
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccagggacagacggccaggatcacctgctcttcagatgcattgccaaggcaatatgcttcttggtaccagcagaagccaggccacggccccctggtcggtggtgatataataaagacaacacagacggccctcgagggactcccgtgggacgtattctacgtcggcctccgagtcctacgacgggacgaacgtacggtacctaacggttacgaaccgtacgttccgggtacgggtacgtcccgaagggaccgaaaggaaacgggaaccggtagggggtactaacgttaacgtttaacgtcgttaccgtaaggttccgtaacggaaccaaaacctacccgtaacctacggtaccaccgggtcgggtttacggttccggggacggggtaaccgggaacccgtaacggccgttaccggaccccggttccgtacggtaccggtccgaaccggaccccggtaacgggtcccgttacccgggacccccccgttcgggtacccctacccggtttacccgttacccgttccccccgtaacccccg

SEQ ID NO: 293639 - DNA, 610 bp, Homo sapiens
  misc_feature: GYAE6OF02F2LT2.16.10.A10.1.454.CMB.1.raw
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtcgtccccaggacagacggccaggatcacctgctcttcagatgcattgccaaggcaatatgcttcttgacctagcagagccaggccacggcccctggtggtggtcgatatataaagacaacacaagacggccctcgacgggactcccgtgggacgatttcgtcctggcctccacgctacgagggacgactagtcgtacgttcgaacctagtcgggtaggacgtccgacggcaaggaagacggtagggtcgaacttattacgtgtacgtacgtcgtagtaccaaacaccactcgcacggcggtcgttccgggacgggtaacggggaaccaaggccgtcggtacccgtccgtcgccggtacaccggacccgaacggtcccgtaccggcccccgttcgggtcccgttaacctccgttcccggttccccgtacccccg

SEQ ID NO: 293640 - DNA, 614 bp, Homo sapiens
  misc_feature: GYAE6OF02IWNAI.16.10.A10.1.454.CMB.1.raw
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccacccctcggtgtcagtcgtccccaggacagacggccaggatcacctgctcttcagatgcattgccaaggcaatatgcttcttggtaccagcagaagccaggccaggcccctgtggtggtgatataataaagacacacagacggccctcgagggactcccgtgggcgtattctcgtcggcctccgagctcgagggacgacgagtcacgtcgacctagtcgggtggacgtccacgccaaggaacggacggagggtacgacgttaacgttacgtgtactagtcgtacgacaaacaccactcgaccgaggtcggtggttaccgggacgggaacgggaccgaacggccgtacgtacccggttccgcggtccggtacgaccggcccggaacggtccgtacccggtcccccgtacggggtccctacccggtttcccgttacccccgccccgttaccccg

SEQ ID NO: 293641 - DNA, 522 bp, Homo sapiens
  misc_feature: GYAE6OF02HRKFN.16.10.A10.1.454.CMB.1.raw
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaaggcaatatgcttcttggtaccagcagaagccaggccaggcccctgtggtggtgatatataaagacacacagacggcctcagggactccctgggcgattctctggctccagctcagggacgacagtcacgttgaccatcggtggagtccgaggcaagaagacggaggtgactattacgtgtacagtcagacaaacaccactgcagcggtgtcggcggaggaccgaagcgtacgaccgtctgcgtcgacgacccgaaggctcgcccccgtcggtccaccgtctccgtcccgtcccc

SEQ ID NO: 293642 - DNA, 653 bp, Homo sapiens
  misc_feature: GYAE6OF02I9AZF.16.10.A10.1.454.CMB.1.raw
  modified_base (363)..(363): a, c, t, g, unknown or other
  misc_feature (363)..(363): n is a, c, g, or t
  modified_base (388)..(388): a, c, t, g, unknown or other
  misc_feature (388)..(388): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattcgccaaaggcaatatgtcttcttggtaccagcagagccaggccaggcccctgtcggtggtcgatataataaagacacacaggacggcctgaggactccgtggtcagttctcgtcggctacgacgcgtcgaaggtacgacgngtactacgttcgacctagttcgggnggtacgtccgacgggtacgaaggaaggaccgggtagggtacgtacgttaagttacgttgtacgtaggttccgtacggaaccaaaaccgtccctaacgtcgtacggtacgtccggggttagggttcccgggacgggaacgggaaacccgaggtaccgtacggtaacccggtcgtacggtcccggttaaccggacggtacccggaacggtccgacccgtccccggttacgtccctaccggtccgtttccccgttaccccggtccccg

SEQ ID NO: 293643 - DNA, 646 bp, Homo sapiens
  misc_feature: GYAE6OF02HDS50.16.10.A10.1.454.CMB.1.raw
  modified_base (369)..(369): a, c, t, g, unknown or other
  misc_feature (369)..(369): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtcgtccccaggacagacggccaggatcacctgctcttcagatgcattgccaaggcaatatgcttcttggtaccagcaagaacgccgaggccacggcccctggtcggtggtgatataagtaagacacacgagacggcccacgagggactcccggtggcgtattcgtcgtcggcctccgagctcgagggacacgngtacgtacgtacgaccaggttcggtggacgtacgaggacgaaggaacggacggtaggggctaacgttacgttacgtggtactaggttcacggaacaaaaccctacctacgtcgacggacggtcgggttacgttaccggggacgggaacgggtaccgtaacggccgtaccggtacccggttaccgtcggtaccggtaacgaaccggacccggtaacgggtcccgtacccggtacccccgtacggtcccgtaccgttccgttacccgtacccctacccg

SEQ ID NO: 293644 - DNA, 571 bp, Homo sapiens
  misc_feature: GYAE6OF02HHRNG.16.10.A10.1.454.CMB.1.raw
  modified_base (549)..(549): a, c, t, g, unknown or other
  misc_feature (549)..(549): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtcgtccccaggacagacggccaggatcacctgctcttcagatgcattgaccaaggcaatatgcttcttggaccagcagaagccaggccacggcccctgtggtggtgatataataaagacacacagacggcctcgagggactcccgtgggcgtattctctcggctccagctcgacgggacgacgagtcacgttacgaccagtcgggtggacgtccgaggcgaaggaacggacggacggggtagacgttaagttactgtacgtagtaccgtcgaccaaaccaccactcgacgacggtcggtcggtcgggcgggacgggaacgagcgtacgaccgtccgtcgcgtcaccgaccgacgcgtccgtccccgtcgtccncttccgtccgtccccgtccccg

SEQ ID NO: 293645 - DNA, 524 bp, Homo sapiens
  misc_feature: GYAE6OF02HRKKN.16.10.A10.1.454.CMB.1.raw
  modified_base (448)..(448): a, c, t, g, unknown or other
  misc_feature (448)..(448): n is a, c, g, or t
  modified_base (463)..(463): a, c, t, g, unknown or other
  misc_feature (463)..(463): n is a, c, g, or t
  modified_base (472)..(472): a, c, t, g, unknown or other
  misc_feature (472)..(472): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggccccctgtggtggtgatatataaaagacacacagaggccctcagggactcccgtgggcgattctctggatccagctcagggacgacagtcacgttgaccatcgggtggagtccaggcagaagacggagggtgacgtattactgtacagtctgacaaacaccactcgacagcggtgttccggngggaggaccgaagcngaccgtccngcgtcacgccgaaggccgtcgccccctcggtccacctctcgtcccgtccccg

SEQ ID NO: 293646 - DNA, 733 bp, Homo sapiens
  misc_feature: GYAE6OF02H2GLR.16.10.A10.1.454.CMB.1.raw
  modified_base (332)..(332): a, c, t, g, unknown or other
  misc_feature (332)..(332): n is a, c, g, or t
tcagtgtactactccacgaccggtgctcgatttagcgtcgatctcagggggtgggtccaggaggcagaactctgggtgtctcaccatggcctggatccctctacttcctccccctcctcactctctgcacaggctctgaggcctcctttgagttgacacagccaccctcggtgtcagtcgtccccaggacagacggccaggatcactgctcttcagatgcattcgccaaggcaatatgcttcttgtaccagcagaacgccacggccacggcccctggtcggtggtgatataataaagacacacgagacggccctacgacgggacttcccggngggtccgtattccgtacgtcggcctccacgcctacggacggggaacgaacgtacgtccgtaacggtttcgaaccgtaggtcgggtaggtacgtcccggaagggacgaacgggaaacgggtaacgggtaaggggtactaaacgttacgtttaacgttcggtaacgttacggttaccgtaacgtaaccaaaaccgacccaaccgttacggaacgaccgggttacggggttacgggttaccggggaccgggtaacggggacccgaaacggtccgttaccgggacccgttccggtacggtccgtaccggaacccggtaccgggaaccggtcccgttccccgggacccccgttaccgggtacccttacccggtttaccggttccccgttacccccttaacccccgg

SEQ ID NO: 293647 - DNA, 541 bp, Homo sapiens
  misc_feature: GYAE6OF02H4RUZ.16.10.A10.1.454.CMB.1.raw
  modified_base (416)..(416): a, c, t, g, unknown or other
  misc_feature (416)..(416): n is a, c, g, or t
  modified_base (432)..(432): a, c, t, g, unknown or other
  misc_feature (432)..(432): n is a, c, g, or t
  modified_base (440)..(440): a, c, t, g, unknown or other
  misc_feature (440)..(440): n is a, c, g, or t
  modified_base (480)..(480): a, c, t, g, unknown or other
  misc_feature (480)..(480): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtcgtccccaggacagacggccaggatcacctgctcttcagatgcattgccaaggcaatatgcttcttggtaccagcagaacgccaggccacggcccctgtggtggtgatataataaagacacacagacggccctcgacgggactcccgtgggcgtattcctcgtggcctccagctacgagggacacgacgtcacgttgacctagtcgggtggacgtccgaggcaagaaggacggagggtnactatacgtgtcagtngacaaacncatgcagtcggtgtcggcggacgggacaggctgacctcgngcgtcgacgccgaaggcctccgtccccgtacggtccaccgttccgtccggtccccgtcccg

SEQ ID NO: 293648 - DNA, 639 bp, Homo sapiens
  misc_feature: GYAE6OF02GQOMX.16.10.A10.1.454.CMB.1.raw
  modified_base (325)..(325): a, c, t, g, unknown or other
  misc_feature (325)..(325): n is a, c, g, or t
  modified_base (465)..(465): a, c, t, g, unknown or other
  misc_feature (465)..(465): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagcccaccctcggtgtcagtcgtccccaggacagacgccaggatcacctgctcttcagatgcattgccaaggcaatatgctttcttggtaccagcagaagccaggccaggcccctggtggtggtgatataataaaggacacacagacggccctagagggactcccgngggtcattctcgtggcctccagccgtcgaggggaccgacgaggtccgacgtttcgaacctagtccgggtaggacgtccgaggcaaggaagaccggagggtcgaacttagttaaccgtgtacgtagttcacgaccaaaccnctaaccgtgacaaggtcgggttcggttcgggacgggtacgggaccaaggtcctaggtaccccgttcgtcggtaccgttccggaaccgtaccccgggaacggcccgttacccggccccccgtttacgggtcccgtacccttcccgtttaccccggtttcccccgtaaccccccgg

SEQ ID NO: 293649 - DNA, 678 bp, Homo sapiens
  misc_feature: GYAE6OF02HMB4A.16.10.A10.1.454.CMB.1.raw
tcagtgtactactccacgaccggtgctcgatttagcgtcgatctcagggggtgggtccaggaggcagaactctgggtgtctcaccatggcctggatccctctacttcctccccctcctcactctctgcacaggctctgaggccttcctttgagttgacacagcccaccctcggtgtcagtcgtccccaggacagacggccaggatcacctgctcttcagatgctattcgaccaaaggccaaagttactgtacctttcgttacggtaccagcaagaacgccgaaggccacggccccgtggtggtggtgatataagtaaagacaacacagacgccctgaggactcccgtgggcgtattctctggactccgagctacgagggacacgtagtctacgttcaccgtagtcgggtggacgtccgaagggacgaaggaaacggacgggtaggggtaacgtaacgttatttaaccgtagtacgtaacgttccgtacgaaccaaaccacctaacgtcggaccgtaacgggtccgggttaggttccggggacgggtaaccgggaaccgtaacggccgttaacggcccggttcgtacggtccgtaccgaccggtaccccggaaggtccccgtacccgtcccccggttacggtcccgtaccgtttcccggttccgttcccccgttccccg

SEQ ID NO: 293650 - DNA, 578 bp, Homo sapiens
  misc_feature: GYAE6OF02FL8SQ.16.10.A10.1.454.CMB.1.raw
  modified_base (202)..(202): a, c, t, g, unknown or other
  misc_feature (202)..(202): n is a, c, g, or t
  modified_base (299)..(299): a, c, t, g, unknown or other
  misc_feature (299)..(299): n is a, c, g, or t
  modified_base (341)..(341): a, c, t, g, unknown or other
  misc_feature (341)..(341): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctgggagtgggtctcaactttttagnggtagtggtggtcacgcctactacgcagagtccgtgaagggccgattcaccatctccagagacacttccgagaacacgctgtatctgcgaatgaacngcctgagagtcgaggacacggccatatattactgtgcgaaantcctgaggcctatacccactcagtcagcttggtccgaccccgtgggaccgacgggaacccgtggtccaccgtcctccctcacgcctaccaccgaacgggcccacgtccggtcccttcccccgtcggcccaccctccctaccaacgacgcctaccgtcgtcggggccacgacgccggtcccgtcgggcctcggtccgtcggtcgaacggtacttaccgttccgacgttacgtactacg

SEQ ID NO: 293651 - DNA, 601 bp, Homo sapiens
  misc_feature: GYAE6OF02H2HN3.16.10.A10.1.454.CMB.1.raw
  modified_base (331)..(331): a, c, t, g, unknown or other
  misc_feature (331)..(331): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaaatgaacagcctgagagtcgaggacacggccatatattacngtgacgaaagctcctgacggcctaataccacctcagtcagtctcggttcccgaccccgtggggccgacgggaacccgtggtccaccgtcctccctcacgcctacccaccgaacggcccacgttccgtccttcccccgtcggccctacccctccctaccaacgacgcccaccgtccgtcgggggaccacgacgcccggcccgtcgggtccgtcggccgttcggtaccgaacggtaccttaccgttaccggtaacggtacgtaccgtaacgg

SEQ ID NO: 293652 - DNA, 626 bp, Homo sapiens
  misc_feature: GYAE6OF02FYGNC.16.10.A10.1.454.CMB.1.raw
  modified_base (203)..(203): a, c, t, g, unknown or other
  misc_feature (203)..(203): n is a, c, g, or t
  modified_base (317)..(317): a, c, t, g, unknown or other
  misc_feature (317)..(317): n is a, c, g, or t
  modified_base (343)..(343): a, c, t, g, unknown or other
  misc_feature (343)..(343): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctggggtccgccaggctccaggggaaggggctggagtgggtctcaactttttagnggtagtggtggtcacgcctactacgcagagtccgtgaagggccgattcaccatctccagagacacttcgagaacacgctgtatctgcgaatgaacagcctgagagtcgaggacncggccatatattactgtgacgaaagntccgtagacggcctagaccacctcagtcagccgttggtcccgaccccgtgggaccacgggacccgtggtcacgtccgtctcctacacgccctaccaccgaaccggcccacgtccgttccttcccccgtcggcccaccccttccctaccgaacgacgccacccgttcgacgggggacctacgaccggccgggtaccccggtcgggtacccgtcggtcccgttacgggtaccgtaaccgggttaacccttaaccggtttacccggtaacggttacgttaacccgg

SEQ ID NO: 293653 - DNA, 576 bp, Homo sapiens
  misc_feature: GYAE6OF02HVIPR.16.10.A10.1.454.CMB.1.raw
  modified_base (294)..(294): a, c, t, g, unknown or other
  misc_feature (294)..(294): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggagggctggagtgggtctcaacttttagtggtagtggtggtcacgcctactacgcagagtccgtgaagggccattcaccatctccagagacacttccgagaacacgctgtatctgcgaatgaacngcctgagagtcgagacacggccatatattactgtgacgaaagtctccgtggacggcctaatacccacctcagtcagtctcggttccgaccccgtgggccgacgggaaccctcggtcaccgtctccgtcacgcctccgaccgacggcccacgtccgtccttccccgtgccctaccctcctaccaacgacgccaccgtcgtcgggccacgaccggccggcccgtcgggcctcggccgtcggtaccgaacggtacctaccgttaccggacgttacgtactaccgg

SEQ ID NO: 293654 - DNA, 582 bp, Homo sapiens
  misc_feature: GYAE6OF02G52LZ.16.10.A10.1.454.CMB.1.raw
  modified_base (379)..(379): a, c, t, g, unknown or other
  misc_feature (379)..(379): n is a, c, g, or t
  modified_base (431)..(431): a, c, t, g, unknown or other
  misc_feature (431)..(431): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgaccaaggcaattatgcttcttggtaccagcagaagccaggccaggcccctgtacggtggtgatatagtaaagacacacagacggccctcgagggactcccgtgggacgattcctacgtcggccttaccgagctcgaagggacacgagtacacgtanaccagtcggtagacgtccgagcaagaacgacggaggtgactattactcgtanagtctagacaaacacctaactgacgaggcggtacgttcggacgggacgggaacccaaggtaccgtcgaaccgtccaggccgtacgaccgaccgaacggcccttccggacccccttcggacctaccgtccgttaccgttccccctaaccccg

SEQ ID NO: 293655 - DNA, 643 bp, Homo sapiens
  misc_feature: GYAE6OF02HPY29.16.10.A10.1.454.CMB.1.raw
  modified_base (475)..(475): a, c, t, g, unknown or other
  misc_feature (475)..(475): n is a, c, g, or t
tcagtgtactactccacgaccggtgctcgatttagcgtcgatctcagggggtgggtccgaggaggcagaactctgggtgtctcaccatggcctggatccctctacttcctccccctcctcactctctgcacaggctctgaggccttcctttgagttgacacagcccaccctcggtgtcagtcgtccccaggacagacggccaggatccactgctcttcagatgcattgaccaaaggcaatatgtacttctggtaccagacagaacgccaggccacggcccctggtcggtggttgataagtataaagacacacagacgccctcgagggactcccgtagggctattcctcgtcggctccgagctacgacgggacgacacgtcgaacgttgaaccctagtccgggtaggacgtacgagggtaccgaaggaaacgacgggaagggcgtaaacgtagttaacgttgtaaccgtagtaccngtaaccaaaacgcctacgtacgacgaacggtcggtaccggtaccggtaccgggaaggtacccgaaaggtccgtacgggaacccgtccgtcggacgtaccgaccgtaccccgtaaggcccgttaccggaccccgttcggtaccgtacctccgttccgtacccctacccg

SEQ ID NO: 293656 - DNA, 571 bp, Homo sapiens
  misc_feature: GYAE6OF02IDGCF.16.10.A10.1.454.CMB.1.raw
  modified_base (303)..(303): a, c, t, g, unknown or other
  misc_feature (303)..(303): n is a, c, g, or t
  modified_base (339)..(339): a, c, t, g, unknown or other
  misc_feature (339)..(339): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacgccaggatcacctgctcttcagatgcattgccaaggcaatatgcttcttggtacagcagaagccaggccaggcccctgtggtggtgatatataaagacacacagagccctnagggactcccgtgggcgtattcgtcgtggactccgngctcgagggacgacagtcacgttcgaccagtcgggtggacgtcgaggcagaagacgagggtgactatactgctagtctgacaaacacactcgcaggcggtagttcggacgggaacgggaccgaaagtccgtacgacccgtccgtaggtccggtacacggacccgaaggtcccgtaccggccccccgttcgggtaccctacccgttccttacccggttcccctaaccccccgg

SEQ ID NO: 293657 - DNA, 622 bp, Homo sapiens
  misc_feature: GYAE6OF02HMHE4.16.10.A10.1.454.CMB.1.raw
  modified_base (200)..(200): a, c, t, g, unknown or other
  misc_feature (200)..(200): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattccacccttagcggttatgccatgagctgggtccgccaggctccagggaggggctggagtgggtctgaacttttagnggtagtggtgtcacgctactacgcagagtccgtgaagggccgattcaccatctccagagacacttccgagaaccacgctgtatctgcgaatgaacagcctgagagtcgaggacacggcatatattactgtagcgaaagactcgtagacggtacctactacccgacctcacgtcaagtcgtcgggtttcccgaccccggtcggggcccgacgggtaaccccggtcgggtcctacccggttcctcccgtacgtaccgccctacccgacccgaaccgggcccgtaaccgtcccggttcctcccccgtcgcccgtaccctccctaccaacggtacgcctaccgtcgtcggggcacacggccggcccgtgggccgtcggccgtcggtacgacggtacgtaccgttcccggtaaggtacgtataccgg

SEQ ID NO: 293658 - DNA, 647 bp, Homo sapiens
  misc_feature: GYAE6OF02G09ZJ.16.10.A10.1.454.CMB.1.raw
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctctaactttttagtggtagtggtggtcacgcctactacgcagagtccgtgaagggccgattccaccatcctccagagacacttccgagaaccacgctgtatctgcgaatgaacagcctggagagtcgaggacacggccatatattactgtgacgaaagactccgtggacggaccttaactaaccctacctacacgttcagtccgttcgggttacccgaccccggtcggggacccgacggggtaaccccgtcggtccgtacccgtcctccctccaccgccctacccgaaccgaccgggaccctacgtcccggttcccttcccccgtcggtccctacccctccctacccgaacgacgaccacccgtcggtcggggccacgacggcccggcccggtcgggcctcggtccgttacggtaccgaacggtaccttaccgttaccggtacggttacgtacgtacgg

SEQ ID NO: 293659 - DNA, 615 bp, Homo sapiens
  misc_feature: GYAE6OF02IGF25.16.10.A10.1.454.CMB.1.raw
  modified_base (311)..(311): a, c, t, g, unknown or other
  misc_feature (311)..(311): n is a, c, g, or t
  modified_base (367)..(367): a, c, t, g, unknown or other
  misc_feature (367)..(367): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggtttatgccatgagctggggtccgccaggctccgagggaggggctgggagtgggtctctaactttttagtggtagtggtggtcacgcctactacgcagagtccgtggaagggccgattcaccatctccagagacacttccgagaacacgctgtatctgcgaatgaacagcctgagngtcgagcacggcatatattactgtgacgaaagctcctaggacgcctataccacctnacgtcagtctcgggttcccgacccgtcgggaccgacgggacccgtcggtcctaccgtcctcctccgcgccctaccaacccgaccggaccccgtacgttcccggtcccttccccgtcggccctaccctccctaccgaacgacgacctacccgtcggtcggggaccacgacggcccggtccggtcgggccgttcggccgttcggtacgtaacggtaccttaccgttaccggtacgttacgtacgtaccgg

SEQ ID NO: 293660 - DNA, 772 bp, Homo sapiens
  misc_feature: GYAE6OF02HHDJ7.16.10.A10.1.454.CMB.1.raw
tcagtgtactactccacgaccggtgctcgatttagcgtcgatctcagggggtgggtccaggaggcagaactctgggtgtctcaccatggcctggatccctctacttctccccctcctcactctctgcacaggctctgaggccttcctttgagttgacacagcccacctcggtgtcagtcgtccccaggacacgacggccaggatcgactgctcttcagatgctagttcgccgaaggacaattatgtactttcgttcggtaaccagccgaaggaaccgccgacggaccacggtccccttggttgggtcggtagtaattactaaagtaaacggtaccaacgacgaaggtaccgccctacgagggactccccggtagggtcctacgttcctcgtggtaccctccgtagccgtacggtagggaccgtacgtggtacaccgttacggacgtacggttcggggtacgaccgtacccgagggtcaaacgggtaacggaacgggtacgggtaacgtaacgtttaagttacgttacgggtaactaacggttccttaacggaaacccgtaaactacccggtaacgtaaggtacccggtaaggggttcgggtacccgggttaccgggggaccgggaaccgggaaccggtaacggtcccgtacgggttaaccccgtcccggttaggccccggttaacaccccggggttaccgaacgggttcccctaccccggtaccccggttcggtaccctacccgtttaccggtccccttccccgtaaccccg

SEQ ID NO: 293661 - DNA, 767 bp, Homo sapiens
  misc_feature: GYAE6OF02G95IF.16.10.A10.1.454.CMB.1.raw
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagcccaccctcggtgtcagtcgtccccaggacagacggccaggatcacctgctcttcagatgcattcgaccgaaggacaatatgtctttcgttaggtaccagcagaacgccgacggccgacggcccctggtgggtggtgatataataaagacacacgagacggccctacgagggactcccgtgggcgtacttccgtcgtggtcctccgacgtctacggacgggtacacgtacgtactacgttacgaccacggttcgggtacggtacgtaccggacggaccgaagggtaaacgggaacgggtaaggggttacgtaaccgttaacgtttaaccggtcggttacgacggttaccgtaacgaaccctaaaacccgaccctaacgttcggaaccgtacgggttcccgggttaggggtttacccgggggaccgggggtaaacgggtaaccccggtaaacggtcccggttaaccgggtaaccccggttccggttacgggtacccggtaaccgtaacccgggacccccgtaaagggtcccccgttaccccggtccccccggttacgggttccctaacccggtttcccgtttaccccggttaccccccttacccccgg

SEQ ID NO: 293662 - DNA, 666 bp, Homo sapiens
  misc_feature: GYAE6OF02HOQQC.16.10.A10.1.454.CMB.1.raw
  modified_base (262)..(262): a, c, t, g, unknown or other
  misc_feature (262)..(262): n is a, c, g, or t
  modified_base (517)..(517): a, c, t, g, unknown or other
  misc_feature (517)..(517): n is a, c, g, or t
tcagtgtactactccacgaccggtgctcgatttagcgtcgatctcagggggtgggtccaggaggcagaactctgggtgtctcaccatggcctggatccctctacttcctccccctcctcactctctgcacaggctctgaggccttcctttgagttgacacagcccaccctcggtgtcagtcgtccccaggacaggacggccaggactcacctgctcttcagatgcattgaccaaggcaaatatcgctttcgttaggtaaccngacaaggaaacgccgagggacccacgggcccccgttggtacgggtgggtagtaataataagtaaaagccaacgacgaggacggtccctgaacgggtactcccgtgggctactttcgtcgtcggcctccgacgtcctacggacggggacaacgtacgtccgaacgttcgaaccgtgtacgggtacggacgtccgacgggacaaggaacggacggaggggtacacgttacttacgtgtacgagttcgagaccaaacncgactgacgacggtcggtcggttcgggacggacggaacccgagtccgtacggacccgtcgtcggtaccgtcgaaccggacccggaacggtcccgtacccgtcccccggttacggaccgtacccgttccggtcccgttccccggtccccg

SEQ ID NO: 293663 - DNA, 689 bp, Homo sapiens
  misc_feature: GYAE6OF02GG5L6.16.10.A10.1.454.CMB.1.raw
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagcccaccctcggtgtcagtcgtccccaggacagacggccaggatcacctgctcttcagatgctattcgaccaaagggcaaattatgtacctttcgttacggtaaccagcaagaacgccgaacggccacggtcccccgtggtgggtcggtgaattaagtaataaagacaacacaggacgccctgacgggactcccgtgggctacttctcgtcggcctcgacgaccgtcggacgggaaccgacgtacggtacgtaccgttacgaaccctaggttccgggtaggtacgtccgaagggtacaacggtaaaggacgggtagggtactacgttaacgttacgtcgtactaggtcctacgaaccaaaccaccacgtcgacgacgggtcggttacgggttcgggaccggggtaacggaaccgtaaggctaccggacccgttcgaccggtacgtaaccgaccggacccggaacggtcccgtcccgtcccccggttacggtaccctacccggttccgttcccgttacccccttaccccgg

SEQ ID NO: 293664 - DNA, 571 bp, Homo sapiens
  misc_feature: GYAE6OF02GSAEU.16.10.A10.1.454.CMB.1.raw
  modified_base (200)..(200): a, c, t, g, unknown or other
  misc_feature (200)..(200): n is a, c, g, or t
  modified_base (358)..(358): a, c, t, g, unknown or other
  misc_feature (358)..(358): n is a, c, g, or t
  modified_base (377)..(377): a, c, t, g, unknown or other
  misc_feature (377)..(377): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagnggtagtggtggtcacgcctactacgcagagtccgtggaagggccattccaccatctccagagacacttccgagaacacgctgtatctgcgaatgaacagcctgagagtcgaggacacggccatatattactgtgcgaggaggggggcgtgggagctcncgacgggccatgactccgngggccagggactccgtggtccaccgtctcctcacgccctacccgaccgaacgggcccagttccggtacccttccccgtaggcccgtcccttggccctccgacggcgtacccacccgtccgagacgccacgaccgccggtcccgtgggcctcgccgtggtacgaacggtctaccgttaccgagttaccgatacgg

SEQ ID NO: 293665 - DNA, 747 bp, Homo sapiens
  misc_feature: GYAE6OF02FGM29.16.10.A10.1.454.CMB.1.raw
tcagtgtactactccacgaccggtgctcgatttagcgtcgatctcagggggtgggtccaggaggcagaactctgggtgtctcaccatggcctggatccctctacttctcccctctcactctctgcacacggctctgacggtcctcctttgagttagacacgacgcccacccgttcggtcgttaccagttccggtaccccgaggaccaacggaccggaccacggtacttaccaccgtccgtccttacttccgagacctcggtcctagtttccgaccgtaacggacaacttcgtcgtacctttcgttacggaccgaacgcaacgacgcccggtacgacccggtaccggtcccgtggttcgggttacgtagtaataacgttaaacgaaacacctaacgacgaccgtaccgacccgttaggaaccgggtcctccggtacgggtaccttaccgtctacggtacggtcctaccgtacgccgttacggaaccgggaacctacgacgtaccgtacgttacgaccgtcggttacggacgacgtacgacgaggtaacgacggtacggtagttaccgactttagtcgcgttacgactcgaacctaacgaccttacggtcacggctcgggttacgtcgggtacgacggtacgacctagtccgtaacgcccgttagcgacccgtaacggcccggaacgtcccgtcccggtaccctttcgggaccttaccccgtcgtaccccgtcccctaccggttaccgg

SEQ ID NO: 293666 - DNA, 589 bp, Homo sapiens
  misc_feature: GYAE6OF02IJCHX.16.10.A10.1.454.CMB.1.raw
  modified_base (203)..(203): a, c, t, g, unknown or other
  misc_feature (203)..(203): n is a, c, g, or t
  modified_base (331)..(331): a, c, t, g, unknown or other
  misc_feature (331)..(331): n is a, c, g, or t
  modified_base (334)..(334): a, c, t, g, unknown or other
  misc_feature (334)..(334): n is a, c, g, or t
  modified_base (342)..(342): a, c, t, g, unknown or other
  misc_feature (342)..(342): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccgagggaaggggctggagtgggtctctaactttttagnggtagtggtgtcacgcctactacgcagagtccgtgaagggccattcaccatctccagagacacttccgagaacacgctgtatctgcgaatgaacagcctgagagtcgagacacggccaatatattacngtncgaaaagntcctgacggctaataccacttcagtacagcgttggttccgaccccgtgggccacgggaaaccctggtaccaccgttctcctccacgccctaccaaccgaacgggcccactccggtccttaccccctcggcctaccctcctaccaacgtacgccacccgtcgtcggggctacgacggccggcccgtgggccttcgcccgttcggtacgaacggaccgttaccgttaccggacgttacgtactaaccgg

SEQ ID NO: 293667 - DNA, 665 bp, Homo sapiens
  misc_feature: GYAE6OF02FWZCJ.16.10.A10.1.454.CMB.1.raw
  modified_base (250)..(250): a, c, t, g, unknown or other
  misc_feature (250)..(250): n is a, c, g, or t
  modified_base (256)..(256): a, c, t, g, unknown or other
  misc_feature (256)..(256): n is a, c, g, or t
  modified_base (283)..(283): a, c, t, g, unknown or other
  misc_feature (283)..(283): n is a, c, g, or t
tcagtgtactactccacgaccggtgctcgatttagcgtcgatctcagggggtgggtccaggaggcagaactctgggtgtctcaccatggcctggatccctctacttctccccctctcactctctgcacaggctctgaggccctcctttgagttgacacagccaccctcggtgtcagtgtcccccaggacagacggccaggactcacctgctcttcagatgcattgccaaggcaatatgctttcttggacngcaganccagccaggccctgtgtgtgactatanaaagtacacacagacgccctcgagggactccccgtgggcgtattcctcgtcggcctccgagcctcgaacgggtacgacacgtactacgtttcgaaccgtagtccggtaggtaccgtccgaagggtaccgaggaaacggacggaaggggttcaaccgtttaagttaccgttggtaccgtacggttacctcgaaccgaaaacctacccgtaacctgaccgtacgggtcgggttagggttcccgggacggggaacgggtaacccgaacggtccgtacggtacccgttccgtaggacccgttcggaaccgtacccggaacgggttccctaccggccccccgttcggtacccttcccggaccctttacccggttccccgtacccccg

SEQ ID NO: 293668 - DNA, 671 bp, Homo sapiens
  misc_feature: GYAE6OF02HRX14.16.10.A10.1.454.CMB.1.raw
  modified_base (346)..(346): a, c, t, g, unknown or other
  misc_feature (346)..(346): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccgaggggaaggggctgggagtgggtctactaacgtttttaggtggtagtggtggtcacgcctactacgcagacgtccgtgaagggccgattcaccatcctccagagacacttccgagaacacgctgtatctgcgaatgaacagcctagagagtcggaggaccacgccatatacttactgtnacgaaagctccgtgaggtcctaactaccacctcagtcagtcctggtttacccgacccgtgggacccgtaacgggacccctggtccacccgttctaccctcgacgccctccaacccgacggccctacgtcccggttcccttcccccgtgggtacccctaccccttcccgtacccaacggtaccgacccgtaaccgtccggtacgggggccaaccgtacgggcccggccccggtcggggtaccgttccggcccggtttacgggtaaccgtaaccgggttaacttaaccccggtttaccgggtaacggttaaccggtaccgtaaccgg

SEQ ID NO: 293669 - DNA, 915 bp, Homo sapiens
  misc_feature: GYAE6OF02FSI2K.16.10.A10.1.454.CMB.1.raw
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtcgtcccccaggacgaggaccggccgaggactccacctcgtccttccttacgagtagtcgaccttagttcgaccgaacggaactaaattagtacgttctttaccgttaccggtaaccgacgacgaacgaacgaccgacggacccgaccggtccccgtgggttcgggttggtacgttaacgttaagttaaaacgtaaaaccggtaaccaaccgaaccggaacgggaacccgggtaccccgtaacgggaaccggggtacccgttaccccgggttcggggaccgtttaacgtttcccgttccggttaccggtccccttaacccggtacgtacccggtaccgggaacggggtaacccgtaaccgtaacggttaccgttaaccggttaccgtaacccgtacggggtttccgggtaacggggtacccgtaccggtaaccggaacccggaaagggtaaacgggtaaccggggtaggggttaccgtaacgttaaccgttacgttaccggtacggttcgtaccgttaaccgaacccgtaaaccacccgtacggacgtacggtacggttccgggtttaccgggtaccgggtaccggggtaaccgtaaccggtaaccggtaccgttacccggtacccggtccgtaccggtaccggtaacccgacccggtacccggtacccggtcccggtaccccggtccccgttaccggtccgttcccggttcccggtttaccccgtcccccgttccccg

SEQ ID NO: 293670 - DNA, 584 bp, Homo sapiens
  misc_feature: GYAE6OF02FIJ8H.16.10.A10.1.454.CMB.1.raw
  modified_base (370)..(370): a, c, t, g, unknown or other
  misc_feature (370)..(370): n is a, c, g, or t
  modified_base (425)..(425): a, c, t, g, unknown or other
  misc_feature (425)..(425): n is a, c, g, or t
  modified_base (456)..(456): a, c, t, g, unknown or other
  misc_feature (456)..(456): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaactttttagtggtagtggtggtcacgcctactacgcagactccgtgaagggccgtttcaccatctccagagacaattccaagaacacgctgtatttgacaaaatgaacagtctagagagtcgaggacaccggccaatataattactgtggcgaaaggcgggaagtttggcgggcggtanacgtgctattgacttacgtggggccaaggggaccctgggtctaccgtctcctcanccctcaccgacggccatcggttcctccccgngccacctcctaccagtacgcaccgtcgtcgggcacgacgccggcccgtcgggcctcgcctcggtaccgaaggaccgttaaccgttccgaaggttaccgtacgtacgtacggacggtcggacgtccggg

SEQ ID NO: 293671 - DNA, 666 bp, Homo sapiens
  misc_feature: GYAE6OF02GKYPT.16.10.A10.1.454.CMB.1.raw
  modified_base (117)..(117): a, c, t, g, unknown or other
  misc_feature (117)..(117): n is a, c, g, or t
  modified_base (304)..(304): a, c, t, g, unknown or other
  misc_feature (304)..(304): n is a, c, g, or t
  modified_base (325)..(325): a, c, t, g, unknown or other
  misc_feature (325)..(325): n is a, c, g, or t
  modified_base (368)..(368): a, c, t, g, unknown or other
  misc_feature (368)..(368): n is a, c, g, or t
  modified_base (382)..(382): a, c, t, g, unknown or other
  misc_feature (382)..(382): n is a, c, g, or t
  modified_base (549)..(549): a, c, t, g, unknown or other
  misc_feature (549)..(549): n is a, c, g, or t
tcagtgtactactccacgaccggtgctcgatttagcgtcgatctcaggtcttcgtggctcacgtccaccaccacgcatgtgacctcgagggtccctgagactctcctgtgcagcctntcggattcaccttagcggttatgaccatgagtctgggtccactaggctccgagggaagggctagggagtgggtctcgtaactttagtcggtagtggtgtcacgtcctactacggcagacgttccgtaggaacggccgtaattcacctatactccgaagacgacaccttcgaacgaacacgtctagtnttccgtgaccgaattgaaacnggtcctagaagtgcgtaaggacacggcaagttatacgtttacngtgaccgaaaagtntcccgtggaaccgttcaacttaccgactcctaagtcgacgtcgtacgggtttacccaccccgaggggtccgtaacggtaaccgtcgtaaccgcgttaccgaccctagtacctcccgtaccgaacgaccggtacctaccgtaccgtccctttaccccgcggttacccncccttaccggactaacggacctccggaaccttcggtccggataccgaggtacccgccggtaacggctccggtaccgagtccgtacggaaccttaccgtcgaacgttcgaactaccgg

SEQ ID NO: 293672 - DNA, 757 bp, Homo sapiens
  misc_feature: GYAE6OF02G60W5.16.10.A10.1.454.CMB.1.raw
tcagtgtactactccacgaccggtgctcgatttagcgtcgatctcagggggtgggtccaggaggcagaactctgggtgtctcaccatggcctggatccctctacttcctcccctcctcactctctgcacaggctctgaggcctcctttgagttgacacagcccacccgtcggtgtcagtgtcccccaggacagacggccaggatcacctgctcttcagactgctagttcgacccaaagggccaaattactggtacctttcgttacgggtacccaggactaaggaacggcccgaacgggacccaacgggtccccccgttagggtacggggttacgggttaacggtaacttaacgttaacgttaaaaacggaccaaccgaacgtaacgggaccggtaccccgttacggaacggggttacttacccccggtaggggtaccgtactttccgtcggttacggcccttacgacgtcctaccggtacgggaccgtacgacggttacctaccggttacgaaccgtaggttccgggtaacggtacgttccggacggacgaacggtaacgggaacggtacgggtacgtaacgttacgttacgtacgtacgttacgtcgtagaaccaaactaccgacgtcgaccgtacggtccggtacgttcgggacggtacggacgaacggccgtacggaccgtcgtacggaccgtaccgacggcccgaacggtccacccgtcccgtcgcctaccgtccgttaccgtccccgtcccg

SEQ ID NO: 293673 - DNA, 554 bp, Homo sapiens
  misc_feature: GYAE6OF02HQW5F.16.10.A10.1.454.CMB.1.raw
  modified_base (256)..(256): a, c, t, g, unknown or other
  misc_feature (256)..(256): n is a, c, g, or t
  modified_base (307)..(307): a, c, t, g, unknown or other
  misc_feature (307)..(307): n is a, c, g, or t
tcagtgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaanccaggccacggcccctagtggtgtgatatataaaagacacacagacgcctnagggactccgtgggctattctctggctccagtctagagggacgacgagtacacgttacgacctagtcgggtggagtccgaggcgaaagaaggacggagggtacgaacgtattacgtgtactacgtctagtacaaacaccactagacaggcggtgttcgggacggacgggaaccaagcgtacgaccgtcgtcgcgtcacgacccgaaggtcctcgccccgtcggtacctacgtcctcgtcccctcccg

SEQ ID NO: 293674 - DNA, 631 bp, Homo sapiens
  misc_feature: GYAE6OF02GBYSJ.16.10.A10.1.454.CMB.1.raw
  modified_base (311)..(311): a, c, t, g, unknown or other
  misc_feature (311)..(311): n is a, c, g, or t
  modified_base (343)..(343): a, c, t, g, unknown or other
  misc_feature (343)..(343): n is a, c, g, or t
  modified_base (345)..(345): a, c, t, g, unknown or other
  misc_feature (345)..(345): n is a, c, g, or t
  modified_base (352)..(352): a, c, t, g, unknown or other
  misc_feature (352)..(352): n is a, c, g, or t
  modified_base (381)..(381): a, c, t, g, unknown or other
  misc_feature (381)..(381): n is a, c, g, or t
  modified_base (445)..(445): a, c, t, g, unknown or other
  misc_feature (445)..(445): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattccacccttagcggttatgccatgagcgtgggtccgccaggctccgaggggaaggggctgggagtgggtctcgtaacttttagtggtagtggtggtcacgcctactacgcagagtccgtggaacgggccattccaccatctccagagacaccttccgaagaaccacgtctgtatctgacgaatgaacngccgtgagcgtcgagacacgcatatattacgngngacgaanctcctaggacgtacctaactaccaccgtnacgttcaaggttcttcgggttacccgacccggtcggggacccgacgggtaacccgtcggtaccnccgttcctcctacaccgtccctacccgaccgacggacccacgttcccgtacccttccccgtcgccctaccctcctaccgaacgaccgacctaccgtacggtcggggcaccgacgtccggcccgtgggacctcggtccgttagtaccgtaccggtacgttaccgttcggtacgttacgtacgtacgg

SEQ ID NO: 293675 - DNA, 623 bp, Homo sapiens
  misc_feature: GYAE6OF02H06O3.16.10.A10.1.454.CMB.1.raw
  modified_base (253)..(253): a, c, t, g, unknown or other
  misc_feature (253)..(253): n is a, c, g, or t
  modified_base (256)..(256): a, c, t, g, unknown or other
  misc_feature (256)..(256): n is a, c, g, or t
  modified_base (276)..(276): a, c, t, g, unknown or other
  misc_feature (276)..(276): n is a, c, g, or t
  modified_base (282)..(282): a, c, t, g, unknown or other
  misc_feature (282)..(282): n is a, c, g, or t
  modified_base (348)..(348): a, c, t, g, unknown or other
  misc_feature (348)..(348): n is a, c, g, or t
  modified_base (502)..(502): a, c, t, g, unknown or other
  misc_feature (502)..(502): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcaccttagcggttatgccatgagctgggtccgccaggctccgagggaaggggctgggagtgggtctctaacgtttttagtggtagtggtggtcacgtcctactagcagagtcgtgaaggccgattcacntcncagagacactcgagaacacnctgtanctgcgaaatgaactacgcgtgagagtacggagaccgacggccaatattattactgtagacgaaaanctcctaggacgtcctaactacctacctcagtcagtcgtcggtttaccccgacccggtcgggacccgtacgggacccgtacggtcctaccgttcctccacgccgtaccctacaacccggtacgaccgacgttccgttcccttccccgcgtacccnccccgttccctaaccgaacgaccaccgtaaccgtcggtaccgggacaccgacggcccgggccgtcggccgttcggtccgtacggtacgaacgttctaccgttccgaacgtcgtactacggg

SEQ ID NO: 293676 - DNA, 716 bp, Homo sapiens
  misc_feature: GYAE6OF02IL5N4.16.10.A10.1.454.CMB.1.raw
  modified_base (157)..(157): a, c, t, g, unknown or other
  misc_feature (157)..(157): n is a, c, g, or t
  modified_base (350)..(350): a, c, t, g, unknown or other
  misc_feature (350)..(350): n is a, c, g, or t
  modified_base (360)..(360): a, c, t, g, unknown or other
  misc_feature (360)..(360): n is a, c, g, or t
tcagtgtactactccacgaccggtgctcgatttagcgtcgatctcagggtcttcgtgctcacgtccaccaccacgcatgtgacctcaggggtccctgagactctcctgtgcagcctctggacttcacccttagcggttatgccatgagctgggtccnccaggctccgagggaagggctggagtgggtctcaactttttagtggtagtggtggtcacgctactacgcagacgtccgtagaagggccgattccaccatctaccagacgactacttccgaagaaccatgactgtatcgtagctaaatcgaacagtctagaggacgtaccgaggacacggccattaatattacngtgacgaaantccgtagacgtacctaatacccacgttcgaactcaggtccctttaggttacccgtacccgtcggggtaccgaaccgggtaaaccgtcggtaccgtaaccgtccgtccctaccacgtacccgtaccctaaccgaaccgggtacccgtaacgttcccgggttaccctttcccccggtcggaaccctaccccgttaccctaacccgtaaacgaccgtacctacccggttccggtacgggggtaccaccggtacgggtccccgggtcccggtacgggtaccgttccggtaccccgttacgggtacccggtaacgggtaccgtttaacccggtttaccggtaacggttaacgtaaacccgg

SEQ ID NO: 293677 - DNA, 906 bp, Homo sapiens
  misc_feature: GYAE6OF02JUXE2.16.10.A10.1.454.CMB.1.raw
tcagtgtactactccacgaccggtgctcgatttagcgtcgatctcagggggtgggtccgaggaggcagaactctgggtgtctcaccatggcctggatccctctacttctcccctcctcactctctgcacagctctgaggcctcctttgagttgacacacgccaccctcggtcgtcagtcgtccccgaggacagacggccaggataccacctgctcttcagatcgctattcgccaaggccaatatcggtctttacgttcggttaaccgacgtaccgaacgaaacgtaccccggaacgggcccgtaacccgggcccccgttgggttcggggtacgggtttcggaattaacgtaagttaaaacgaacctaccacgaacgaacgggtcccctacggaaggacgtccgacggggtcgtaaccttcgtccgtcgggtaccctacgtaccgtactaccggacggggtaacgaccgtaaggttaccgaacgtttccggaaccgtaccggtttacggggacggttaaccgggtcccggaacggacggtaacggaaacgggtacggggtaacggggtacggttaaacggttcgttttaaaccgttaggggttacccgtaaagggttcccgttaacgaaacccgtaaaaccgacccgtaacccgttacgttaccggaccgggttacgggttaccgggggtttacccgggaacgggggtaacccggggttaaacccgtaaaccggtacgggttaccccgggtacccgtacccggttacggtaaccccgggttacccggaacccgggtaaccccggaacccgggtcccgttaccccccggggtacccccgtttacccggggtaacccctttccccgggtttaacccggtttcccccggttcccccggttaccccccggg

SEQ ID NO: 293678 - DNA, 614 bp, Homo sapiens
  misc_feature: GYAE6OF02HH6FW.16.10.A10.1.454.CMB.1.raw
  modified_base (228)..(228): a, c, t, g, unknown or other
  misc_feature (228)..(228): n is a, c, g, or t
  modified_base (232)..(232): a, c, t, g, unknown or other
  misc_feature (232)..(232): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgaactgggtccgccagactccagggaaggggctggagtgggtcgcatccattagtggtggtaataattacatatactacgganactnaatgaagggccgcttcaccatctccagagaacaacgaccgaaaactcactgtatctgacagaatagaacagcctagagacgaccgaagacgacggctgtgttaattacgtgtgcgaagaggttcttaataattaggttcgggtaattaaataagtaaacgtaacgttatttcgattcgttggtaggggccggtggacctacccgtgtcctcgtcgttcctccctcgacgccctcccaaccgaacggcccacgttccggtcccttcccccgtgccctaccctacctccaagacgacctacccgtacgtcggggtaccacgacggccggtcccgtgggcctcggtaccgtcggtaccgtaacggaaccttaccgtacgtaacgg

SEQ ID NO: 293679 - DNA, 694 bp, Homo sapiens
  misc_feature: GYAE6OF02JR8SU.16.10.A10.1.454.CMB.1.raw
tcagtgtactactccacgaccggtgctcgatttagcgtcgatctcagggggtgggtccaggaggcagaactctgggtgtctcaccatggcctggatccctctacttcctccccctcctcactctctgcacaggctctgacggccttccttttgagttgacacacgcccaccctcggtgtcagtcgtccccaggacagacggccaggactcacctgcctcttcagatgctattcgaccgaaaggctaaattacttcgtcctttcgtttacggaacctagcaaggaacgccgacggccgacggccccgttggtcggtggtgatataataaacgacacacgacgacggcccacgacgggctaccggtcgggacgtactctcgtcggcctccacgcgtacgacgggacgacgtacgtacgtacggttcgaacgtacggtcggtacggacgtccgaaggtcaagggtacgacggtagggtacgtacgttacgttacgtcgtacgtacgtcgtaccgaactaaacgaccctacgtacgtaccggtacggtaccgggttcgggttaccgggaccgggacgggtaacccgaacgttccggtacggtacccggtcgtcggtaccggtccgtaccggacccgtaacgtcccgtcccggtaccccgtccggtacctcccggttccttcccgttaccctaccccgg

SEQ ID NO: 293680 - DNA, 720 bp, Homo sapiens
  misc_feature: GYAE6OF02H98US.16.10.A10.1.454.CMB.1.raw
  modified_base (200)..(200): a, c, t, g, unknown or other
  misc_feature (200)..(200): n is a, c, g, or t
  modified_base (285)..(285): a, c, t, g, unknown or other
  misc_feature (285)..(285): n is a, c, g, or t
tcagtgtactactccacgaccggtgctcgatttagcgtcgatctcagggtcttcgtggctcacgtccaccaccacgcatgtgacctcaggggtccctgagactctcctgtgcagctctggattcacctagcggttatgccatgagcgtcgggtccgccaggctccgagggaagggctaggagtgggtctcaacttttagnggttaggtggtggtcacgcctactacgcagagtccgtagaagggccattcacgatcctcagtagacacttccgaagaacctacgntacgtatcgtgctaagtagaacacgcctgaagtacgccggaagaccacggttccaattaacgttattaacgtgtagacgtaaaagcttcctggaacggtcccttaaacgaccctactaccgtagttaccacggtctacgggtttcccgaccccgtcgggaacccgtacgggtaaaccccgtcgggtaccgtacccgttacctaccgttcccacggtccccttacgaacccggaaccgggcccacggttaccgttccctaccccgttcggacccctaacccgttccctacccgaacggtacgaccttacccggtacggttccgggaccgaccgaccggtacccggtcccgtaacggtccggtacgtacccgttacgggtaaccctaaacggtcccgttaaccggtttacccggtaaacggttcgtaaacccgtacg

SEQ ID NO: 293681 - DNA, 799 bp, Homo sapiens
  misc_feature: GYAE6OF02HK18I.16.10.A10.1.454.CMB.1.raw
  modified_base (203)..(203): a, c, t, g, unknown or other
  misc_feature (203)..(203): n is a, c, g, or t
  modified_base (275)..(275): a, c, t, g, unknown or other
  misc_feature (275)..(275): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattccacccttagcggttatgccatgagctgggtccgccaggctccgagggaagggctggaggtggtctacaacgttttagnggtagtggtcggtcacgcctactacgcagagtccgtgaagggccgatcaccatctcgagagaccattccganaacacgctagtatctgacgtaatgaaccagcctaggagacggtcgaggacgaacggcctaagtattagttaactggtagaacgaaaagtctccgtagacggtaccttaagacccaaccttcgaacgttaccaggcgttcgggtttacccggtaacccccggcgggggtacccgtaacggggaaacccccgttcggtacccgacccggtttcctaccgtaccgaaccgcccttaaccccgaaccggtaaacccggccctaacccggtttacccgggttcccctttaccccccggtcgggtacccccctaacccccgttccccgtaaccccgtaaaggtacccggtaccctaaacccggtcccggttacggggggaacccaaccccgggtaaccggggtcccccgggtccccgggttaccgggggtacccggttccgggtaaccccggttccgggtaaccgttaaccgggttaacccttacccgggtttaaccggttaaccggttaaccggtaacgtaaccccggg

SEQ ID NO: 293682 - DNA, 757 bp, Homo sapiens
  misc_feature: GYAE6OF02IO1BW.16.10.A10.1.454.CMB.1.raw
  modified_base (225)..(225): a, c, t, g, unknown or other
  misc_feature (225)..(225): n is a, c, g, or t
  modified_base (562)..(562): a, c, t, g, unknown or other
  misc_feature (562)..(562): n is a, c, g, or t
tcagtgtactactccacgaccggtgctcgattttagcgtcgatctcagggggtgggtccaggaggcagaactctgggtgtctcaccatggcctggatccctctacttcctccccctcctcactctctgcacaggctctgacggcctccttttgagttgacacacgccacccgtcggtgtcagtcgtacccaggacagacggccaggtactcacctgctcttcagntgctattcgaccaaggacaatagtcgtctttcgttacggtaccacggcaaggaacgcccgacggaccgtaccggccccgttagggtcgggttggtagtaacttaagtaaagtaaaacgacaaccgaacggacgggaaccggtaccccgtaggtaaccgggtactccccggttaggggaccttacgttacgtccgtacggtcctaccgtaacgtcgacgggaacggacgtaactaggtaccttacgtacgaccgtaagtcgggtaacggacgtacccggaggtacgaacggaaaggtacgggaaggttacgacttaagttaccgtgttacgtacgtanaccgtaacgaaacctaccgacgtcgtaccgtaaagggcgggtttaaccggtacggggtaccggtaacgggtaaacccgtaaggaccgttaccgtaccggtaccgtaggtcccgtaacggacccgtaccggtaacggtcccgtaccgtccccgttcggttacctaccccgttacgttcccggttcccctaccccgg

SEQ ID NO: 293683 - DNA, 659 bp, Homo sapiens
  misc_feature: GYAE6OF02ITF6X.16.10.A10.1.454.CMB.1.raw
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagcgtggggtccgccaggcctcccgaggggaacggggtctggaggttgggtcctactaacgtttttaggtggtagtgggtggtcacggtcctactacgcagacggtccgtggaacgggccgattccacctatcctccgagagaccacttccgaagaaccacgctgtatctgacgaatgaacagcctagagagtcgaggacacggccatatattacgtgtcgacaaagtctctaggacgccctagtacccacctacgtagtacagtccgttcgggtccgtaccccggtcggggacccgtacgggaacccgtcggtacccgtcccgtactcccgtaccaccgtcccgtaacccgaaccgaaccggaccctacgtcccggttccctccccgtcggccctaccctacccgtaccgaacgacgtacctaccgtcggtcggggaccaccggtacggccgtccggcggccgtcggtaccgtcggaacgacgtacctaccgttacgacggtacgtcgtacg

SEQ ID NO: 293684 - DNA, 635 bp, Homo sapiens
  misc_feature: GYAE6OF02GPJJ9.16.10.A10.1.454.CMB.1.raw
  modified_base (157)..(157): a, c, t, g, unknown or other
  misc_feature (157)..(157): n is a, c, g, or t
  modified_base (202)..(202): a, c, t, g, unknown or other
  misc_feature (202)..(202): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccnccaggctccgagggaaggggctggagtgggtctctaacttttagnggtagtggtggtcacgcctactacgcagagtccgtgaacgggccgattcacatctccagagacacttccgagaacacgctgtatctgacaatgaacagtcctgagagtcgagacacggcatatattactgtacgacgtaaaagctccgtaggacggtacctaactaacccaccttacacgttacaaggtccgtacgggtttaccccgaccccggtcggggacccgaaccggggtaacccgtcggtcccacccgttcctcctccgaccgtccctaccgaacccgaaccggccctacgtccgttcccttccccgtcgccctaccctccctaccgaacgaccgccaccgtcggtacggggccacgacggccggcccggtggccgcgtccgttcggtaccgaacggtaccttaccgtaccggtacgtacgactacgg

SEQ ID NO: 293685 - DNA, 716 bp, Homo sapiens
  misc_feature: GYAE6OF02HIAV5.16.10.A10.1.454.CMB.1.raw
  modified_base (303)..(303): a, c, t, g, unknown or other
  misc_feature (303)..(303): n is a, c, g, or t
  modified_base (336)..(336): a, c, t, g, unknown or other
  misc_feature (336)..(336): n is a, c, g, or t
  modified_base (350)..(350): a, c, t, g, unknown or other
  misc_feature (350)..(350): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattccacccttagcggttatgccatgagctgggtccgccaggctccagggaaggggctggagtgggtctcaacttttagtggtagtggtggtcacgcctactacgcagagtccgtaggaagggccgattccaccatcctccagagacaccttccgagaacacgctgtatctgcaatagaacngctgagagcgaggacacggccatatattactgngacgaaagctccgngacggtacctaactacccacctacacgtactacgccttccgggtttcccgaccccggtccggggaccggaaccggggtaaccccgtcgggtaccgcccgttccttcccgtcaccgtccctacccgaacccggaaccgggacccctaccgttcccggttccccttcccccggtccgaccccgtaccccttacccgtacccgaacgacgacccgttaacccgtccgggtaaccgggggcccaaccggaccgggtacccgggtaccccgttcggggtccgttaccggccggtttaccgggtaaccggtaaaccgggttacccgttacccggttaacccgggtaaggtttacccggtaacgtaacccggg

SEQ ID NO: 293686 - DNA, 694 bp, Homo sapiens
  misc_feature: GYAE6OF02G6F9H.16.10.A10.1.454.CMB.1.raw
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccgagggaaggggctggagtgggtctctaacttttagtggtagtggtggtcacgcctactacgcagagtccgtgaagggccattccaccatctccagagacaccttccgagaaccacgcttagtatacgtgacgaatagaacagcctggagagtacggaggaccgacggccaatatacttactgtgacgaaagtactccgtaggacgtacctaactacccaccgtacacggtcaggtcccgttcgggttacccgaccccggtcgggacccgaacgggtaccccgtccggtcccgtacccgttcctcccgtccaccgtcccctaccgacccgaaccggccctacggttcccgttcccgttcccccgtcgacccctaccccttacccgtacccgtaaacggaccgtacccgtacccggtccggtccgggggtacctaccggaccggcccggttcccggtacgggtccctcggtcccggtacggttaccgaacggtaccttacgtacccggttaacggtacgtaccgtaccgg

SEQ ID NO: 293687 - DNA, 695 bp, Homo sapiens
  misc_feature: GYAE6OF02FWW1L.16.10.A10.1.454.CMB.1.raw
  modified_base (207)..(207): a, c, t, g, unknown or other
  misc_feature (207)..(207): n is a, c, g, or t
  modified_base (265)..(265): a, c, t, g, unknown or other
  misc_feature (265)..(265): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagcgtgggtccgccaggctccgaggggaaggggctgggagtgggtctctaacgttttaggnggtagtggtggtcacgcctactacgcagacgtccgtggaagggccgtattcaccatcnccagagacacttcgagaacacgctgtatctgcgaatgaacagcctgagtacgtcggaggaccacggaccagttatattatgtgagaaagctcgtgacggtacctataaccacctcaagtcacgcgttcgggtaccgaccccggtcgggacccgtacgggaacccgtcgggtaccgtacccgtccgtcctaccgaccgtccccttaccgaacccgtaacgggtacccctaacggttcccggttaccctttcccccggtaccggtacccctaccccgttcccgtacccgaaacgtaccgacccgtaacccgtccgggtacgggggacccaccggccggacccggtacccggtcgggtccgtccggtcccggttacggtaaccggtaacggtaccttaaccggttaccgtaacggttaccggtacctaccggg

SEQ ID NO: 293688 - DNA, 597 bp, Homo sapiens
  misc_feature: GYAE6OF02FGN5Y.16.10.A10.1.454.CMB.1.raw
  modified_base (591)..(593): a, c, t, g, unknown or other
  misc_feature (591)..(593): n is a, c, g, or t
  modified_base (595)..(597): a, c, t, g, unknown or other
  misc_feature (595)..(597): n is a, c, g, or t
tcagtgtactactccacgaccggtgctcgatttagcgtcgatctcaggggtccctgagactctcctgtgcagcctctggattcacccttagcggttatgccatgagctgggtccgccaggctccagggaaggggctggagtgggtctcaactttttagtggtagtggtggtcacgcctactacgcagagtccgtgaagggccgattcaccatctccagagacaccttccgagaacacgctgtatctgcgaatgaacagcctgagagtcgaggacacggccatatattactgtgacgaaagactccgtgacgcctataccacctcagtcagtcgttggttccgaccccgtggggacccacggggtaacccctggtaccaccgtcctccgtcacgccctacccgaccgaacgggcccagttccggttcctcccccgtggccctacccctccctaccaacgacgcccaccgtcggtcgggggcctaccgacggcccggtcccgtcgggcctcgccgttcgggtacgaacggtaccttaccgtccgtagtcgtacacgtgacggcgggtcgtcggacggacggcgacgacgtagnnngnnn

SEQ ID NO: 293689 - DNA, 818 bp, Homo sapiens
  misc_feature: GYAE6OF02IQYB8.16.10.A10.1.454.CMB.1.raw
  modified_base (264)..(264): a, c, t, g, unknown or other
  misc_feature (264)..(264): n is a, c, g, or t
tcagtgtactactccacgaccggtgctcgatttagcgtcgatctcagggtcttcgtggctcacgtccaccaccacgcatgtgacctcaggggtccctgagactctcctgtgcagccctctggattccacccttagcggttatcgccatgagcgtggggtccgcaggctccgaggggaggggctgggagtgggtctctaactttagtggtagtgggtggtcacgcctactacgcagtacgtccgtagaagggccatcaccatccncagagactactccgagaaccacgtctgtatctacgacgaatagaacatccgtagagacgtcgaggacacgaccagtattatactggtacgagaaagtctaccgtgacgggtaccttaactaaccccgtacctacgtaaccgtacaacggttccggttaccgggtttacccgggaaccccgggttcggggaacccggtaacccggggtaaaccccggtcgttacccggtaacccgttccgtaccccttacccggtaccgtcccttaccccgaaacccggtaacccgggtaccccgtaccggttacccggttcccccgttaccccggttcccgggtaccctaccccccgttaccccgtaaccgtaacccggaccgtacccgtaccccggttacgggtcccgggggtaccctaaccgggacccgggtccccgggttccccgggtcccggggttccgttcccgggtaccccgtttacgggtaaccccgggttaaccggttaacccgggtttaaacccggttacccggttaacgggtttaccgtaaccggttaaccggg

SEQ ID NO: 293690 - DNA, 765 bp, Homo sapiens
  misc_feature: GYAE6OF02G8SFJ.16.10.A10.1.454.CMB.1.raw
  modified_base (205)..(205): a, c, t, g, unknown or other
  misc_feature (205)..(205): n is a, c, g, or t
  modified_base (239)..(239): a, c, t, g, unknown or other
  misc_feature (239)..(239): n is a, c, g, or t
  modified_base (300)..(300): a, c, t, g, unknown or other
  misc_feature (300)..(300): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattccacccttagcggttatgccatgagctgggtccgcaggctccgaggggagggctggaggtggtctacgtaacgttttaggnggttaggtggtggtccacgtcctacgtacgcagngtccgtaggaacgggccattaccacctatcctaccaaggacgtacctaccgttaccggaanaaccaccgtctagtactcgtggaaccgaagtagaacctcggcccgttaggaaggtacggtaccggaaggggtacccaccgggtacctaaacttaagtttaactttaacggtggttaacggaaacggtaaaacgttccgtacccggtaagggtacccggtaacccttaaccctaaaccccgtacttacgaagtacccgtaggtcccgtttaccgggttaccccggaaccccggggtccggggtaaccggtaacccggggtaccccgtacggtacccgtacccgtccttccctacgaccgtccctacccgaaccgtaaccggccctacgttcccgttccctcccgtccgcctaccctcctaccgacgtaccacctcccgcggtcggaccacggccgccggtccggtcggccgtccgccgttacggtaccgaacgtaccgtacgttaccggacgttacggtactacgg

SEQ ID NO: 293691 - DNA, 735 bp, Homo sapiens
  misc_feature: GYAE6OF02GM6AK.16.10.A10.1.454.CMB.1.raw
tcagtgtactactccacgaccggtgctcgatttagcgtcgatctcagggggtgggtccaggaggcagaactctgggtgtctcaccatggcctggatccctctacttctcccctcctcactctctgcacaggctctgaggccttcctttgagttgacacagcccaccgtcggtgtcagtcgtccccaggacaggcggccaggactcactgctcttcagatgctagttcgaccgaaggctaatagtcgtcgttcgttacggtaccagacgaaggaacgccgacggacccaccgggtcccctgggtcgggttggtcgtaattacgttaaagtaaacggaacaaccgaacggtaacgggaccggtacccctgggaaacggggtaccgttaccccggtgggtaccgttactttccggtacgtcggtaccctacgacgtctcggaacgggacgacgtacgtaccgtacgtacgacccgtaggtccgggtagtccggtacgagggtacgaagggaacgcggggtaagggtcgtagttaacgttcgtacgtacggttacgtaccgtacgaaacctaaaccaccggttacgcgtacgtcgggttacgggtcgggttcgggaaccgggtaacggtaaccgacggtcccgttacgaccgttccgacggtccgtacgacccggtcgaaccggtccgtacccgtccccgttccgtcctacccgttccgttacccggtccccttcccgg

SEQ ID NO: 293692 - DNA, 729 bp, Homo sapiens
  misc_feature: GYAE6OF02HHQZG.16.10.A10.1.454.CMB.1.raw
  modified_base (236)..(236): a, c, t, g, unknown or other
  misc_feature (236)..(236): n is a, c, g, or t
  modified_base (252)..(252): a, c, t, g, unknown or other
  misc_feature (252)..(252): n is a, c, g, or t
tcagtgtactactccacgaccggtgctcgatttagcgtcgatctcagggggtgggtccaggaggcagaactctgggtgtctcaccatggcctggatccctctacttctcccctctcactctctgcacaggctctgaggcctcctttgagttgacacagcccaccctgggtgtcaggtcgtcccaggacagacggcaggactcacctgctcttcagatgcattgaccaaggcaatangtacttcttaggaccngacgaagagtaccgaggtccgaacggcccctggtggtcggtagtactagtagtaaaggacacgtaacgaggacggcctacgacgggactcccgtagggcgtacgttgtacgtcggccttaccgagtcgtacgaacgggtacgacgtacggttaccgaacgttacgacctaggtaccggtaggtacgtaccggaggactaaagggaacggtacgggtaacggtacgtacgttacgttacgtcgttacgtacgttacgtacgaaccgtaaaccacgtaccgtacggacgtacgggttccgggtacgggtcgggtaaccgggacggggtaaccgtaacggtcgtaccggtacccggttacgtacggttcccggtaacggtaccccggtacggtacccgggttacctaccccgggttccccgttaccggttacccgttacccggttacccggtttaccccgtaccccggtttaacccccgg

SEQ ID NO: 293693 - DNA, 806 bp, Homo sapiens
  misc_feature: GYAE6OF02FWSQ9.16.10.A10.1.454.CMB.1.raw
  modified_base (340)..(340): a, c, t, g, unknown or other
  misc_feature (340)..(340): n is a, c, g, or t
tcagtgtactactccacgaccggtgctcgatttagcgtcgatctcagggggtgggtccaggaggcagaactctgggtgtctcaccatggcctggatccctctacttctcccctcctcactctctgcacaggctctgaggcctcctttgagttgacacagccaccctcggtgtcagtgtccccaggacagacggccaggatcacctgctcttcagatgcattgccaaggcaatatgtcttcttggacctaggccagaagccgaggtccacggtcccctgtcggtggtcgaatataataaacggacactacgagacggcctagaggactccgtgggcattcncgtggctcgtagcgtacgagggtaccacgtacgtacaccggtttacgaacccgtaggttaccggggtagggtaccgttacccgaaggggtccgaaaggggaaacgggtaacgggtaacgggggttacgtaaaccggtttaacgtttaaaccgttcgggttaacgttaaccgggttccgtttaacggaaccttaaaaccccggaacctaaccggttggaaccgtacgggtaccggggtttaccggtttccggggggaaccgggttaaaccgggggaaaccgttaaaccggtacgggtttaccccgggtaaaccccgggttcccggtttacggggaccccggtttaaccgtaaacccgggacccccgggttaaagggtccccgttaacccggggtcccccccgtttacggggttacccctaccccggttttaccgtttcccccgggtaaccccccgggtttacccccc

SEQ ID NO: 293694 - DNA, 867 bp, Homo sapiens
  misc_feature: GYAE6OF02GJEBJ.16.10.A10.1.454.CMB.1.raw
  modified_base (135)..(135): a, c, t, g, unknown or other
  misc_feature (135)..(135): n is a, c, g, or t
tcagtgtactactccacgaccggtgctcgattttagcgtcgatctcaggggggtggggtccagggaggcagaactctgggtgtctcaccatggcctggatccctctacttcctccccctcctcactctctgcacnggctctgaggcctcctttgagttgacacagcccacccgtcggtgtcagtcgtccccgaggacgaggaccggccaggactcaccgtcgcttcttacgagactgctagttcgaccgaaggtactaagtacttcgtccgtttacgttacggtaaccaaggacgaacggaacggcccgaacgggccccgaccgggtccccgttagggttcggggtggttacgtaagttaacgtaaagtaaacgacaacgacggaacggaccggcccgtaggacgggtacctccggtacgggactacgttcgtcgtccgccgttaccgacggtacgtacggaacgggtaacgacgtacggcgtaacggttccgtaacgacgggttacgggtgggtaaccggtccgggaacgggtacggaacgggaaccgggaacgggttacgggttaacggtacgtttaacggttaccgttacggtaaccgttacggttaccgtaaccgtaacccggaaaacctacccgaacgttaccggaccggttacggtaccggggttacgggtttcccggggaccgggtaaaccgggtaaccgaaccggttaccggtaccgggttacccggttccgtacggacccggtaaccggtaacccggtaccgggtaacccggttcccggtaacccccggtccccggtttaccggtccccgtttacccggtaccccggtttaccccggttccccccggttaaccccggg

SEQ ID NO: 293695 - DNA, 784 bp, Homo sapiens
  misc_feature: GYAE6OF02JRG6I.16.10.A10.1.454.CMB.1.raw
  modified_base (177)..(177): a, c, t, g, unknown or other
  misc_feature (177)..(177): n is a, c, g, or t
  modified_base (204)..(204): a, c, t, g, unknown or other
  misc_feature (204)..(204): n is a, c, g, or t
  modified_base (259)..(259): a, c, t, g, unknown or other
  misc_feature (259)..(259): n is a, c, g, or t
tcagtgtactactccacgaccggtgctcgatttagcgtcgatctcaggggtgggtccgaggaggcagaactctgggtgtctcaccatggcctggatccctctacttctcccctcctcactctctgcacaggctctgacggcctcctttgagttgacacagcccaccctcggtgtacngtcgtccccaggacacgacggccaggntcacctgctacttcagatgcattgccaaggcaatagtcgcttcgttacggtaccnggtcaagacgccaggtccacggcccctggtggtcgtgaacgttataagaaaacgtacaacgaacaaggaccggaccccttaggacgggtaacctcccggaggggtacctacgtttccgtcgtacggtcccgtaccgttaacgcgtaacgggacgaacgtaacggtctaaccgggtacgtaaccgtaccggtcggtacgggtcgggtaacccgtacggtacgggaaacgtaacgggtaaacgggacggtaacgggggttaacttaaacgttaacggttacgtaccgtacgggttaacgttacgtacggaaaccctaaaacgtaccgtcgaacgtaccggaacggttccggggttaacgggtccggggttaaacgggaacccggtacggtaaaccgtcgggtaacccgttaccgtgggttacccgtaccggtaaccggaccgtaaccgggaaccgttacccggtcccgtttacccccggtcggtaaccttcccggttaccgtttacccccgtccccggttaacccgg

SEQ ID NO: 293696 - DNA, 613 bp, Homo sapiens
  misc_feature: GYAE6OF02FLPYH.16.10.A10.1.454.CMB.1.raw
  modified_base (201)..(201): a, c, t, g, unknown or other
  misc_feature (201)..(201): n is a, c, g, or t
  modified_base (262)..(262): a, c, t, g, unknown or other
  misc_feature (262)..(262): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaactttttagnggtagtggtggtcacgcctactacgcagagtccgtgaagggccattcaccatcctccaganacacttcgagaaccacgctgtatctagcgaatgaacagcctgagtacgtcgagaccgacggccataatattactgtgacgaaagtatccgagacggtcctaacgtacccgacctcgacgttccgagtccgttcgggttccgaccccggtcgggccgaacgggaacccgtcggtaccgtacccgttctccgtccacgccctaccaccgacggccctacgtccgtccttccccgtcgccctaccctccctaccgaacgacgcctaccgtcgtcggggccacggtaccgccggtccgtcggccgtcgtccgtcgtaccgtacgtacgttaccgtacgtacggtacgtacgtacg

SEQ ID NO: 293697 - DNA, 764 bp, Homo sapiens
  misc_feature: GYAE6OF02H5L4L.16.10.A10.1.454.CMB.1.raw
  modified_base (142)..(142): a, c, t, g, unknown or other
  misc_feature (142)..(142): n is a, c, g, or t
  modified_base (417)..(417): a, c, t, g, unknown or other
  misc_feature (417)..(417): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattccacccttaggcggttangccatgagctcgggtccgccgaggcctccgaaggggaggggctgggaggtgggtctctaacgttttaggtggtaggtggtggtcaccgtcctactacgcgaggacgtccggtaggaacgggcctattcaccatcctaccagagacctaccttacgaagtaacaccgtctgtatcgtgacgtaatcgaaccacgtcctaggagacgtcggacggaacgaccgcctaatattactacgtggacgaacgaagcttccgtagacggaccttaacacccnctacgtatacgtacgtcctcgggttacccgcccggtacggggacccggtaaccgggtacccgtcgggtaccgtacccgttaccgtcccgtaccgcgtaccctaccccgtaaccggaacccggtccgtacccggttacccggttcccgtacccccgttccggtaccccttacccccgttcccgtacccgaaccgaccggtaacccgtcccggtaccggacccggggaccgaccggacccgggtccccggtaccggtccgggtccggttcccggacccggttaccggtaacccggtacggttaacccgttaccggtttaacccggaacggttacccgtaagtaacccgg

SEQ ID NO: 293698 - DNA, 751 bp, Homo sapiens
  misc_feature: GYAE6OF02F5VDK.16.10.A10.1.454.CMB.1.raw
  modified_base (119)..(119): a, c, t, g, unknown or other
  misc_feature (119)..(119): n is a, c, g, or t
  modified_base (158)..(158): a, c, t, g, unknown or other
  misc_feature (158)..(158): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctcnggattccaccttagcggttatgccatgagctcgggtccnccgaggctccgagggaagggctgggagtgggtctactaacgttttagtggtagtggtggtcacgcctactacgcagacgtccgtaggaacgggccattccgaccacttcctccagtacgactacttccgaagaaccacgtctaggtactcgtagacgtaatacgaaacagtcctggaacggacggtacggaacggaaccgaccgggtacccaaagttaacgttacttacgttcggtacgaacgaaaagtcttacccgtaggacggtacccttaactaccctaacctacgacgttcgacggtccctttacggggtttaccccaccccgggtcggggaacccgaaccggggtaacccccgttcggtaccctacccgggttccctcccgtaccgaccgccccttaaccgaaccgaccgggtccctagtcccggttaccccttccccgtacggtcccctacccgtcccctaaccgaacgtaccgtcccgtaccgttccggggtggacctaccgggtgtacccggtcccgggttggaccctcgggtacccgtcggtaaccgcgtaaccttcggtacccgtagtaccgtacgtacccgg

SEQ ID NO: 293699 - DNA, 761 bp, Homo sapiens
  misc_feature: GYAE6OF02FZYX7.16.10.A10.1.454.CMB.1.raw
tcagtgtactactccacgaccggtgctcgatttagcgtcgatctcagggggtgggtccaggaggcagaactctgggtgtctcaccatggcctggatccctctacttcctccccctcctcactctctgcacaggctctgaggccttcctttgagttgacacagcccacccgtcggtgtcagtcgtccccgaggacaggaccggccgaggatccaccgtgcttctacgagagttcgcacttacgacccgaaggactaatatcgtacctttcgttacggtaccagacgaacggaacgcccgacggacccgaacggtcccccgttgggttgggttggtagtaagttaataaacgtaaacgaacaaccgtaacgaaggtaccggccccgttacggacgggtacctcccggtggggacttaacgtttccgttacgtcggtcctaccgtacgtccgtacggacgggacgtaacgtacgtaccgtaacgttaccgtaaccgtacggttacgggtacggtaccggtaccgaaggtacgaagggaacggtaccgggtagggtacgtaaccgttaagttaccgtacgtacgtaagtcgtacgaaccaaccacgtaccgtagcgtacggtacggtcgggtacgggacgggaccgggaactaacggtccgcgtaccgtccgtacggacgtcccgaacggcccggtaacggtcccgttcccggtacccccggtgttacccgtccggttacccgttcccgttaccccgtacccccg

SEQ ID NO: 293700 - DNA, 890 bp, Homo sapiens
  misc_feature: GYAE6OF02GG7EH.16.10.A10.1.454.CMB.1.raw
tcagtgtactactccacgaccggtgctcgatttagcgtcgatctcagggggtgggtccaggaggcagaactctgggtgtctcaccatggcctggatccctctacttctcccctcctcactctctgcacaggctctgaggcctcctttgagttgacacagcccaccctcggtgtcagtgtccccaggacagacggccaggatcacctgctcttcagatcgctatcgccaaaggactaaatatcgtctttcgttcggtaccagcaagaagtccgaggaccaggcccccgtggtcggtgtgatataagtaagaacacgacagacgcctacgaggacgtcccgtgggaccgtacgttctcggtcggtctcccgtacgtaccgtcgaacggggaacgtaacgtacgtaccgtaacggtttccgaacccgtaacggttccggggtacggtaccggttaccgtaaacggggaccgaaacgggtaaacgggaaacgggtaacgggggttacggttaaaccgttaacggttttaaccgtcggtttacggttaaacggttccgttaacggaaaccccgtaaaaaccgtaccccgtaaacgttacggtaaccggtaaacccgggtacccggggttttaccgggggtttacccgggggaacccgggggtaaaacgggggtaaccccgtaaaaacggggtttcccggtttacccggggtaaacccccgggtttccccgggttacgggtaacccgggtttaaccccgggaacgggtacccccccgggtaaaggggtttcccccggtaaaccccgggttccccccccggttccgggtttaacccccggttaacccgtttcccccggttttacccggggtttacccccccctttccccccccgggg

SEQ ID NO: 293701 - DNA, 736 bp, Homo sapiens
  misc_feature: GYAE6OF02H8718.16.10.A10.1.454.CMB.1.raw
tcagtgtactactccacgaccggtgctcgatttagcgtcgatctcagggggtgggtccaggaggcagaactctgggtgtctcaccatggcctggatccctctacttcctccccctcctcactctctgcacaggctctgaggccttccttttgagttgacacagcccaccctcggtgtcagtcgtacccaggacacgcggccagatcacctgtctcttcagatgactattcgacccaaaggacaaattagtcgtctttacgttacggtaccagactaaggaacgaccgacggaccgacggccccgtgggtgggtggtacgtaattaataacgtaaaacgactaaccgaacgaacggtaccggacccgtacggacgggtaccgttcccggtagggtaccgttacgtttcctacggtcggtacctccgtacgtccgtacggtacgggaaccgaacgtacggttaccgtacgtaccgtaccgtacggtacgggtacggtacgtacggacggaacgaagggaaggacgggtagtacgtacgttacttacgttagtccgtaattacgtacgaacctaaaccgactacgtcgacgtacggtcggtcgggtacgggaccgggacggacccgtagtccgttaccgggaccgtccgtacgtaccgcggaacccggtacggaccggttcctccccgtcccggtacgtcccgttaccggttcccgttaccccgtacccttacccccgg

SEQ ID NO: 293702 - DNA, 793 bp, Homo sapiens
  misc_feature: GYAE6OF02FNUWQ.16.10.A10.1.454.CMB.1.raw
  modified_base (289)..(289): a, c, t, g, unknown or other
  misc_feature (289)..(289): n is a, c, g, or t
  modified_base (292)..(292): a, c, t, g, unknown or other
  misc_feature (292)..(292): n is a, c, g, or t
  modified_base (312)..(313): a, c, t, g, unknown or other
  misc_feature (312)..(313): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattccacccttagcggttatgccatgagctgggtccgccaggctccgagggaaggggctggagtgggtctactaacttttaggtggtagtggtggtcacgtcctactacgcagacgtccggtggaagggccgattccaccatcctccagacaccaccttccgagaacncgntgtatctgcgtaatgaaccnncctagagtaggtcggacggtaccaccggctaattagttaacttacgtggtacgaacggaaactacgtcctaggaccggttaaccctacgtaaccctaccctacgaacgttaccgaaggtccgttaccgggttacccgtaccccggggtccggggacccgtaaaccgggtaccccggttggtaccccgtacccggttcctcccgtacgaccgtcccgtaacccgaacccggaaccggtccccgtaaccgttcccggttaccccctttcccccgtaccggtcccctaccccgttaccccgtaaccgtaaccgaccgtaccgacccgttacgggtaccgggaccgaacccgacggggccccggtacccgggttccggtcccgggttaccgggtaccgttaccggggttaacccgtaaccggggtttaacccgttaaccccgggtttaccggtaaccggtttaacggtaacccgtaacccgggg

SEQ ID NO: 293703 - DNA, 780 bp, Homo sapiens
  misc_feature: GYAE6OF02IINPH.16.10.A10.1.454.CMB.1.raw
  modified_base (154)..(154): a, c, t, g, unknown or other
  misc_feature (154)..(154): n is a, c, g, or t
  modified_base (228)..(228): a, c, t, g, unknown or other
  misc_feature (228)..(228): n is a, c, g, or t
tcagtgtactactccacgaccggtgctcgatttagcgtcgatctcagggggtgggtccaggaggcagaactctgggtgtctcaccatggcctggatccctctacttcctccccctcctcactctctgcacaggctctgacggccttccgtttgngttcgacacgagccacccgtcggtgtcgacgtcgtacccaggacgagacggcaggactacactgtctcttcagntcgctattcgaccgaaggactaatagtcgtccttacgttcggacctagacgaagaacgccgacggccgacggtccccgtggtcggtggtagattaataaataaacgacgaacgtacgacgggtaccgtaccgtacggaacggtccgtacccggtggggtaccgtagtttcctggtaccggccgtacacggtacacgggtaacgggaccgtacgtaccggttactacgtaccgtacggtacggtacgggttcgggaaccgggtcgtaaccggacggaaacggtaaacggggtcgggtaaacggggttaccgtaacgtttaacgtttacgtacggttaccggttagttaacccggttacaaaccggaaaccctaccgtaacgtacggaccggttacgggttaccggttcgggtcccggggaacgggaaccgggtaaccgtaggtacccgtaccggtccgtcccgtacggccggtaccgacccggacgtaccggtcccgtacccggtcccgtaccggtaccgtacccgtcgttacccccgttaccgtaaccccgg

SEQ ID NO: 293704 - DNA, 847 bp, Homo sapiens
  misc_feature: GYAE6OF02JOER0.16.10.A10.1.454.CMB.1.raw
  modified_base (376)..(376): a, c, t, g, unknown or other
  misc_feature (376)..(376): n is a, c, g, or t
  modified_base (406)..(406): a, c, t, g, unknown or other
  misc_feature (406)..(406): n is a, c, g, or t
  modified_base (426)..(426): a, c, t, g, unknown or other
  misc_feature (426)..(426): n is a, c, g, or t
tcagtgtactactccacgaccggtgctcgatttagcgtcgatctcagggtcttcgttggctcacgtccacccaccacgcatgtgacctcaggggtccctgagactcctcctgtgcagcctctggattcacccttagcggttatcgccatgagcgtcgggtcccgccgaggcctccgaggggaaggggctgggaggtcgggtcttactaaacgtttttagtgggttaggtggttggtccgacgccttactacgcgtagaacgtccggtaggaacggggcccgtattccaacctactcctaccgaagaacgtacctaacttccggaaacggaacacggcttgtaactcgtgacgaaagtcgaaacgcgacctaggagnggacgaaggacaaccgctataattacttanggtaacgcaaagtctaccgngaacgtaccttacgtaacccgctacgaagtaccgtacgttccgttcgggttccccggaaccccggttacgggaccggtaaacccgggtaacccgttaccggtacccggtaaccccgtaccgttccccgtaccgtaccgttaccccgtacccgaaccggaaacccggacccggttaccgttcccgggtttaaccccccgtttccccgtaaccgggtccccctttacccccggttacccgtaaacccctaaagggtaacccgaccttaaccccgggttacccgggtccggggaacccaacccgggacgggtacccgggtaccccgggttccgggtccttaccgggttacccgtaccggggttacctaaaccggttacccgttccccggttaacgggaccgggtttaacgtaaccggtacgggg

SEQ ID NO: 293705 - DNA, 741 bp, Homo sapiens
  misc_feature: GYAE6OF02IO07Y.16.10.A10.1.454.CMB.1.raw
  modified_base (168)..(168): a, c, t, g, unknown or other
  misc_feature (168)..(168): n is a, c, g, or t
  modified_base (174)..(174): a, c, t, g, unknown or other
  misc_feature (174)..(174): n is a, c, g, or t
  modified_base (184)..(184): a, c, t, g, unknown or other
  misc_feature (184)..(184): n is a, c, g, or t
  modified_base (193)..(193): a, c, t, g, unknown or other
  misc_feature (193)..(193): n is a, c, g, or t
  modified_base (261)..(261): a, c, t, g, unknown or other
  misc_feature (261)..(261): n is a, c, g, or t
tcagtgtactactccacgaccggtgctcgatttagcgtcgatctcagggggtgggtccaggaggcagaactctgggtgtctcaccatggcctggatcctctactctcccctctcactctctgcacaggctctgaggcctccgtttgagttgacacagccacctcggtntcagtntcccaggacngacgcaggntcacctgctcttcagactgactattacgacctaaaggccaatatcgacttcgtggtaccagcagaacnccgtaaggccaggaccccttggtggtcggtagaattaagtaataaaagtacacgaacaacggacggtacccccgttagaacggggaacctccggtagggggtaccttacgttaccgtaccgttggaccttaccgacggtacttaccggaaggggaaccgttaacgaagtccgtaaccggtttacaaccgtacgtacgggtaacggtacgtacgtacggaacgaagaacggaacggtagggtacgtaaacgttaacgtacgtacggttacgtaagttaccacggtaaccaaaaccgccgtaacctgaaccgtaggttacggtccgggttacggcgggaacgttaaccgaagtaccgttaccggaaccgtttcgacggttaccggacgtaacccggtaccggtaaacggtcccgttaaccggtacccccggtaggttaccccgaaccgtttccgttacccggttaaccccgttaaccccggg

SEQ ID NO: 293706 - DNA, 589 bp, Homo sapiens
  misc_feature: GYAE6OF02G5T9Y.16.10.A10.1.454.CMB.1.raw
  modified_base (413)..(413): a, c, t, g, unknown or other
  misc_feature (413)..(413): n is a, c, g, or t
  modified_base (441)..(441): a, c, t, g, unknown or other
  misc_feature (441)..(441): n is a, c, g, or t
tcagtgtactactccacgaccggtgctcgatttagcgtcgatctcaggggtgggtccaggaggcagaactctgggtgtctcaccatggcctggatccctctacttctcccctctcactctctgcacaggctctgacggccttccttttgagttgacacacgcccaccgtcggtgtcagtcgtccccgaggacagacggccaggatcacctgctcttcagatgcattcgaccaaggcaatagtgactttcgtcgtaccagcagacgccgaggaccgtacggcccctggtcggtgtagtattatataaacgacaacacgaggaccgccctgacgggtactcccggtgggccgtacgttcgtcgttcggaccgttccaacgcgttacgacgggtaccacgtacgtcacgttcgacngtcggtgacgtcgagcgaagaggacggnggatacgtaattctagtctacgtctcgaacgaaacctacactgacgtacggtcggtacgttcggacggtacgacgaacgtcgcgtaccgtcgcgtcgtcgcgaccgacgcgtccgcccgtcgtacctccgtcgtccgtcccgtacccg

SEQ ID NO: 293707 - DNA, 795 bp, Homo sapiens
  misc_feature: GYAE6OF02J1T63.16.10.A10.1.454.CMB.1.raw
tcagtgtactactccacgaccggtgctcgatttagcgtcgatctcagggggtgggtccaggaggcagaactctgggtgtctcaccatggcctggatccctctacttcctccccctctcactctcgtgcacaggctctgacggcctcttgagttgacacagcccacccgtcggtgtcgagttccgtacccccgaggaccaggaccggccaggacttccgaccgtgccttaccttacgagagtcgctaagttcggaccaaaggtccaattacgtcggtcctttacgttacggtaaccaggtcctaaggaacgtccgagggtacccgtacgggtcccctagggttacgggtacggtaacggtaactaaccgttaaaggtaaaccgaacctacgaacgtaacggtaccgggtacccttaccggaacggggtaccctcccgggttacggggtaccctttagttccgtacggtaccggtccctaccgacgttacgacggtacgggaaccgacgtacgtacgtaccgttcgaaccggttagtcgggtacgtacgtacccgtagccgaagtaacggacggtacggtaaacgtacgttagtcgtaacgtcgtaaggttcacgtaaccgaccgtcaacgttccggagtaccggttaacgggtccggcgggaaccgtaccgggtactaacggtccgttaccggaccggtacgtcggtaccgtccggaaccggtcctaacgggtcccgttacccggtccccgttaacggacccgttccgtttcccggttacccgtcccggttacccg

SEQ ID NO: 293708 - DNA, 847 bp, Homo sapiens
  misc_feature: GYAE6OF02HYBZ2.16.10.A10.1.454.CMB.1.raw
  modified_base (140)..(140): a, c, t, g, unknown or other
  misc_feature (140)..(140): n is a, c, g, or t
tcagtgtactactccacgaccggtgctcgatttagcgtcgatctcagggggtgggtccaggaggcagaactctgggtgtctcaccagtggcctggactccctctacttcctccccctctcactctctgcacgaggtcctntggacggtccctttacgtttgagttacgacacgacgcccacccgtgggtctcgtacggtcccgtacccgaggaccgacggtaccggaccgaggtacctccgtaccgtgtcctttcgtaccgaagtacgttcgaaccgttacgttccgaaccgtaaaggcctaaagttctcggttcgtttcggttacgaccgacgtacgtaaggaccgccggacgtaacccggccggttacccggtggggttacgggtacgtaagttaacgtttaaattaaacgtaaacgacctaaccggaacgtaccgggaccggtaccctagggtaacccggttaccgtccgggttacgggttaccgttacctttaccggtccgggtacgtacccgtaccggtaacgggtccgggtaaaccggaccgggtaaacgttaccgtaaccgggtttaccgtaaccggtacgtaacccgggttcggtacggggtaacgtaccggtaacgtacggaacgaaacggtacggacgggtagtacgtacttaacgtcgtagtacctacgtacgaaccgacctaacgaccgtacgacgtacgaccgggtcgtaccgggtacggaacggaccggacgttaacggccgttacgggacccgttgtacggtcgaaccggccgacggttccgacccgtaccgtccgtccgtacccgaccgttcccgttcccgtcccgtaccg

SEQ ID NO: 293709 - DNA, 887 bp, Homo sapiens
  misc_feature: GYAE6OF02FINVE.16.10.A10.1.454.CMB.1.raw
  modified_base (218)..(218): a, c, t, g, unknown or other
  misc_feature (218)..(218): n is a, c, g, or t
tcagtgtactactccacgaccggtgctcgatttagcgtcgatctcagggggtgggtccaggaggcagaactctgggtgtctcaccatggcctggatccctctacttctccccctctcactctctgcacaggctctgacggcctcctttgagttgacacagcccacccgtggtgtcagtcgtccccaggacaggacgccaggactcactgctcttcagntgcattcgacccaaggctaatactcgtccgtttacgttacggtaaccacgacgaacggaaccgccgacggcccgtaccggtccccggttgggttcgggttcggtacgtaacttaacgttaaacgtaaaccgaaccaaccgaacgaacggtaccggtacccgtacgggtaaccgggtaccgttacccgggtacgggtaccttaaccgtttccgtaccggttacggtcccttaccgtaccgggtaccgtaccgggaaccgggtaaccgtaacgtaccggtaccgtaaccggttaccgaacccgtacggggttaccgggtacgggtaccgtaccggtaacgggaccggaaacgggtaaaccgggtacgggtacgggtacgtaaccgtttacggttaccgtacgttaccgtaacggtaccttaaccgaaccctaaaccgtacccggtaacgtaccggtaccggtacgggttacccggttacggggttaccgggaaccggggtaaccgggaacccgtaccgggtcccgttacccggtacccggttaccgtaccggtaacccggtaaccggaacccggtaaccccggtaccggttaccccggttccccggttacccccggtacggttaccccgttaccccgtttaccccggttaccccgtaccccccgtacccgg

SEQ ID NO: 293710 - DNA, 777 bp, Homo sapiens
  misc_feature: GYAE6OF02FV7F6.16.10.A10.1.454.CMB.1.raw
  modified_base (638)..(638): a, c, t, g, unknown or other
  misc_feature (638)..(638): n is a, c, g, or t
  modified_base (645)..(645): a, c, t, g, unknown or other
  misc_feature (645)..(645): n is a, c, g, or t
  modified_base (717)..(717): a, c, t, g, unknown or other
  misc_feature (717)..(717): n is a, c, g, or t
tcagtgtactactccacgaccggtgctcgatttagcgtcgatctcaggggggtgggtccaggaggcagaactctgggtgtctcaccatggcctggatccctctacttctccccctctcactctctgcacaggctctggacggtcctccttttgagttgacacagcccacctcggtgtcagtcgtccccaggacagacggcctaggactcaccgtgcttcttacgagtacgtcgctagttcgacccgtaaaggctaaattacgtcggtaccgttttacgttacggggtaacccgtacggaccaaggaacggacccgtaggggacccgaaccgggtcccccctgggttccggggttgggtttacggaattaacgtaaacgttaaaaccggaactaaaccgaacgtaacgtacgggccccgttaaggaccggggtaccgttacccggtcggggaccgtaacgttttcctacgtcgggccttccggaacggtcttaccggaacgggggtaaccgaaccgtacgtacccggtaacggttcgaacccgtacgttcgggtacggaacggtccgtacggacgagaaacgggacggtacgggaatcgttaagtactcggtcttacgattaaccggacaaaccgtccngtttacnccgtagggaccggtttcgtacggggcgggaaaccggtacaacggtccgacgtcccgtttcgacgcggttacncgggacccagggtcacccgtcccggtacgtaccgtctaccgttccgtacccctaccccgg

SEQ ID NO: 293711 - DNA, 749 bp, Homo sapiens
  misc_feature: GYAE6OF02HIGOK.16.10.A10.1.454.CMB.1.raw
  modified_base (290)..(290): a, c, t, g, unknown or other
  misc_feature (290)..(290): n is a, c, g, or t
  modified_base (312)..(312): a, c, t, g, unknown or other
  misc_feature (312)..(312): n is a, c, g, or t
tcagtgtactactccacgaccggtgctcgatttagcgtcgatctcagggtcttcgtggctcacgtccaccaccacgcatgtgacctcaggggtccctgagactctcctgtgcagcctctggattcacccttagcggttatcgccatgagcgtgggtccgccaggctccgaggggaaggggctggaggtgggtctctaacttttgtggtagtggtggtcacgcctactacgcagagtccgtgaagggccgattccaccatcctccgagacgaccaccttccggaagaaccncctctgtatctagcgaatgaancgcctgagacggtcggaggtaccgacggcctatataacttcgtgtacggacgaaagtctaccgtaggaccggtacctaactaacccgtaccgtacactacggacgttccggttagggttccccgaccccgggtcggggacccgtaaccggggtaacccgttcggtacctacccgttccgtccgtccgaccgtaccctacccgaacccgggaccgggtccctaaccgttcccgggttaccccgtttcccccgtcggtaccctacccccgttaccgttacccgaacgtccgttacccgtacccgttcgggtaccggggtaccaccgggacccggtacccgggtccggtccgggttaccgtcccgggttaccgggtaccgtaacgggtaaccgtacccggttacccgttaaccggtaaccggttacgtacccgtaacggg

SEQ ID NO: 293712 - DNA, 939 bp, Homo sapiens
  misc_feature: GYAE6OF02IINOF.16.10.A10.1.454.CMB.1.raw
tcagtgtactactccacgaccggtgctcgatttagcgtcgatctcagggggtgggtccaggaggcagaactctgggtgtctcaccatggcctggatccctctacttcctcccctcctcactctctgcacaggctcgtgacggccttctttgagttgacacacgccaccctggtctacgtagtcggtccccaggtaacctaggaccgccaaggacttccgactcgccttacttcgagacttggactacgttcggacaaacggcctaaattacgtcgtacctttacgttcggtaacccaggacctaaggaaacgccgtaaccgggaccccaacgggccccccttgggtacgggttacgggttagaacgttaattaaaccgtaaaaaggtaacccgtaacgaaaccgtaacgggtaaaccggggtccccttaacggtaacgggggtaaaccttccccgggttcggggaacccggttaaaccgtttccggtaccgtttaaccgggtccttaaccccgtaaacggtttacccgtaccggtaaacgggggaacccgaaccggtaacggtttaacccttaacgggttttaccgaaaccgtaacggttacccgggtaagggtaaccgttaacccgggaacggaaaaccgtaagggtaaaccgggtaaccgggtaaaggggttactaaaccggtttaaacgttaaccgttaccggtaaccttaccggttattaaccggaaccttaaaacccgaacccctaagtccggaactaccggttaaggggtccggttacggggaaccgggaacggggttaaaccgaaacgtcggttaaccgttaccggttcccgtaacggccccgttaagaaccccggtaccgacgggtccgtacccccgacccgttacgggtccctaacccgttccgtttaccccggttacccttaacccccg

SEQ ID NO: 293713 - DNA, 777 bp, Homo sapiens
  misc_feature: GYAE6OF02H04K6.16.10.A10.1.454.CMB.1.raw
  modified_base (81)..(81): a, c, t, g, unknown or other
  misc_feature (81)..(81): n is a, c, g, or t
  modified_base (634)..(634): a, c, t, g, unknown or other
  misc_feature (634)..(634): n is a, c, g, or t
tcagtgtactactccacgaccggtgctcgatttagcgtcgatctcagggggtgggtccaggaggcagaactctgggtgtcncaccagtggcctggactccctctacttcctcccccctcctcactctctgacacgaggcttctaggacggcccttccgtttttgaacggtttgaaccacgacggtaccccaccccgttggggtcgtccttaggtcccggtacccccgaagggaccaacggaaccgggcccgaaagggtacccttacccaaaccggttcgtacttccgttacgaacggtataggtacctaacgttacgaaccggaaacgggacttaaaatacgtaccggttctttacgttaccggggtaaacacgacgaacgaaacgaccgacggtaccggaacggtcccccgtgggttcggtaggtgaaagtaactaagtaaacggacaaccgaagacggtaccgccgtacggacggtacgtccgtacggacgtagttcgtacgttcgcgtactaggaccgacgacgggtacgacggacgtcgacgttacgaccgtagcggtacggagtaccgacgacgaacgggagacgggtagtacgtatacttacgtgacgtcgtacgtacgaccgaaacnccggtacgcgacggacggttggtacggtaccggggacggaacggaacgacgtcgtaacgccgtacgtcggtacgtacgacccgagacccggttaccgcccttcgggaaccccttgttacccgaccgtccccgtaccgtacccg

SEQ ID NO: 293714 - DNA, 674 bp, Homo sapiens
  misc_feature: GYAE6OF02JICJJ.16.10.A10.1.454.CMB.1.raw
  modified_base (204)..(204): a, c, t, g, unknown or other
  misc_feature (204)..(204): n is a, c, g, or t
  modified_base (230)..(230): a, c, t, g, unknown or other
  misc_feature (230)..(230): n is a, c, g, or t
  modified_base (256)..(256): a, c, t, g, unknown or other
  misc_feature (256)..(256): n is a, c, g, or t
  modified_base (281)..(281): a, c, t, g, unknown or other
  misc_feature (281)..(281): n is a, c, g, or t
  modified_base (308)..(308): a, c, t, g, unknown or other
  misc_feature (308)..(308): n is a, c, g, or t
  modified_base (312)..(312): a, c, t, g, unknown or other
  misc_feature (312)..(312): n is a, c, g, or t
  modified_base (355)..(355): a, c, t, g, unknown or other
  misc_feature (355)..(355): n is a, c, g, or t
  modified_base (465)..(465): a, c, t, g, unknown or other
  misc_feature (465)..(465): n is a, c, g, or t
tcagtgtactactccacgaccggtgctcgatttagcgtcgatctcagggtcttcgtggctcacgtccaccaccacgcatgtgacctcaggggtccctgagactcctcctgtgcagcctctggattccacccttagcggttatgccatgagctgggtccgccaggctccgagggaagggctggagtgggtctactaacttttagnggtagtggtggtcacgcctactcganagagtccgtggacgggccattcaccntcctaccagacgacaccttccgaanaaccacgctgtatcaggcaatggaacngccngatagcgagcgacgccgatactattacgagtacgacaaaggtntccggagacgaacctactaaccgtcctagacgtcacgtcgttcgggtcgtaccccggtaggccccggacggaacccgtcgtaccgtaccgtcctccgtacaccgtacccncccgtaaccgaccggtccctacggtcccgttccccgttaccccgtccgtacccgtacccccgttacccaccgaaaccggtacgtccccgaaccgttaccgggttcccggggactaacccggccggaccggtcccgggtcccgggcctccgggtccgtaacccggtagtaccggacctttcccgtaaccgtacggtaccgtaccgtacgg
